US009074254B2

(12) United States Patent
Lavedan et al.

(10) Patent No.: US 9,074,254 B2
(45) Date of Patent: Jul. 7, 2015

(54) METHOD OF PREDICTING A PREDISPOSITION TO QT PROLONGATION

(75) Inventors: Christian Lavedan, Potomac, MD (US); Simona Volpi, Derwood, MD (US); Louis Licamele, Gaithersburg, MD (US); Kendra Tomino Mack, Westminster, MD (US); Callie Michelle Heaton, Washington, DC (US)

(73) Assignee: Vanda Pharmaceuticals, Inc., Washington, DC (US)

( * ) Notice: Subject to any disclaimer, the term of this patent is extended or adjusted under 35 U.S.C. 154(b) by 1370 days.

(21) Appl. No.: 12/593,419

(22) PCT Filed: Mar. 28, 2008

(86) PCT No.: PCT/US2008/058791
§ 371 (c)(1),
(2), (4) Date: Dec. 28, 2009

(87) PCT Pub. No.: WO2008/121899
PCT Pub. Date: Oct. 9, 2008

(65) Prior Publication Data
US 2010/0226858 A1 Sep. 9, 2010

Related U.S. Application Data

(60) Provisional application No. 60/908,734, filed on Mar. 29, 2007.

(51) Int. Cl.
C12Q 1/68 (2006.01)

(52) U.S. Cl.
CPC ........ *C12Q 1/6883* (2013.01); *C12Q 2600/156* (2013.01); *C12Q 2600/136* (2013.01)

(58) Field of Classification Search
CPC . A61K 31/519; A61K 23/00; A61K 31/7052; A61K 31/496; A61K 31/137; A61K 31/5513; A61K 31/047; A61K 31/164; A61K 31/355; C12Q 1/6883; C12Q 2600/106
See application file for complete search history.

(56) References Cited

U.S. PATENT DOCUMENTS

| 5,364,866 | A | 11/1994 | Strupczewski et al. |
| 5,658,911 | A | 8/1997 | Strupczewski et al. |
| 6,140,345 | A | 10/2000 | Strupczewski et al. |
| 6,908,734 | B2 | 6/2005 | Dragic et al. |
| 2003/0170176 | A1 | 9/2003 | Leyland-Jones |
| 2004/0091909 | A1 | 5/2004 | Huang |
| 2004/0096874 | A1 | 5/2004 | Neville et al. |
| 2006/0073506 | A1* | 4/2006 | Christians et al. ............ 435/6 |

FOREIGN PATENT DOCUMENTS

| WO | 9309276 | A1 | 5/1993 |
| WO | 9511680 | A1 | 5/1995 |
| WO | 03020707 | A1 | 3/2003 |
| WO | 03038123 | A2 | 5/2003 |
| WO | 03044226 | A2 | 5/2003 |
| WO | 2004058052 | A2 | 7/2004 |
| WO | 2006039663 | A2 | 4/2006 |
| WO | 2007035953 | A2 | 3/2007 |

OTHER PUBLICATIONS

Volpi et al; Molecular Psychiatry, vol. 14, pp. 1024-1031, 2009.*
ss 1451062 (rs993648, Oct. 2000, dbSNP, NCBI, NLM).*
Tuson et al; American Journal of Human Genetics, vol. 74 pp. 128-138, 2004.*
Juppner; Bone, vol. 17; 1995, pp. 39S-40S.*
Lucentini (The Scientist; 2004, vol. 24, p. 20).*
Hegele (Arterioscler. Thromb. Vasc. Biol.; 2002, vol. 22, pp. 1058-1061).*
Levine et al; Formulary Journal, Jun. 1, 2008, pp. 1-7.*
Volpi et al; 57th Annual meeting of the American Society of Human Genetics, 2007, Abstract.*
Heaton et al., "Whole-genome association study identifies polymorphisms in the CERKL gene associated with QT prolongation during iloperidone treatment of patients with schizophrenia," Oct. 2007, 1 page, American Society of Human Genetics 57th Annual Meeting (XP002500472).
Volpi et al., "Whole genome association study identifies polymorphisms associated with QT prolongation during iloperidone treatment of schizophrenia," Jun. 2008, pp. 1-8, Molecular Psychiatry (XP002500473).
NCBI Online Database, "Single Nucleotide Polymorphism," Sep. 2000, 6 pages, RefSNP #: rs895901 (XP002500474), http://www.ncbi.nlm.nih.gov/SNP/snp_ss.cgi?subsnp_id=1326361.
NCBI Online Database, "Single Nucleotide Polymorphism," Jul. 2003, 7 pages, RefSNP #: rs1441162 (XP002500475), http://www.ncbi.nlm.nih.gov/SNP/snp_ss.cgi?subsnp_id=11451915.
NCBI Online Database, "Single Nucleotide Polymorphism," Jun. 2003, pp. 1-6, RefSNP #: rs6433927 (XP002500476), http://www.ncbi.nlm.nih.gov/SNP/snp_ss.cgi?subsnp_id=9936521.
NCBI Online Database, "Single Nucleotide Polymorphism," Nov. 2007, 3 pages, RefSNP #: rs16867450 (XP002500477), http://www.ncbi.nlm.nih.gov/SNP/snp_ss.cgi?subsnp_id=84544314.
NCBI Online Database, "Single Nucleotide Polymorphism," Oct. 2007, pp. 1-3, RefSNP #: rs16867452 (XP002500478), http://www.ncbi.nlm.nih.gov/SNP/snp_ss.cgi?subsnp_id=79032989.
NCBI Online Database, "Single Nucleotide Polymorphism," Nov. 2007, 3 pages, RefSNP #: rs993648 (XP002500479), http://www.ncbi.nlm.nih.gov/SNP/snp_ss.cgi?subsnp_id=83108969.
NCBI Online Database, "Single Nucleotide Polymorphism," Nov. 2007, 3 pages, RefSNP #: rs993650 (XP002500480), http://www.ncbi.nlm.nih.gov/SNP/snp_ss.cgi?subsnp_id=86142829.
Patent Cooperation Treaty, PCT Notification Concerning Transmittal of International Preliminary Report on Patentability and Written Opinion of the International Searching Authority, for International Application No. PCT/US2008/058791 dated Oct. 8, 2009, 10 pages.
Patent Cooperation Treaty, PCT Notification Concerning Transmittal of International Search Report and the Written Opinion of the International Searching Authority, or the Declaration, for International Application No. PCT/US2008/058791 dated Nov. 7, 2008, 19 pages.

* cited by examiner

*Primary Examiner* — Jehanne Sitton
(74) *Attorney, Agent, or Firm* — Hoffman Warnick LLC

(57) ABSTRACT

The present invention describes an association between genetic polymorphisms in the ceramide kinase-like (CERKL) gene and a predisposition to prolongation of the QT interval, and provides related methods for the prediction of such a predisposition, the administration of QT interval-prolonging compounds to individuals having such a predisposition, and determining whether a compound is capable of inducing QT prolongation.

6 Claims, No Drawings

METHOD OF PREDICTING A PREDISPOSITION TO QT PROLONGATION

CROSS-REFERENCE TO RELATED APPLICATIONS

This application claims the benefit of co-pending U.S. Provisional Patent Application No. 60/908,734, filed 29 Mar. 2007, which is hereby incorporated herein.

SEQUENCE LISTINGS

The sequence listings contained in the electronic file titled "VAND-0042-PCT_sequence_listings.txt," created 28 Mar. 2008, comprising 4.1 MB, is hereby incorporated herein.

BACKGROUND OF THE INVENTION

1. Technical Field

The invention relates generally to a method of predicting an individual's predisposition to QT prolongation, and more particularly, to a method of predicting such predisposition based on a sequence of the individual's ceramide kinase-like (CERKL) gene.

2. Background

Prolongation of the electrocardiographic QT interval (the time between the start of the Q wave and the end of the T wave) is referred to as long QT syndrome (LQTS). LQTS may comprise a genetic component. In some patients with LQTS, QT prolongation can be a chronic condition. In some persons, LQTS may be induced by the administration of an active pharmaceutical ingredient that prolongs the QT interval.

A number of compounds are believed to be capable of prolonging the QT interval. These include amiodarone, arsenic trioxide, bepridil, chloroquine, chlorpromazine, cisapride, clarithromycin, disopyramide, dofetilide, domperidone, droperidol, erythromycin, halofantrine, haloperidol, ibutilide, iloperidone, levomethadyl, mesoridazine, methadone, pentamidine, pimozide, procainamide, quinidine, sotalol, sparfloxacin, and thioridazine.

Other compounds are suspected of being capable of prolonging the QT interval, although such prolongation has not been definitively established. These include alfuzosin, amantadine, azithromycin, chloral hydrate, clozapine, dolasetron, felbamate, flecamide, foscarnet, fosphenyloin, gatifloxacin, gemifloxacin, granisetron, indapamide, isradipine, levofloxacin, lithium, moexipril, moxifloxacin, nicardipine, octreotide, ofloxacin, ondansetron, quetiapine, ranolazine, risperidone, roxithromycin, tacrolimus, tamoxifen, telithromycin, tizanidine, vardenafil, venlafaxine, voriconazole, and ziprasidone.

Individuals at risk of suffering LQTS are advised not to use still other compounds, due to the possibility that they may prolong the QT interval. These include albuterol, amitriptyline, amoxapine, amphetamine, dextroamphetamine, atomoxetine, chloroquine, ciprofloxacin, citalopram, clomipramine, cocaine, desipramine, dexmethylphenidate, dobutamine, dopamine, doxepin, ephedrine, epinephrine, fenfluramine, fluconazole, fluoxetine, galantamine, imipramine, isoproterenol, itraconazole, ketoconazole, levalbuterol, metaproterenol, methylphenidate, mexiletine, midodrine, norepinephrine, nortriptyline, paroxetine, phentermine, phenylephrine, phenylpropanolamine, protriptyline, pseudoephedrine, ritodrine, salmeterol, sertraline, sibutramine, solifenacin, terbutaline, tolterodine, trimethoprim-sulfa, and trimipramine.

The CERKL gene has been mapped by Tuson et al. to 2q31.2-q32.3, between the ITGA4 gene and the NEUROD1 gene, and determined to contain 13 exons. Tuson et al., *Mutations of CERKL, a novel human ceramide kinase gene, causes autosomal recessive retinitis pigmentosa (RP26)*, Am. J. Hum. Genet. 74: 128-138, 2004. PubMed ID: 14681825. Ceramide kinases convert the sphingolipid metabolite ceramide into ceramide-1-phosphate, both of which mediate cellular apoptosis.

SUMMARY OF THE INVENTION

The present invention describes an association between genetic polymorphisms in the ceramide kinase-like (CERKL) gene and a predisposition to prolongation of the QT interval, and provides related methods for the diagnosis of such predisposition and for the administration of QT interval-prolonging compounds to individuals having such a predisposition.

A first aspect of the invention provides a method of administering to an individual a compound capable of prolonging the individual's QT interval (e.g., a compound the administration has been linked to prolonged QT, such as in clinical studies in humans), the method comprising: determining at least a portion of an individual's ceramide kinase-like (CERKL) gene sequence; and in the case that a portion of the individual's CERKL gene sequence is associated with an increased risk of QT prolongation, administering to the individual a quantity of the compound less than would be administered to an individual having a CERKL gene sequence not associated with an increased risk of QT prolongation, or electing instead to treat the individual with a different compound not known to be associated with QT prolongation.

A second aspect of the invention provides a method of determining whether or not an individual is predisposed to prolongation of the QT interval, the method comprising: determining at least a portion of an individual's ceramide kinase-like (CERKL) gene sequence. All or a portion, including a SNP described hereinbelow, can be compared to CERKL gene sequences that are associated with QT prolongation.

A third aspect of the invention provides a method of administering a compound capable of prolonging QT interval to an individual suffering from long QT syndrome (LQTS), the method comprising: determining at least a portion of an individual's ceramide kinase-like (CERKL) gene sequence; and administering to the individual a quantity of the compound based on the individual's CERKL gene sequence.

A fourth aspect of the invention provides a method of administering to an individual a compound capable of prolonging the individual's QT interval, the method comprising: characterizing an expression product of an individual's ceramide kinase-like (CERKL) gene; and in the case that the characterized expression product is associated with an increased risk of QT prolongation, administering to the individual a quantity of the compound less than would be administered to an individual having a CERKL gene expression product not associated with an increased risk of QT prolongation. Expression products of the CERKL gene may include, for example, mRNA and protein including any isoform of the mRNA and protein.

fifth aspect of the invention provides a method of determining whether an individual is predisposed to prolongation of the QT interval, the method comprising: characterizing an expression product of an individual's ceramide kinase-like (CERKL) gene. All or a portion of the gene expression product can be compared to CERKL gene expression products that are associated with QT prolongation.

A sixth aspect of the invention provides a method of administering a compound capable of prolonging a QT interval to an individual suffering from long QT syndrome (LQTS), the method comprising: characterizing an expression product of an individual's ceramide kinase-like (CERKL) gene; and administering to the individual a quantity of the compound based on the characterized expression product.

A seventh aspect of the invention provides a method of determining whether a compound is capable of prolonging QT interval in an individual, the method comprising: measuring an expression product of the individual's ceramide kinase-like (CERKL) gene; administering to the individual a quantity of the compound; remeasuring the expression product of the individual's CERKL gene; and determining whether the compound is capable of prolonging the individual's QT interval based on a difference in the measurements of the expression product of the individual's CERKL gene.

An eighth aspect of the invention provides a method of determining whether a compound is capable of prolonging a QT interval in an individual, the method comprising: measuring a QT interval of each of a plurality of test organisms, the plurality including a first test organism having a ceramide kinase-like (CERKL) genotype associated with a predisposition for prolongation of QT interval and a second organism having a CERKL genotype not associated with a predisposition for prolongation of QT interval; administering a quantity of the compound to each of the plurality of test organisms; remeasuring a QT interval of at least the first test organism; and determining that the compound is capable of prolonging a QT interval in an individual in the case that the remeasured QT interval is greater than the measured QT interval. Test organisms may include, for example, humans, animal models, and/or cell lines.

In further aspects of the inventions, the invention comprises method for determining an individual's genotype for the CERKL gene that comprises determining the individual's genotype at least one single nucleotide polymorphism (SNP) locus selected from the group consisting of: rs895901, rs1441162, rs993650, rs993648, rs16867450, rs16867452, and rs6433927, as well as a method for reporting a person's genotype for the CERKL gene that comprises determining and reporting the individual's genotype at least one single nucleotide polymorphism (SNP) locus selected from the group consisting of: rs895901, rs1441162, rs993650, rs993648, rs16867450, rs16867452, and rs6433927.

DETAILED DESCRIPTION OF THE INVENTION

As indicated above, the invention provides a method of predicting an individual's, e.g., a human subject's, predisposition to QT prolongation based on the sequence of the individual's ceramide kinase-like (CERKL) gene.

A number of single nucleotide polymorphisms (SNPs) within the CERKL gene have been found to have a significant correlation to a predisposition to drug-induced QT prolongation. Table 1, below, shows such SNPs and the genotypes associated with QT prolongation following the administration of iloperidone.

TABLE 1

CERKL SNP Genotypes and QT Prolongation Following Administration of Iloperidone

| Affymetrix SNP No. | rs number[1] | Position | Flank | Orientation | Lowest QTc change | P value[3] | Allele A | Allele B | Seq. ID No. |
|---|---|---|---|---|---|---|---|---|---|
| SNP_A-2220578 | rs17226490 | 142613 | ccttcttccaaaaaaa[C/G]ttggagatccctgttc | forward | Non-AA | 0.230510123 | A | G | 1 |
| SNP_A-191199 | rs16867442 | 142502 | tgtgagaagttacata[A/C]aatagtgatactgtag | reverse | AB | 0.523235967 | A | C | 2 |
| SNP_A-1937552 | rs718449 | 141189 | ttgaactccacacttg[C/T]accatcatggcactcc | forward | AB | 0.222483417 | C | T | 3 |
| SNP_A-1950600 | rs12623737 | 132230 | tttcatctgaacattg[A/C]agaatgacatctacat | forward | AB | 0.077895801 | A | C | 4 |
| SNP_A-4262423 | rs10514624 | 128459 | ctgtgagtttgaagta[C/T]ggtgggtatgcccaag | reverse | AB | 0.415376626 | C | T | 5 |
| SNP_A-1966128 | rs10490688 | 124294 | caaatacaattcagag[A/C]ccttactgtggcatgt | reverse | AB | 0.007281497 | A | C | 6 |
| SNP_A-2246382 | rs16867447 | 121205 | ctggttctactggtaa[A/T]ctgttttcaaaataa | forward | AB | 0.059152747 | A | T | 7 |
| SNP_A-1966129 | rs6706370 | 118832 | actgttaaaccttatg[A/T]gagcttcagattctatat | forward | Non-AA | 0.136332739 | A | T | 8 |
| SNP_A-2140582 | rs895901 | 109658 | tgctctgtgttcaacat[A/T]gtgcaggatgcgagatg | forward | AB | 0.004039676 | A | T | 9 |
| SNP_A-1937875 | rs1441162 | 91975 | ttgaatcatttgcgcc[A/C]aggaactggacagacc | forward | AA | 0.003384913 | A | C | 10 |
| SNP_A-2122170 | rs993650 | 90904 | agtgatttccagtata[C/T]gctgttaagtttaaaa | reverse | AB | 4.83E-07 | C | T | 11 |
| SNP_A-4232718 | rs993648 | 90758 | cccettataggtaacc[A/G]attgcactggtttcta | forward | AB | 2.60E-07 | A | G | 12 |

TABLE 1-continued

CERKL SNP Genotypes and QT Prolongation Following Administration of Iloperidone

| Affymetrix SNP No. | rs number[1] | Position | Flank | Orientation | Lowest QTc change | P value[3] | Allele A | Allele B | Seq. ID No. |
|---|---|---|---|---|---|---|---|---|---|
| SNP_A-2216593 | rs16867450 | 89951 | cctctatatctcaaag[A/G] aaactcaatttcaact | reverse | Non-AA | 0.004139028 | A | G | 13 |
| SNP_A-2216297 | rs16867452 | 86371 | cctcctctaccatcta[C/T] cggttgtttaaccttg | reverse | BB | 0.005241705 | C | T | 14 |
| SNP_A-1827109 | rs6433927 | 60587 | tggcttcctctaattt[C/G] tactccaaaatggtt | forward | Non-AA | 0.001479588 | C | G | 15 |
| SNP_A-1966130 | rs10497581 | 53701 | tcttctcccaataggt[A/G] aagtacgacagagctc | forward | Non-AA | 0.52388901 | A | G | 16 |
| SNP_A-2310431 | rs13398869 | 42469 | ggaactgtcttaaaag[C/T] ctgaaagaagtcagat | reverse | Non-BB | 0.075041974 | C | T | 17 |
| SNP_A-1893037 | rs1967351 | 26643 | tgcactgtaggttaaa[C/T] tggctctttgggctaa | reverse | Non-BB | 0.258267198 | C | T | 18 |
| SNP_A-4275669 | rs10207791 | 23890 | aatggggaagcagtca[A/G] gaagaaagtgagtccc | reverse | Non-AA | 0.138169504 | A | G | 19 |
| SNP_A-2065238 | rs2696344 | 13541 | aattggcttctcttaa[C/G] tatatgagatagggtt | forward | Non-BB | 0.086456719 | C | G | 20 |
| SNP_A-1966131 | rs12053195 | 6069 | actagtactgtcccag[A/G] aaaatttatacacctt | forward | Non-AA | 0.399257392 | A | G | 21 |
| | | 77898 | cagtgtctgttgttcct[C/T] tctatgaaacacaatgg | forward | A/B | 0.0047 | T | C | 22 |
| | rs6433923 | 77934 | taattggaaaattta[T/A]t tttttttcaggtg | forward | A/B | 0.0045 | T | A | 23 |
| | | 77949 | tttttttcaggtg[A/C]tt ctaagtatgacttgc | forward | A/B | 0.2241 | A | C | 24 |

The following SNP genotypes were found to most accurately predict a predisposition to QT prolongation: non-AT at rs895901, non-AA at rs1441162, non-CT at rs993650, non-AG at rs993648, AA at rs16867450, non-TT at rs16867452, and CC at rs6433927. These genotypes are included amongst all genotypes associated with a predisposition to QT prolongation. Therefore, individuals possessing one or more of these genotypes may be considered predisposed to QT prolongation following the administration of a compound capable of prolonging the QT interval.

Since the QT interval changes with changes in heart rate, the QT interval is often measured as a corrected QT (QTc) interval. Any number of formulas may be employed to calculate the QTc, including, for example, the Fridericia formula (QTcF), the Bazett formula (QTcB), and the Rautaharju formula (QTp), among others. In the studies described herein, QT was calculated using the Fridericia formula. However, the present invention includes the use of any such formula or method for calculating a QTc or an uncorrected QT.

As noted above, a large number of compounds are known or suspected to be capable of inducing QT prolongation in some individuals, including individuals not suffering from LQTS. One such compound is iloperidone. Iloperidone is disclosed in U.S. Pat. Nos. 5,364,866, 5,658,911, and 6,140,345, each of which is incorporated herein by reference. Metabolites of iloperidone may also be capable of prolonging a QT interval. Metabolites of Iloperidone, e.g., 1-[4-[3-[4-(6-Fluoro-1,2-benzisoxazol-3-yl)-1-piperidinyl]propoxy]-3-methoxyphenyl]ethanol, are described in International Patent Application Publication No. WO03020707, which is also incorporated herein by reference.

Other iloperidone metabolites include: 1-[4-[3-[4-(6-Fluoro-1,2-benzisoxazol-3-yl)-1-piperidinyl]propoxy]-3-hydroxyphenyl]ethanone; 1-[4-[3-[4-(6-Fluoro-1,2-benzisoxazol-3-yl)-1-piperidinyl]propoxy]-3-methoxyphenyl]-2-hydroxyethanone; 4-[3-[4-(6-Fluoro-1,2-benzisoxazol-3-yl)-1-piperidinyl]propoxy]-3-hydroxy-α-methylbenzene methanol; 4-[3-[4-(6-Fluoro-1,2-benzisoxazol-3-yl)-1-piperidinyl]propoxyl-2-hydroxy-5-methoxy-α-methylbenzenemethanol; 1-[4-[3-[4-(6-Fluoro-1,2-benzisoxazol-3-yl)-1-piperidinyl]propoxy]-2-hydroxy-5-methoxyphenyl] ethanone; and 1-[4-[3-[4-(6-Fluoro-1,2-benzisoxazol-3-yl)-1-piperidinyl]propoxy]-2,5-dihydroxyphenyl]ethanone. See U.S. Pat. No. 5,364,866 and International Patent Application Publication Nos. WO9309276 and WO9511680, which are incorporated herein by reference.

In some embodiments of the invention, a compound known or suspected to be capable of inducing QT prolongation has the formula:

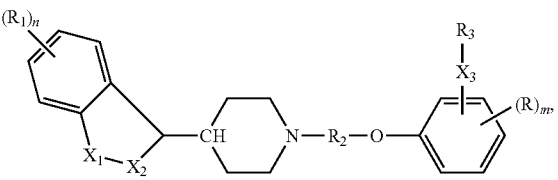

(1)

wherein: R is, independently, hydrogen, lower alkyl, lower alkoxy, hydroxyl, carboxyl, lower hydroxyketone, lower alkanol, hydroxyl acetic acid, pyruvic acid, ethanediol, chlorine, fluorine, bromine, iodine, amino, lower mono or dialkylamino, nitro, lower alkyl thio, trifluoromethoxy, cyano, acylamino, trifluoromethyl, trifluoroacetyl, aminocarbonyl, monoaklylaminocarbonyl, dialkylaminocarbonyl, formyl,

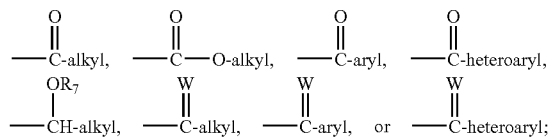

alkyl is lower alkyl, branched or straight and saturated or unsaturated; acyl is lower alkyl or lower alkyloxy bonded through a carbonyl; aryl is phenyl or phenyl substituted with at least one group, $R_5$, wherein each $R_5$ is, independently, hydrogen, lower alkyl, lower alkoxy, hydroxy, chlorine, fluorine, bromine, iodine, lower monoalkylamino, lower dialkylamino, nitro, cyano, trifluoromethyl, or trifluoromethoxy; heteroaryl is is a five- or six-membered aryl ring having at least one heteroatom, $Q_3$, wherein each $Q_3$ is, independently, —O—, —S—, —N(H)—, or —C(H)=N—, W is $CH_2$ or $CHR_8$ or N—$R_9$; $R_1$ is —H, lower alkyl, —OH, halo, lower alkoxy, trifluormethyl, nitro, or amino; $R_2$ is $C_2$-$C_5$ alkylene, alkenylene (cis or trans), or alkynylene, optionally substituted by at least one $C_1$-$C_6$ linear alkyl group, phenyl group or

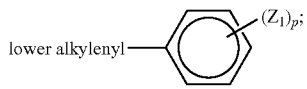

where $Z_1$ is lower alkyl, —OH, lower alkoxy, —$CF_3$, —$NO_2$, —$NH_2$, or halogen; $R_3$ is lower alkyl or hydrogen; $R_7$ is hydrogen, lower alkyl, or acyl; $R_8$ is lower alkyl; $R_9$ is hydroxy, lower alkoxy, or —$NHR_{10}$; $R_{10}$ is hydrogen, lower alkyl, $C_1$-$C_3$ acyl, aryl,

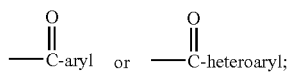

$X_1$, $X_2$, and $X_3$ are, independently, —O—, —S—, =N—, or —N($R_3$)—, or $X_1$ and $X_2$ are not covalently bound to each other and are, independently, —OH, =O, —$R_3$, or =$NR_3$; lower is 1-4 carbon atoms; m is 1, 2, or 3; and n is 1 or 2.

In some such compounds, R is —C(O)$CH_2$OH, —CH(OH)C(O)$CH_2$OH, —C(O)OH, CH(OH)$CH_3$, or C(O)$CH_3$; $R_1$ is halo; $X_1$ and $X_2$ are different and are =O, —OH, =N—, or —O—; $R_2$ is $C_2$-$C_4$ alkylene or alkenylene; $R_3$ is hydrogen, methyl, or ethyl; $X_3$ is —O—; and R is substituted as shown in Formula 1A (1A)

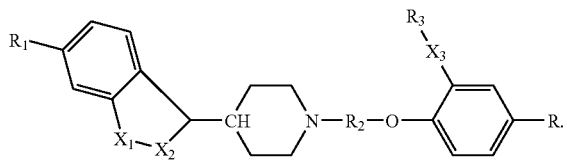

In some embodiments, the compound of Formula 1 is 1-[4-3-[4-(6-fluoro-1,2-benzisoxazol-3-yl)-1-piperidinyl]propoxy]-3-methoxyphenyl]ethanone, as shown in Formula 1 B:

(1B)

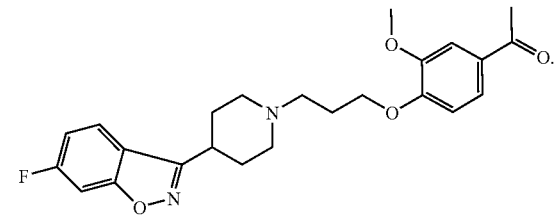

In still other embodiments, the compound of Formula 1 is 1-[4-[3-[4-(6-Fluoro-1,2-benzisoxazol-3-yl)-1-piperidinyl] propoxy]-3-methoxyphenyl]ethanol, as shown in Formula 10:

(1C)

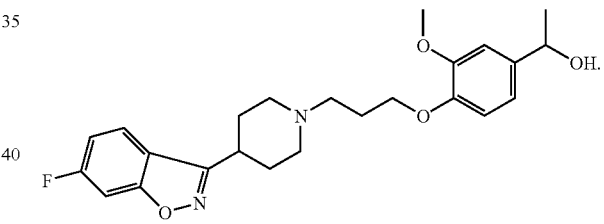

Using the genotypes at the SNP loci above, it is possible, with a high degree of certainty, to predict an individual's predisposition to QT prolongation. Table 2 below shows the results of a study of 174 individuals, each of whom was genotyped at the rs993648 locus and their QT interval measured following the oral administration of 24 mg/day B.I.D. of iloperidone for a period of two weeks.

TABLE 2

QT Prolongation and Presence or Absence of a Genotype for
SNP__A-4232718, rs993648 Associated with a Predisposition to QT Prolongation

| Change Threshold (msec) | Low QT | | High QT | | Odds Ratio | p value | sensitivity | specificity | negative predictive value | positive predictive value |
|---|---|---|---|---|---|---|---|---|---|---|
| | −test | +test | −test | +test | | | | | | |
| QT > 5 | 42 | 22 | 38 | 72 | 3.62 | 0.0001 | 0.65 | 0.66 | 0.53 | 0.77 |
| QT > 15 | 62 | 41 | 18 | 53 | 4.45 | <0.0001 | 0.75 | 0.60 | 0.78 | 0.56 |
| QT > 30 | 76 | 71 | 4 | 23 | 6.16 | 0.0013 | 0.85 | 0.52 | 0.95 | 0.24 |

As can be seen in Table 2, an individual's CERKL sequence at the SNP_A-4232718, rs993648 locus is highly predictive of whether the individual will experience QT prolongation following the administration of iloperidone. For example, using the lowest threshold of a change in QTc interval (between baseline and the end of the second week) greater than 5 milliseconds (normal QTc intervals are between 0.30 and 0.44 seconds for males and between 0.30 and 0.45 for females), 72 of those individuals with a SNP genotype (test is considered positive if genotype for SNP_A-4232718, rs993648 is non-AB) associated with a predisposition to QT prolongation experienced QT prolongation while only 22 such individuals did not. Similarly, nearly twice as many individuals (72) experiencing QT prolongation possessed a SNP genotype associated with a predisposition to QT prolongation as did not (38). This resulted in a sensitivity (probability that the individual will have a SNP genotype associated with a predisposition to QT prolongation, given that he/she experienced QT prolongation) of 0.65 and a specificity (probability that the individual will not have a SNP genotype associated with a predisposition to QT prolongation, given that he/she did not experience QT prolongation) of 0.66, a negative predictive value (probability that the individual will not experience QT prolongation, given that he/she does not have a SNP genotype associated with a predisposition to QT prolongation) of 0.53, and a positive predictive value (probability that the individual will experience QT prolongation, given that he/she has a SNP genotype associated with a predisposition to QT prolongation) of 0.77.

The use of higher thresholds (i.e., QTs greater than 15 and 30 milliseconds) yielded markedly increased negative predictive values (0.78 and 0.95, respectively). The associated decrease in positive predictive values, from 0.77 for QTs greater than 5 milliseconds to 0.24 for QTs greater than 30 milliseconds) suggests that additional factors affect more severe QT prolongation.

As the data in Table 2 show, an individual's CERKL sequence at the SNP loci above may be used to predict whether an individual is predisposed to QT prolongation due to the administration of a compound capable of prolonging the QT interval. That is, individuals having one or more SNP genotype associated with a predisposition to QT prolongation may reliably be predicted to experience a prolonged QT interval (i.e., a QT interval prolonged by at least 5 milliseconds) following the administration of a compound capable of prolonging the QT interval. Similarly, individuals not having any of the above SNP genotypes associated with a predisposition to QT prolongation may reliably be predicted to not experience severe QT prolongation (i.e., a QT interval prolonged greater than 15 milliseconds) following the administration of a compound capable of prolonging the QT interval.

The ability to make such predictions may be used in deciding whether to treat an individual with a particular compound and/or in determining the dosage appropriate for the individual. For example, an individual predicted to experience QT prolongation may be treated with an alternative compound not known or suspected to cause QT prolongation or may be administered a lower dose of a compound capable of causing QT prolongation than would be administered to an individual not predicted to experience QT prolongation.

The present invention also includes the administration of another compound useful in treating LQTS, in addition to one or more of the compounds above. Compounds useful in treating LQTS and/or preventing cardiac events resulting from LQTS, include, for example, beta blockers, such as propranolol, nadolol, atenolol, metoprolol.

The present invention also includes the prediction of an individual's predisposition for QT prolongation based on one or more of the SNP loci above in combination with the individual's genotype or gene sequence at one or more additional genes or loci. For example, International Patent Application Publication No. WO2006039663, incorporated herein by reference, describes a method of treating an individual with a compound capable of inducing QT prolongation based on the individual's CYP2D6 genotype. Other genotypes and/or gene sequences may similarly be used in combination with the SNP loci above, including those associated with LQTS.

Multiple techniques for determining the sequence of the CERKL gene or of one or more portions thereof (including, e.g., the following SNPs: rs895901, rs1441162, rs993650, rs993648, rs16867450, rs16867452, rs6433927) are well known in the art. These include amplifying and sequencing genomic or complementary DNA or mRNA as well as, e.g., hybridization techniques.

After determining the genotype across the entire CERKL gene or a portion of it, such as the SNPs identified above, the patient's genotype can be compared to genotypes described above as being associated with prolonged QT prolongation. Thus, e.g., if a given individual's genotype at rs993648 is other than A in one gene and G in the second copy of that gene, then, with reference to Table 1, one can see that that person is predisposed to prolonged QT interval.

In one practice of the invention, a person or other entity performing a genotyping test for an individual's CERKL gene will determine the genotype only for one or more of single nucleotide polymorphism (SNP) loci selected from the group consisting of: rs895901, rs1441162, rs993650, rs993648, rs16867450, rs16867452, and rs6433927. In a related practice of the invention, a person or other entity that performs such genotype assay will determine the person's genotype at one or more of said loci and will report the person's genotype only at such one or more of said loci.

It should also be understood that the present invention includes the characterization of an expression product of the CERKL gene rather than, or in addition to, the determination of one or more SNP genotypes within the CERKL gene. For example, by determining a sequence of an mRNA strand transcribed from the CERKL gene, it is possible to determine the sequence of the CERKL gene itself and, as described above, determine whether the CERKL gene sequence is associated with a predisposition to QT prolongation.

Similarly, by properly characterizing a peptide or protein, including the CERKL enzyme, translated from the mRNA strand above, it is possible to determine the sequence of the CERKL gene itself and, as described above, determine whether the CERKL gene sequence is associated with a predisposition to QT prolongation.

Phenotypic assays that indirectly determine a person's CERKL genotype are described, e.g., with respect to CYP2D6 alleles, by Leyland-Jones, US20030170176.

This invention encompasses kits and reagents for determining an individual's CERKL genotype, including, e.g., probes and primers. Kits of the invention include reagents and, optionally, other materials, useful in determining an individual's genotype for the CERKL gene. Such kit may include, e.g., a detection means, a collection device, containers, and instructions, and may be used in determining a patient's CERKL genotype, such as for determining an appropriate treatment strategy for a person having a disorder for which iloperidone is indicated. Such treatment strategy might comprise, e.g., choosing a different drug, i.e., one not associated with QT prolongation, adjusting the dose of iloperidone, or monitoring the patient during treatment for prolonged QT interval.

Detection means may detect a CYP2D6 polymorphism directly or indirectly via mRNA or protein. Such detection means may also indirectly determine genotype at a relevant loci by taking advantage of linkage disequilibrium with another polymorphism. Detection means include, e.g., polynucleotides used in amplification, sequencing and SNP detection techniques, Invader(R) assays (Third Wave Technologies Inc.), Taqman(R) assays (Applied Biosystems, Inc.) gene chip assays (such as those available from Affymetrix, Inc.), pyrosequencing, fluorescence resonance energy transfer (FRET)-based cleavage assays, fluorescent polarization, denaturing HPLC, mass spectometry, and polynucleotides having fluorescent or radiological tags used in amplification and sequencing.

Collection devices suitable for use in the invention include devices known in the art for collecting and/or storing a biological sample of an individual from which nucleic acids and/or polypeptides can be isolated. Such biological samples include, for example, whole blood, semen, saliva, tears, urine, fecal material, buccal smears, skin, hair, and biopsy samples. Accordingly, suitable collection devices include, for example, specimens cups, swabs, glass slides, test tubes, lancets, and Vacutainer(R) tubes and kits.

An illustrative embodiment of a kit of the invention is a kit that comprises a set of oligonucleotides, wherein each member of the set selectively, hybridizes to regions of selected variants of the CERKL gene that comprise one or more SNPs selected from the group consisting of: rs895901, rs1441162, rs993650, rs993648, rs16867450, rs16867452, and rs6433927. By "selectively hybridizes," one of skill in the art would understand that the oligonucleotide will hybridize preferentially for a given SNP genotype such that the nucleotide in that SNP locus can be determined. Such oligonucleotides can be provided, e.g., in the form of an array of nucleic acid molecules attached to a support, wherein the array has oligonucleotides that will hybridize to selected allelic variants, or SNPs, of CERKL, such as, e.g., rs993648.

Such nucleic acids of the invention can be used, for e.g., in prognostic methods, such as are described herein. Specifically, for example, the nucleic acids of the invention can be used as probes or primers to determine whether a subject has a genotype for the CERKL gene that is associated with predisposition to QT prolongation.

Assays for determining genotype for the CERKL gene can be done in many clinical laboratories, such as those found in a typical hospital, clinic and private reference laboratories. In accordance with an aspect of this invention, kits are designed that contain some or all the reagents, primers and solutions for the genotyping assay.

An illustrative assay for determining an individuals CERKL genotype comprises: a) obtaining a genomic DNA sample of said subject; b) using the DNA sample of step a), amplifying a fragment comprising a polymorphic site of the CYP2D6 genes; c) hybridizing the amplified fragment of step b) with allele-specific oligonucleotides probes corresponding to wild type and variant alleles to determine the CYP2D6 genotype of the subject. Such methods include methods that are well known, such as are disclosed by Milos et al., US20030170176, Huang, US20040091909, Neville, et al., US20040096874, WO03544266, and WO03038123.

In addition, the present invention includes determining whether a compound is capable of prolonging a QT interval in an individual. This may be done, for example, by measuring a change in QT interval in a test organism (e.g., human, animal model, cell line) known to possess a CERKL genotype associated with a predisposition to QT prolongation following the administration of a quantity of compound under study. Preferably, the compound is also administered to a test organism known to possess a CERKL genotype not associated with a predisposition to QT prolongation.

The foregoing description of various aspects of the invention has been presented for purposes of illustration and description. It is not intended to be exhaustive or to limit the invention to the precise form disclosed, and obviously, many modifications and variations are possible. Such modifications and variations that may be apparent to a person skilled in the art are intended to be included within the scope of the invention as defined by the accompanying claims.

SEQUENCE LISTING (24 sequences)

SEQ ID NO: 1 - DNA, 145347 bp, Homo sapiens
  mutation 142613: c/g SNP in forward strand
attgctatttgggcaacaatatggctccttcagaactggtcgagaatttctgtggtctttgcttgaccttcaagttgggagtttcaaatcagaggctttgaagtctggaggagttcgcagccattaatccttccggggttgtgctaaaggcgtttctagaaagagatcggaaagacccgttcagcacaggcccattgcatcttctctttgaaaacgcttgtctgaatcaagtatcttatacagacccgagactgaggggagcaagagcgcaggtccggctgtggcgaggtgtccaccaccgtacttgtggtcaatgcctggactagagagccgaggccgtccagggcgggctggccagggaaccagaagcgtccctggactggctgagtgagggtgccctttccagcaacccagtggccatggttaaaaggcagaatacaaccgtcaaagaagtccccagctcccacataagagagcgcaaaggccaatggaaccaaggcctcctcgcgagaactagctcgctttgaggacaagatcctggggatggaggtggggactgacgtagtgagagggtctggaggaacagtcgtagctgaaggtcaggacatgaagaattgcacgtatggtagggatagaatggcaggtacaacttttctgtactgaaggaactgggagaggacgatccggttagggaggttggggaactaatctcaacgctgcgtttacagatgaagccgcttttatatggcgtatatgtttgcttagaggggccgacggagattaggagaagccatcctttggcgccaatgatcaaagcgtctgccaaggagaagaagccaagggatgggcctttcagagagggcaaggagtcatgctgctctggatgccagtgtcaggacaagaaatcgaaaggagcgaggactcttcactgcgtgcctcagtctccccgcttctgcctctttcacctctgtcctacttccggcgcgaaagcaggccactcgctctgatctagacctagttaacattagcttttcccttccttccctcaaatcccctcccccctctatccccgtcccttctgccgcctgaaagggttaatctctcctgcgggtaaaaacaggtccgcggagtctctaactggcgacagatgggccactttcttctggccacaaaggggccggaatggagcgctccgcggcatacaaatgggcaggtcacgtggttccaggctcttggctggaccgggaagaccatatggcgcatgccggggaggaaggaggaggggcgggggtaggggtggagggtgaggggagcggttgtcggaggagggcgggagacgagcaaggcgtggggagaagtggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaaggtaattacagttctttcatttttttgccccagaatagaagcaataactgaagactgatgaacctacatattctgtatgtgtgcgtttgcgagagtgtgtatgtgtattgagaccagcatccccctccataattgcccataagtactcacacataatgagtcgtgtcactcaagtaccccctgcaggctttctaatttaaattttaaaaatttgggtttcttttgtggatagcataggagcttcttggattttttaaaagaatgcacggtaactatgattatctgctagtgctgattttaaagtcccaaaagcaataatgacttcactttctcacttcttacagtaagaaaaaaaaatctatgttatcaatatatattttgtgtgcatgtattttacgcacattgggagtgtcaagctgtgttttcagtgaatgaaagggacatggataccttgagtattcacaccatggaaaataaatcaggttcagagatagtttagttgagaggggggaaagtggagaaagggagagggactcactcctgctacctgttaccgctccagaggcggccaagtccccagcagccactactggagccagaaattcagttgttttactaaaggctttttattttccttactagaagcggcaacttcgcggttgccaatcgctgaccattataattactcaatcttttaaagggaggtttgaggcgaactttgaaaagccccaataaagagcgggcggccctttcaatgggctgtttattagagaggagccttccgcacctgatccccggcgcgtgggagagcgctctgcgccgcgcccccagccctcgccctgcagctagcgcttttgtacaaggtggaaatttagcggtgggccagagatggaaggcaagaaaagaaaggcgagggaggggtggaagaccctgtccacttttgttgccaaatgttacattgatggtgaaacaatttggtggaaactatttttcctcctttctgcatttgcttttcagtatcccgtcgatgtaatcttcttaaaaatcgctgccagtattagtaaattacgcaatggctgttcaacttaaatcgctaagtatctggaagccaggacagaaatggaagtagaatgtgtgattttacagcttttttttttttttatggagttgtgagtaactttgaacacatttggataaacatgaagtcgctgaaatgtacagtcatttccacacacattatcctgtcgggcaaccaccataaacacatttaagttaatcactaggatacaaacacatatgcgtgagtggtgtacacatatacatattcactaccctcccccagtcctgtcctcactcctacgtactagcggggcacacgcacgcgccattataaaacactgcatttaactttttctcagaggcattcattttgtaatgggcaggtacttttcgcaagcatttgtacaggtttagggagtggaagctgaaggcgtatctggcttttgaatatagcgtttttctgcttttctttctgtttgcctctcccttgttgaatgtaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaaaccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtgagagcaattgttgcatttcttcttaaagggattctgtttttatttttggggaaagtagttgcttttttgctgagttaaaaaatactaaacactatatgtagaataaaagaaaagaaaaaagtttaccttggcatatgctcttgtctgtttatcttgcacagggagtcaccagttctatgtagataatgaaaagacctaactgatatttcattatttggaatatgggactggacggcagtacaaacagtgtgtttttttctttgttttaagtggcttagcctttaggttttttatttccatttttaaaaatgattgttacatgttttcttctatttctttttttaaaaggtggattttaataattattaacaagcaagacataaacaagtatcctagcttagtttgtctatacatttaagatgtataaaacattactattttcttggtcttctgttatctgtacatttttctgaactaaacagttttatcttgcaaactagtactgtcccagaaaaatttatacacctttaggaagtaccaaagggaaatgagttaattaatttaaagaatccaagagaagtaacattttataattgttctattaacatcttgtgatgatttccatcatttttccaagaaaaagcataatggattatttgtactgaagaacacactatttgtactgtatttaggaaggtgtaattatttcctccccccaccctttggggcactattctgttgtttcatgaacacaactcactggaaaaacttatggatgattctgtctattgttaagtccacttcaaaaaaaaaaaaacagtttggcatttcttttcctctggatgtattgactgacagtcatgattcctagggaatatcattttggcacttgtgccctggctctactgtggtgctctgattactgtcattagtaactccattgtttctactctgattcgggtgccacattggatgactaccccccttcccaagcttgttcctttaatctccttctcattggtgatttaggggttccagaaagctgacctcatttagcaagctgctccagaaaaatgtgagtaatgtaatggacaggaacaattagccatactaataacattgccaatgaggctgcgtcaagctgtgacagaagcagtaaggaatacttcgacgttaaaaaaatgtttgagagcaatttaaaatatattattttaacatgttttctatcagccttcatcacatgacagaaatacttttaagttagtcccaactttatctaaaatgcagcaatctcattccaagtgaatcagagttgttattttggaatcaagctgttgctttctatatcctggattgttctcactgttcttactttaagagacataatactgatatgatacttgaatactaccagccttccagtgtaggaggtaatgaagtgagcattcagatctgatctaacctattaagtagctcaatttcacctgcaattaaaattagacatcttcatgcaaactaaaatctgttgctgtagtgaagagaagaaataaaagaatgccattttgagaattccagcttccaaaatagcaaacagggaaatctagactgtgttcttttgtaaggtagaaatgaagactaaaagttaggttttttttttttttcttcccattttgccaatacaacttcattctaaaacatagggattctttcagtcagtcaaggagtaactcacatgccaccatcttttattcaaaggcaggcacagatgttccttctgcaggggaggatttaatttatgaaaatgatattgtttatgcatgaatgaactgcatgcactctgcataacacatagcacttccatctgatcagagaaataccacagaaccagtgccaatgtcagaaacatattctacaaatttactcacttaaatgtttaatgaatatttggaaggcattttcaaaccataagaaacattttaaattatcttcttttatgaattcctacccatatttaaaagagactcttacagtttttgtaattggctaatgcttatacccagtttgtaagaaaagaacatattttactaaatgaaaaccaaccaaaaaaaaatgctggcaagtttggcttcactggaaaaaatatttcgtttagttttgctgtttaatgcttgtcatgaataatatttgggattctatctgtttcttcatcttgagccacgactattcctatcaaataagatgcttaggtatacttgtttaatgtgaaaatcctatgaatagttatttctagaaaaagctggtatgtaaaatcagggggaaatttcataaagatgaaattgggctaaatattgtaacatgcataattactattgaataggaacacttcacataacatattttactttatataaccaattgcagctatatagtatgatctatctacttttaatcattaaaacaattatatataaattaaaatgaaagattataatatcaagagtgttctactaattttaggtttataatatgttacagtaaaataccatttgaaataaattttgtgttctaatttatcttaaaatctctctgtttttacatttgaaagtccttacattcttacaaaattaatgcattttctgaaagaagctagcaattactaaaatgatatatggatcattagctaacagtttgaatcaagctgttttagttctataattatacaagaaatttaaagtgaaaatacctattaagcaattaataaaactaggtttcaaaatattggctaattttctcctaatgggaaatgtaaaatagcaaaactgcttcttaaactacacaaaaacctcctcacttctccttttctctctctctaacaccacttatttcctgaaaatcatctaaataaaatatttaattccagggtctgatgaagaataaaagagccaatgcaacatcttgtggaacaccaggactgagaactcttgttgttaccattgcaaagaggcgttctggcgtcagatgcacagtgatttgtatggtggcataatcattggctcctggccaggcattatgtttcagaggacactattgtcaagaaccattcaactagaaatctgcactgtatgcactcaaaagttgagatcatctgccttcctatgacaggaagaattctgtgctggcaattgactcatggactctcttcacatacactaaggcttggtccagtggctctgatggaattaactgtgcagccaaactagtggcattgacaagacagggccacagtctctggggacttcaggagaaattgctaattttaaaatgcagagtattatgttaatgctggattaaatcttcagatacattaaatgtggatttggccatctaagcattattatgttatttgcccagttaatttagaggtagatggatggtgacaataaccatctctacagatccacaattctaagagatggatccaattgtgaaatgatatggagagatagagtaagttcaatctagcatatatgaagtaatttggtaactgacttttcttttaacaagatcaaaagctaacctgctttacactttcatgtctaaggacagccaaccagagagatggcttcacacactagcccactgctaagtgcttttcattcactttcatatttcatcatcaaagcaccctcctgccttatttatagatggggaaacttcaggaagttgagatacctagatatttgcattcctgtcttcctttcttcattcaggtttttctttcattgccacttcctcaaagaagcttttactgattcccatttaaaatagcaactgacttcaactccaccaaaatcactgtattgcccctccctctttccagagcatttgcctatcaaatgttatcttatgtatttacttgtatagcttaattttaaactatctatctctaggtcttctgagcacctgagaaacagagacaaagttgtctcttctgtgtgttgctgttcctctggtgcttagaagacctagaggatcctcaataaatattaactttccaagggaactgaagagcactaatgtgatgctaaagcctgttgccttaaccactatgctataagtcaaatcagttgagaatggagaggaccacaaattattttcagtccagcaagtgttataaacattaattctataaaaagaaaacaattgaaactaatttcttattatattgcatggcaccaaactccccccacttcctttttgaggatcatgagttgtctgtcattgtttctttttattgatatcaattggttaaatataatctggaattggaataaaagaaaaactattataggctttttccagaccatgtatttcaatgcatattattttttcctttctgttcattattctttcagtaattgcacttgttctatttttagtgttatgtaaaattactgtagctcataatttctattttgaagggttcagtgtataaacttagcacatcaatactatctttttagtgttcgcgctcaatggtgtcagttaagagatcaccatcacttttggtgacgtcaatgaaggggtattgcaatgcttaagagaactgttaatccctttccactggtgtcactaacaattgtagtgcttgtttattcatagcaggtacgtgactaagtaatgttaacatcaaagcagaaagaggataatagagtgttctaaaaagaaaattcggtggttgggtgcagtggctcacacctgtaatcccagcacttttgagaggccaatgggggtggatagtttgagcctaggagttcaagaccagtctgggcaatatggtgaaacctcgtgtctacaaaaaatacaaaaactagtggtgcatgatggcatgcatctatagtcccagctactcgggaggctcaggtgggaggatcacctgagcctggggaggtcaaggctgcagtgagacgtgattgtaccactgtactccagcctgggtgacaaagtgagaccctgtctcaaaaaaaaaatgatttgagataacatcacttgtcattgtttgttaactgaataatctttattctagccagtgcctaaatacataataaatgatagtacaaatggatataaattataactaaacctaagtagtgatatttatcacaatatttctttactagaagaatttctttgttaatagaggcaaggctacttgtttagataccttaaaataacataagatttttggataaataaattaatgattctttgattctgactggcatattaaaaatattaagcgaagagatctttgcttcccaggttttattttttgtctaattaactactggtgcatttatattaaaacatattgtcaagggaaaacgtatatatatatatgtgtatatatggtgtgtgtgtgtgtgtgtgtgtgtgtgtgtgcacacatatgctatacttggttgagtagtatccccttcccttgcccacctctctcccaaatttatgtccatccagaacctcaaaatgtggcctcatttgaaatattgtctttccagatttaattaagatataagatgtaaattgatacaagttcatgctggattacggtgggccctaaatccaatcactgatgtcctgataagaagcagacagaacacacagacacacagcatacaggaagaatggcatgtgaaggcaaagacagagactggagtgatgtgtctacaaatcaaggggccccaaggatttggggcccacatcagaagctgggaaagagacaggaattctcagcttctccttctgaatccctaagaaggaatcaaccctgctgacaccttgattttaaacttcttgtctccagaactgtaatataatacatttctgttgtcttaagctacccagttgctggtgatttgttatggcagccctaggaaactgataggtatactaaaatctctaatgaattgatgttaaatatatataagtataggagagttcatttaaattcttctgaaaatgtcttcttaaacttttaatgatacagtatataacaaccagtatacgtagttggtatcgggtttgacatttaaacaagctgacaaaaaacagctgtttaataaacatctgaattatataaaagttttattgtttattattcatgtgaatgacttaaactgacatctacatttagtgaagtgtgaatgggcctagccaataaactatgggtaatttttttaaagtctcatctttgaactcacaaaaaattatcaaatatcagctattatgtattcttcatgtgaagaaaatgtcatatttatttgatttgtggattagcatatatattaatagagcttttgaaagaacaaatgtagcactttcccgatttcatagacactcatttaacacacaagttcatattttaaagtacataattttaaaaaaattctagtccaaatgaatttaagtgccatgacttctaaaaattctgtctctatttttgggttttataggaccttgagccagtactcttctggtgagcttaagaggctaagacttcacctttagttatatggggctttcatctgattatttgtctattttgattgctctaaatacaagttagtgtgtatttcatctgaatgtatttcattataagttttggttttatgtagatctggggatctgtcttgtttttaatcttgattggtctgtttgttttgggatagttggtactttcatttcttatgcttgctttctttttcattttgtgcccacctttagtcaggtgaacatcagtaaggaataaaattttatttttttaagccactgaaaaaatttaaaaaccacatcataactctgcctctgctgactgataaaaatgctaacttattaagacaaaatgttatgcaagaagactttattggaatagagaaacatcctttttatgtaagaaatatcaacagagacatgtgcctttcttgtgacaaatgtggtatgtgtgtggattagaggtctggaatgtggcagcatttcagtacttggaggggagaattagagtagggtagaaagatagacggggagcagaggatgattctcacccagtagaaagcagagtgaagaaagaaaggggaattgttttttgcattatattatttgaactgtggattaagtctttccataagccatccctacgcctctaagtaggttttattaacttaagctggtttgagatgggtttttggtcacacacaagaattgcctgatacaagagaggctttgattttgttgttgcttgctcatttttatacactaagatggagaaaaccctggacatagtgaagacgaaattgaggaaggtgttgggtagagtggagggtagaagacctgtaacataggtacagaattacattaaactggaaggacttatatccagatataggagtcagggtagaaagagagaatgttagcagtaagggtaacagagtagcagaagtttattcttaccaggtcctgttatgtgacagtggaggcatgttgaccttctgactaggggagttaaaggagaacactgaaggtttagaataatgtctctaaggatagaaagagaaagtttcatcaagactcatcaataatagggcagcagggcttagggccaagcaaattcagagaccatgatattatagtagtttgtagtggtcttaatccatctaatttttcagcattttctcaatggccaatacttagcagtggtagtgttttatggcatttggacaacagaagtgaaagcactggtaagagagacgttgaagtgaaacaccatggggctcagaaaagcagagttgatccatctggtacatgggcaaggatggtcctgaacaattctgcagtaagttggaagatagaaaaaatacctaacgaacttgtagatctgggtaaggagatttttggcagaatattgtaaggctaattggcttctcttaactatatgagatagggttttacaagggagagataagcgagcataatttagaagaactatagggggtcccaggcagactctctggctggaaaattattctgatagcaagaaattagccccaaagcaaagatgaaaagtagggtacttccaattaaacatgtcataagggcaagcctcaatcaagagtgtggctagaaggcacagctcacctggacaaaagtgcttctaagcatattaggagcatataccacaataacctgacttggacccaaagttgagagaggccagtctcaaaaaaatttgagggaattgcttttgcataatatgatactttatatacatatctgttacatatcatatatatcatattaaaaagaaaaaaaaccctgtttttccttccgttctttcatataacccttctgacaacaaatgtggagtttttcacacactaagcaattctttagttcttgctggacacttcctggatgtcctacaattcaactcgattctcacacaactgcccagagtcagtgcagacccgcagattaaaggcttagccccaaaagactaccccccactttagatgtcaatcacaagtctcaacttcatttacttctgaaggacgagctatacattggaggaaacccctctttctttcaataatttgctagaatggctcacaaaactctgggaaacatttacttatggttaccaatttattataaaggatataactcagaaacagccaaatggaatagattcatagggtgaaaaatgggggagaggcatggagcacaactctctcagcacctccatgtgttcaccaacccagaagctctcagaactccttcatttagggcttttatggagctttatcaagtaggaatgattcatgaaatactggcattggtgattaacttaacctccagcccctttcccctccctcaacattgggggtgaagctaaaagttccaactctgtaatcacagggtgagcttccctggcaactagtcccctgatccttagggggcttctgaaagtcacctcattatcataaactcaggtgtggttgaaagggatgttttgaataacaaaagatgcgcctttttcctttatctttctgagttgtttcaggagctagggacaaaagactaatactataacaacaacaacaaaaaattcaatttttgcttttatctcttgggaattacaaggattttaggagctctgtccagaagccagtgatgaagatcaaaatacatatttcttattatatcacaattcacacatgtacatgatatccgtaagataagtgaactacataaagtaagctcacaaagtttctgtaggagttttgtccatttacaaacagtttgtaagctaaaagtatctgtgacaagcctcagtcaatttagaagttcatttttccaatgttaaggacatgcctgtgacacagcctcagaaggtcctgatgacatgtgcccaaggtgatcaggctacagcttggctttatacatttagggagacataagacatcaatcgatacatgtaagatgaatattagctcagtccagagaagcaggactactgaaagtggaggcttgcaggtcacaggcagattcaaaggttttctgattgggaattggttgagttattatcttaagacctggaattaataaaagggaatttatcatgcagatgaagctttaggtagcaggcttcagagacattagattgtaaaggtttcttatcagacttaaaagagtctgttctaacagtctttaggtctcagtgttgatgttaatgctggtcagctgtgcctgaattccaaaagggaggagagtataatgaggcatgtctgagtcccttttcccatcatggcatgaactagtttttcaggttaactttggaatgtccttggctgagaggaggggtccattgagatggttgggtggcttggaattttatgtttggtttacaagtttaacattaaaagcctctgtacctccaatgttttatggacaaaaagaaggctgaaaaagctacttggctgtaatcatgggccatttcttgctgaaaagaagaataaaatggaggcagaaccaaaagcccagaggctagagccaagagctgctgagaatgatgaattagggaaccactctcagagagcagatctggatgtgagataggaacattttctttctcagggtctatgaaactggcaacatatgctctcctgaatttcagaattgctatggaccagtgactgtgatatgctttctatatttttcccttttgaatgggtgcatctatcttgattatcctctgtctcattattgtatgttggatttgtgtgggacgataacatgtgtttttagttcctaggttcccagaataagaggagcacactcaaagagcgacatttatgagatactggatttttcacttgatatcataattgggtgagacttgaaagaaagtgaacatattttgcaaatgggagggatgttaaccactgacaaccacacccacagggtccactgtattagcctatctgcaaagacggctgccaaaaattccttctgtccatatatacattcccttttttaatgtgactgtttcacctgccagcaactgaagggctttatttccatttccccttgtgacttgtttgactaacagcaagaagcaaaagtaatgctattccaattctagacctgggccttaagaggcatgacagcttctgcttttactctcttgaaactcaatgtcattttttaaaagctcaggctagactactcatcatgagggaccacatgaaaagagataggcccagctagtttccacccattccagccgctccagatgagatgccagacatgcaaatgaagccatcttggatatttcagccccagctgagcttccagctaaatgtaagtacattcagttgatacctcatagagcggaactactgagctgacttcatccaactcacagaatcataatgaataacaaatcattgttgctttaagtcaatacatttaaagtttttttgttatccagttgtagatgaattatacagcctggggggaaaaaggagatagcacactgttagttgcctcatcaatattcatccccaaattctttttcctttttagtaggtctcacctcccacctggaagctgaaaacacctttcccagtctctctggaagctacagcacaggcatgttgcccaattctaaacaataggacatgataggaggtctgctgggtgggatttttgaaaatatttttttttctggttaagaaaaaagaaatgcccaaggaaaacctacaaatgccccttccattcttgcttttggacattttttgggagagggtatgatgcttagcactcctgcagccatctcggggccaacaatagaatccttgttgctacctggtgatagtgaagtagaaagctacaaagctcttgatttcttttcttttttttttttttttaaattttattattatactttaagttttagggtacatgtgcacattgtgcaggttagttacatatgtatacatgtgctatgctggtgcgctgcacccactaactcgtcgtctagcattaggtatatctcctaatgctatccctcccccctccccccaccccacaacagtccccagagtgtgatgttccccttcctgtgtccatgtgatctcattgttcaattcccacctatgagtgagaatatgcagtgtttggttttttgttcttgtgatagtttactgagaatgatgatttccaatttcatccatgtccctacaagggacatgaactcatcattttttatggctgcatagtattccatgctgtatatgtgccacattttcttaatccagtctatcattgttggacatttgggttggttccaagtctttgctattgtgaatagtgccgcaataaacatacgtgtgcatgcgtctttatagcagcatgatttatagtcctttgggtatatacccagtgatgggatggctgggtcaaatggtatttctacttctagatccctgaggaatcgccacactgacttccacaatggttgaactagttcacagtccaacagtgtaaaagtgttcctatttctccacatcctctccagcacctgttgtttcctcactttttaatgattgccattctaactggtgtgagatggtatctcattgtggttttgatttgcatttctctgatggtcagtggtgatgagcattttttcatgtgttttttgactgcataaatgtcttcttttgagaagtgtctgttcatgtcctttgcccactttttgatggggttgttttttttttcttgtaaatttgtttgagttcattgtagattctggatattagccctttgtcagatgagtaggttgcaaaaattttctcccatgctcgtgggtaggaagaatcaatatcgtgaaaatggccatactgcccaaggtaatttacagattcaatgccatccccatcaagctaccaatgactttcttcacagaattggaaaaaactactttaaaattcatatggaaccaaaaaagagcccgcatcgccaagtcaatcctaagccaaaagaacaaagcttggaggcatcacactacctgacttcaaactatactacaaggcttcagtaaccaaaacagcatggtactggtaccaaaacagagatatagatcaatggaacacagcagagccctcagaaataacgccgcatatctacaactatctgatctttgacaaacctgagaaaaacaagcaatggggaaaggattccctatttaataaatggtgctgggaaaactggttagccatatgtagaaagctgaaactggatcccttccttacaccttatacaaaaatcaattcaagatggattaaagacttaaacgttagacctaaaaccataaaaaccctagaagaaaacctaggcaataccattcaggacataggcatgggcaaggacttcatgtctaaaacacgaaaagcaatggcaacaaaagacaaaattgacaaatgggatctaattaaactaaagagcttctgtacggcaaaagaaactaccatcagagtgaacaggcaacctacaaaagctcttgatttctaatgacatcatatgggatgaaccaacccaggaacagcctgactctggacctcttttaatgtcagaaataaaatcttatttgtaaaccactcttagttgttcaggttgttgacacaggcactgaagtgcctccaaatggtgatgaataatgaggcaaaagtcaaagacagcaagtctagtgtcaaattttttgatgcctatgggtaagaagttcaagaaagtgagctattttctttctttttaaaatttatttttatttttgtgggtatatagatgtatacattagtcagctattttcaatagtgagaagggatgttgccacttagtataatgcctttttcatagctatcatagaaaccatatatacatatagtatagaaaatgaggatagatttctgacttaaactgcctatttcatttgtgtgcctggttacacctaattcaagactctacaatacagcattgctagcaattactgtgagaatatttcaagctccctatttgctggaaatacatttcatttttttgttccaagtttatgaatattagaacctatctaaaaaggagcttttaaaaacttgaggaaaggaaaagggagggcctacttttcttgcctgtgttatttcttgttactgctgattgagatgctagagatcatattgggtgagatgtgtcttagaatacagctgagcaattcacttttaacagtttccatctgagtacaaaaaactggtatgtgcagaaaacttgatattctgacttggcgggattctaggatttgttctatttttttctgtaattgttgtagggacatatggccctgtaccttttgggcagcaggagccagaatagcaggaacattctgacaaaattcccactcagcatgagagggaagcagtccccttgatacactgatgatgtgcccacttagcattacaagtgtttgagaggtggacacaactaaaactcacctcactcaaaatatatattgacacggagaaagtaaatacaatttgctgttattaacctttcttctcaccattgagacatgttaaatatctgaaattaataaaggaattaaatttaaaaagtttacttatcatgcatttaacacatttattgagcatctgttatataaatgcactgtttcaggcacaagagatagagccataaataagcagattaaatcactattctcaactgaggtactaatctgatataagagaggagacagaaataagtaaacattataaatcaactacatacttttacatggtgtaaagtgcaattaagaaaatattattgaatagaggtcaattttggaatggttgggcagggaagaccttctgaggtgacaagaagttggcctgggcaccatggggagctctaccatggtgaaaagtgttccagacagagtagacagcaacagcagaggccctaaatgagaatgcacttggcttatctggagagtagaatgaaggccagtgtggtaggacacatactaataataggagaaaactgatagaaaagagggtttgagcaggtgggcaggaattggacaacatggtgtctcatatgtcataatagaagtttggattttattctacctgcagtgagaagttcttaataaaaaaaaaattctataaactggagtttgagaaagaactatgttgatgatagcataagccctcaatcacttgtcacataaactccaaacttcagcagagactcagggagatcaaagggactaccacaggattacccactggctaaaattcagatccatggcagttggtcctgactggaattagacttccttgtctgttgccctcattgcagtgggtctgaatgtctctgtcggctgtgaatttttctccctctatctgtggcactgagaaggtggcccagacttccagagtctgtctcattggcctattacttggggatttgctgcccttcttctggaagtttgggtatttgttttcagagcatacttaaaggcctcctgaaagcaatgttaacaatagcaggatatattttacagtcttctactcagacttggatttttaagaaccagggatggagactgtgtttccagatctagtcaaatcccttccaaacataaagcaacaaagtgccttttaaactaggacctgtactgtttaatgctctggaaacaaatacccaagcttcagccaaaggagggaaagctatgttcaggaagcttcctgaaagttttttgaaagcaattttcatgcattagtattttacatatatatatatatatatatacacacacacacacacacacatatatataaacatatatatatatacacatgaatcactaatgagacaattgatcttcaggaactaacgtgaaataattggggtatcttggtattattgttatagataaatgttgaagaagttcattctttcagatattaattgagcacttactgtgtactaagaactgtgatagatactggggatttaatggtgaacaagataaattctctgccatcagggggcttatattctaacaaacttaaaatttactgagtgttctctgtatttcagtattgttactaagtacactaacttagtggggaagctagacaataaacaaagaagtatgtaataagaattaatagtaagtgctgtaaagaatactaaagcaggttatggtagagagattaatggcagcgtgaagatgtccatgtttcaatccccagaacctgtgaatatgttaccttacatagcaaaagaggctttgaaaacataattaagggttatctgggcaggcccaatgtaatcataagagtccttatctaagacgggggacaaaggtcaaagacagaggaaaagagacgatttaaggatagaagcaaagaggagagatgttagactgctggctttgaagttggaaaaagtgaacatgagccaaaacaaacaaaacagaacaaaacaaaatccacaggtgacctttagaaaaggggtccccagtctctgggccatggaccagtacctgtctgtggcctgtttggaaccaggctgcccagcaggcggtgagtggtgactggtggacaagcaagttttaccacctgagccctgtctcctgtcaggtcagtggcagcatcagattctcatagcagcctgaatcctactgtgaactgcacatgcaagggatctagtttgtgctccttatgagaatctaatgcctccaaaatgctcaccccttcaaactgcccccatccgtggaaaaactgtcttccacaaaaccagtccctggtgccaaaaaggttggggactgctgctctagaagccagaaaagaggagatatattttcctctagagcctacagaaggaatatataggcctgctggcaccttgattttagtcctgtgaaactgattttggatttctgacctccagaaatgtaaaacaatgcattggttttgtttcaagtcactaaatttgtggtaattagatacagcagcagtaagaaatgaatacacaggtttacaggatggtgaattatggagggtgctcaggaatggcctctttgaggtggtggcctttaaacagaaaaatgagcaaagtgaaagaatgaaccatctggtggggagaaaagcattccagtcagagggaacagcaaaagcgaatgctctgagaagggattattcttctcaatgtgtttgaggactggcaagaaggctttgtgtgaatgagcaaggggaaaaagttagtaggtgatctcggagacatagccagggtccagattataaaggacctctcgccttgctaagcattttgactttattccaagaataatgggaagtcaatggaaggctgtgagcagggttatatgctctcgttattttttaaaggcacaatgtaactccaaaatggaaaattggctctgggctggaggtgccagcacaggggaaaccgaaagcagagagctgggttgggagagcggagactgaagttgtccagctgaggggtgcagaagtgcagactgcaatgacagcaggcagaaaggactatatgttctagacagaatggacaggatttgctggtagattggattgaaggcatgagacaaaggagacatggatgatatcaaggattttgatactacagatttgaaacattctgagagggacaggtttgtgatggaaaatcatgagtctggttttagatatgttttagaagcttattggacagccaagtagagatgtcaggtagggagctggacataatacctaaagttcaggagagtggttggagctggtgacatcatttgcagaaccctggatggtacataaagcacgggacagtgtgtggatagatcctaaagagagccctagggcactccagccctggaagaaggcagcttatcaaaggaaaaagaaagaaagaaggaaacacaatccttattacttccatcttcaggacaattcaaagccagtgtttttgacttcctggcttgagtgaagcttgaaaaatggcaacttgcccctttgcaaagctcctaaggagtagccattggcttggcctgtttgcactggctctgggtgagcttttaaaatgccagtgagctctaattgtgttgattgcctaacagctgtgaatacaagatgctgactccagaactgcaactcattctgcgaagggcaccgtccttttccctctaatgactgctgaacagagccacctgaagcctgcatggggtttagcagcagctgcacttctgctctaagaaatagctcactgcagtcagatcaaactgaagctcttccttgcttttcctcgaagcttgggtacttattgtcggagcattaaacagtaagagtcctagcttaactggtgcacagtgctttatgtttggtagggatttggttaggcctacaaaccgtctgagctaagaaccttgagaaactcctgctatagttagctctttctgtgactctgcagtgtgaccaggaatgaggacagaattaagaatttgctgcctctatgatagaactgtttaggcactagaacactggaactagatctacaaccctatgaatttaatttccttttcaactcccctactccttcttttcaatatgatgataatgatcttgtttaaaaaaaaaaaaagccttctgctttacttcccactctgctcctcttcccagggactcactttcttcttgactgcttccccattacaagtactcagctccctgttttatcaccctgcttagagcagccattatcagccttggctgaacattggaattacctgggaacttttaaaaatccggaagtctgggtctcgcctccagagattccagcttagttgtcttgagcgtggcctggacatttgggttttcaaaagttccctatgtaactttaatgtgcaaccacaattgagaatcactagcctccagactctctgtgttatcaaaattaatgagcagctgattttagaaatctcagttatcaggagaaaagggtgaacccccccagggctcttctccttttccaggtgacacttctttatggcagtgcgtgaaagtgaagccctgctgcttgtaatctccctcaagggagtgcaagatccaggcaaagacaagactgcagaggcgctaccttgggggaaagtaggaccctaaatacttacacctggaggcacttacctttaatactgaatttgtcagatgcaaatttgtctatgcaaaccagggccttatctctagcttcccctcaggggttttgggaagtgcgctactactctgaaacagggttgtaaagcgtcacctgtgctctccagggaaccctctggaaaggaggtggaaaaacagaggcttccacccttgcaactctaagtgtgttccttggccagtgggatccatcacctagtattttcttagatatgtggtatctgggggccagtcccacacctatgcaataagaatctccatttgaacaagatgcccaagcgattatatgcaagtttaagattgaggagggctggtttaactcgagggtaacgaaaagtacgaaatcgtactttacaggagaagctaggcggagggagccacttattcttcctcttgcagctgggtctttttgtggtgagtggcgaagcggcgaggctggcaggccagggtgctggactgggtcaggcgcggccccgcctccctcctgggtccctgccctgcgcgccgttgctgtggcagcgctggacgcggctagagctggggctgccgcgccctccacctccttctccaaaggcctccccggacccctggctcgggcccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgagtgcccggccccaagcgtcttcgcctccctccgcgcttcctccctctccccggcccaaggcctacacccacgagcttttgctccaccctccccttttctcgcctcccctccccgtgctcgcctcactgcccggacaggttaccgagtccccaagtcgccgcctcctccttcccaactgggaactcacgcctctcgccccatcccagaacccccagggattctttcgctacctagccttttcccgcctccgagaccttccccgggcaaacgtcacaagcagcttttgctcagagtctcagcagaaaatcttgagccccaaaggggaggtaatttacaaatgtgagaaggtcaactactcctcccctccaagttgaaaaagttttaatccattaactttgatggtacattgaaactataaacatctcacagattatgcctacacaagagttctgaatccaactctcattttgctgacttgaaaatgtaactccagagctttgggagtgtttctgggtttttttctgcccctcaccttccttgccattgtctagaattaagacttcttcaggctcggtctagaaacttttgatttttaatattgaccctagattattggatcacagttttgcgatgcttagttacgtcaagcggtttgcttaacgtttgccttttattgacttaaaattttagttacctaaaaaagttataatgctgtagtttacaacaaatacttcgagtctattttcacgtcttagtcaaatagccttatagacttaacagatattttataaagaccattttgcaagtcttataagtagactttcatatagtcttatttctaagtccaaactcgagaaatactccccattgttgaattagcttagatgtgagcggtgaaagacagatgaaatgggggaggaactacatcaaggttactctacttgcgaggagatgacttgggggagatggaatttggtattcaacctcttttagctaaatacaaatttatgaaattaaaaaaattgccttcccctgttggaaaacaagacacagtgtggtatttatgttacagaatagactcactgtcttaaagtcttgctcaaaagtctaacaaaatgaaaccaactagccagggattcagcactggttgcgattgtgaattctgcctgtgctgcatgtgccatgctcgctcgcttcacgaaaacagtctttgaccttaaagtgttttcaggtgttttaaaaaccaaggtgtagtattttcttgaaccttttaagttaaaagctagggatatagctatggaattatttgtaagtctttcaggcaattcgagttatgcaatatagaagtttataattacagtttggattagcccaaagagccagtttaacctacagtgcagctgaaatgctatagaattaaaatgagacattgtgcaatgagaggtcatacaaaccaatgttgcagtatttgtgtacaaaaaaagcaaacaatgacatgagaaaagaaatgctgttttatattgagtggtgattaaggtaaaataggtttaattagtgcacccctggcagtagagtttaaaatacatcttgacagatttgtaactttaaaggttgcaagtactgattctttgtttaattatgccctaaaaccatttggtggtcttttccttcatacaggtgtaccctttttctttgtaattaatacctggtattcaaaccactttgggcctctaaaattgggggcacagaagcctagagccttagtaagtacttctgtttatggaagaaaccaagagatgttttatttaggtaaaatatagccaggcgtggtgtgtccctgtaatcccagctacttgggaggctgaggcaggtgaattgcttgaacctgggagttggaggttgctgtgagcggagatcacaccactgcactccagcctgggcaacaagagtgaatctccatctcaaaaagcacaacaaacaaacaaaaacaaacactgggaaataagaaggagatattaagagatgatatatttaaatgttagaaatgctctgttgttgaataagcttagatgtgagtggtaaaagattaaatggaagagggagctacatcaaagttactgtacttgggaggacatgatatggtaggatgtggtggggggagagcatgtccattgctggttggcaagtgactggctgcctcagaaaaggatgagggtgggtaggggagatcactggagattattagaacatacgtatgttttcaagattgcttagtttttaaacctcatagtactttgttttcactgatgaaataaaatactatgtgatctttttctaattttccatcttgagtaataagcaaagacattaatgtattttatgaaggctctgactgccaaaattgggacaaattgatggtcttgttggcagggtaaatgagcataaccgtagtaattgtagttctttttattgggttcagggatgacctggaataatggatgtgttattacccttccctgtagaagtgaggctttcgaaaagaggctataagtcaatttgggaggcacaaagtatcagcgctttttggggattttttttttttttaagtagagaaatattttaaatgtgtgatataaagttatgcatgtgcttcttaagcacattaactcaaccagatccaacagctggtctaataactttttaattgtttaaaaaaatttaattgacacattgtaattgtatatatttatgagatactatttgatgttttgatatttacgttgtacaattatccaatcaaagtagttagttatccttcacctcacactttcattatttccttgtgggttagaacattcaaaagactctcttctagttattttgtaatatatagtattttactgttaaccatagtcaccatactatgcaacaaaacaccagaatttattcttcctacctagttgtaactttgtgtcttttgactaacctctctccatccttccttctcccctccccttcccagtctctggtaactattctaatctctgccttatctatatcaaccttttataatagaaaaagattctacatgtgagtgacatgtggtatttgtctttctgtgtctgggttacttctcttaacacgatgtcctccaggcttagcattcacaattgacaggactttattttttaatggctgactagtattccattatgtttctgtatcacattttctttattcatccattgttgtacgcttaggttgattccatatcttggccattgtgaatagtgctgcagtaaatatgggattgcagatctcttcaacatactcattttatttcctttggatgcatacctggtagtgggattgctggatcatatgatacttctatttttaattgttttaggaacttccatgctgttttccatattgactgtactagtttacaatcataccaccggtgtgtaagtgttcccttttctccatatctgtgtcagtacttattttcttttgtctttttggcaatagccattctaactggagtgaggtgtatctaattgtggttttgatttgcatttccctgatgattagtgatgtcaagtatcttttaaatgcacctgttgatcatttatatgtcttcttttgagacctatcaattaaagtcgtttgcccatttaaaaaatcaagttggccaggcacagtggctcacgcctgtaatcccagcactttgggaggccgaggcgggcagatcacgaggtcagaagatcgagaccatcctagccaacatgatgaaaccccgtctgtactaaaaatacaaaaattagccgggtgtggtggcacatgcctgtagtcacagctacttgggaggctgaggcaggagaattgcttgaacccaggaggtggagattgcagtgagccgagatagtgccactgcactccagcctggtaacagagtgagacttcatctcaaaaaaaaaaaaaagtcattattattttatctgttgaattaattttcttatatattttggattttatccctttgtcgcatgtatagattgcaaatatttttctcccattctgcagctgttttcactttgttaatagttttcttcaaggtgcaaagttttttagtttgatgtaatcttattttgtctatgcttttgaggtcttattttaaaaatccttgctcaggtcagtgtcgagaataatttcccttttttcttgtaatttcatagttttcaagttttacattttaaatctttaatctatttttatttttgtatatggtgagagggaggggtttaatctcattcttctgcatgtgaatatctgattttcctagtaccatttgttgaagagactgtctttttcccagtgcatgttcttgacatcttaaaaattcagttggctgttgtaggtgcaaaaatttatttctgggctttccattttatttcatgggtctgtctggttttatgctagtaccatgctgtgttgatatagttttatcgtatatttcgaagtcaggtagtatgatacttccagttttgttctttttgctcagggttgctttggctatttggggttttttttgtggttctgcatgaattttcagattgtaacatttctgtaaagaatggtgttggtattctgatagcaattgcattaaatccatagatcactttgggtagtatggccattttaacaatataattatttcaatccatgaacatgtactatcttcccatttattgatgtgggaagataatttctttcatcaaagttttatacttttcagtgtagagattctttcacttccttggttgtttatttctaggtatctttttttttaaaaaagtactataaatggaattgttttcttgatttttcacatagtacaatattagtgtatagaaatgctactgatttttatatgttgattttgtgtcttgcaactttactgaattctaacagttcttttgtggagcattttgggttttctatctataagatcatatcttctgcaaacagggacagtttgacatgcttctttctaatttggatgctcgttacttctttctcttgcccagtttatctggctagaactttcagtagtatgttgaatagaaattgtgtaagtggccatcctttccttgttattgatcttagaattgatctcgttattggtcttttcccattcagtatgatgttagctgtggatttgtcatatgtggcctttgtgttgaagtacaaactttccatacctaatttgttgggtttttaatcatgaaattatgccacattttgtcaaaggcttttaatgcatctattaaaatgatcatacagtttttgtctttgttaatgtgtatcacatttactgctttgtgtatgttaaaccattcttgcatgcctctgatcccagtgatgaatcgcacttgaatgtagcaagttatctttctaatgtgctgttggatttggtttgctaatatcttgagaatttttgcacctatgttcatcagggatattgtactatagtttcctgtgttgtattgttatctgattttggaattagggtgatgcttgactcatgaaatgagtttggaagtattccctttgcttcagttttctgaaatattttgagaggaattgatattggtttgttaaatgtttggttgagttcagcagtgaagccattcgtttctgggcctttctttgatgaaagactttattactgattcaatttcctcacttattattggtctggtcagattttatgtcttcctaacttaatcttgataggttgtatgtgtcggggacttcgttttttctatgttatcaaatttgatgaaacttgttgaaaaccaactctaaattttgttcatcttttgaaattatttttagtctctatttcatttatttctcctctgagttgaattacttccttacttctaccaactttgggattagtttgttctgttcttttttttctttctttctttttttttgagatggagtttcgctcttgttgcccaggctggagtgcaatggtgtgatctcggctcaccgcaacctctgcctcctgggttcaagcaattctactgcctcagccttcctgagtagctgggattataggcatgtgccaccacacctagctaattttgtatttttagtagagacggggtttctccatgttggtcaggctggtctcgaactcccgacctcaggtgttctgcctgccgtggcctcccaaagtgctgggattacaggcatgagccacaatgcctggccgattagtttgttcttaattttgtagtgccttgaggttcatcattaggctgtttgtcagaaatctgttgtcttttttgatatgggcatttaatactataaacttacctcttaaaactgcttgtgctatgtttcgtaggttttgttatggtatattttcattctcacttgtctcaagaaaaattttaatttcctttttaatttcttcactgacccattggttgtttaggagcattttgtctccatgatttgtgaagttgtcagtttttctcattgttgatttctagtttatttcttttctttctccttccttctttccttccttccttccttccttccttccttccttccttccttccttccttcctccctccctccctccctccctccctccctcccttctgtattgctttgtctcccaggcccaagtgcagaggcacgatcttggcttactgcaatctctgcctcctgggctcaagcaatcctctcacctcagcctcccaagtagctgggactacaggtgtgtgtcactgtgcctacaggtgtgtgtcactgtgcctggttaaatttgttttttgtttttgtttgttttgttttgtatgtttagtagagatggctttcgccgttttgccatgttgcccaggctgttctcaaattgctgggctcaagcaacctgcccaccttggcttcccaaagtgctgggattacagccatgagccactgcacctggcctgatttctagtattataacgctgtggtcagtaaagatacttgatattatcttaatcttttaaaatttgttaagacttgttttgtggcctaacatgtgatctctcctcaagaatgttccatgtgcatttgagaagaatgtgtatctgcagctgttggacggaatgttctgtaagtgtctgctaggtgcatttggtctatggttcagcttaagtccaatatttcttgatctctctgtgtgtgtttgtgtatgtatgtctagataatttattcattattgaaagtgggctgttaaagtctcttactattattgtattggagtttatctctttaggttgaatatttgctgtatgtatctgggtacttaggtattaggtacatgtatgtttataattgttatatcctgttgttgaattgatccctttatcatattatgaccttctttgtctctttttacagtttttgacttaaagtctattttgtctgatatgagtattgctactcctgctcacttttggattctgattgcatggaatatctttttccatttcttcactttcagtctgtctttaacggtgaggtaagcctcttttaggcagcatgtagctgagttttttttccagtcctgcagctactttatatcttttcattagataatttatttacattcaaggtttttattgataagaacttatttctcccattttgttacttgttttctggttgtcttgtagattctcagttcttctttctctcttgtttacctctgtggtttggtcattttctgtggtcctaagctttgttttccttctatctcttgtttatgtatctgttgtaattgctttctttgtgggtaccatggggctaacataaaaagtcttgtagttataataaactattttaagctgatagcaagttaactttggtcacataaaaatactctagacttttttcctccgccatccctaatttatatttttgttgcctttatttctttagtatgtgttccctagccattgtagctgttgttgtttttgaccagttgtactttaaaccttcatctagaggatcgacaggtttacatagtaacatgatatcactggggaattctgagttggatttatacatttacctctattggtgaggtttatattctcacatgtgttcatgatagttatcattttttcatttacagctgtagcactcctgtaaacattgcttgtaaggctggtgtaggagtgaattccctcagcttttgtttgtctgggaaggcctttattctcctccaggatagttttgctggatatagtatcttttgtccttggccgagactcgtttttttttgttcttttagcatcttgaataaattatccctttctctcctggcatacatcagtaatttaatgttactgatgagaaatctactgatagtctaattaggattcccttacatgtaacttgatgcttttctcttgcagattttagaattctctgtcttcaacttttgacagtttgactataatgtgccacagagagaatctttttgggtttaatctaattgggaatctttgtggttccttcatctggatgtctatatctcccccaatatttgggaagtttttagctattatttcattaaataggttttctgtgcctttcttcaacttttctccatctgccagttctataatgcaaaaatttctttgcttagttttttttaaactttgggttatttcacaaaacctattttcagattttgaaattctttcttctgcttgatctggtctattcttgaagctctcgattgtgtcttttattcactgcattcttcagatttctgtgttttaaatgatagatcttgttttaatttctcattttataactttcctgatttcattgggttgtttgtattctcttgtagcctgctgaatttttttaagatcattatttttaattttgtttcaggcattttataaacacccttttctttggggtctgttactagagactcactgtgttcctttggcagtgtcgtgtgtccttgctttttcatgtttcttgtgacatctgcacatctagtggaatagtcacattttccagttgtatgcagtagctttcacagggagagacttttcctgtagatgggtcctagagtgttggttgggtatggtacattggctttggtttggggtggattcagtaccatggtctctgtgtagtttcgtcagctgtaatcttcacagcaatgtctgatttcctcagtggcctaggctgcaggagtttttgatggtggtatagttttgctagggacaggcatgtcatgctagttgtcaggctggacacttgcaggctcggagggctgacaagctgtcttttgggctccccagggaagagaaagtatgattttccagcttttcttctatgtttatttaaaactttgttgtctggctcacagtgttctttatctaaagtctagccagtggtggtggtcatattgcaatcattattacagcttcagactttctagaccttttccattttagtgaccttcagccttcattcgcttccattcatgaccacagaatagatgtagtcatctctattgaaggcaaacccatcccatctcttcagcttcatctagaaatttgtttcatctgttacactttctttctttggtttttagccttcattctctaccagctctttcacttaagcagagatatgttcaagactctcccattctaacagttccctgccttgatcctacaagcttttctctttagctgctaccttgctttttatttttatttttttctcacttgctctgataatctcctagaaaaattggcttactctgaccatctccattagttcacctcttaattattcttcaaccatctgagacctggctttgttctttctctactgaaactcttcaggcagagattagcagaagtcttctaattgctcaatgaagtggaaattttcagtccttattttctgtatttctccttcatttgactttgacttaactctcttggtttttgtaataccaccagcacctagtttatcagtctctcatgggaacttcattctatctgcctgccaaatggtggagtcccaaggactgtggtctgatctgctgttcctcattacatgctttctggtcagtattgcacactgtggttctcatctaccatcatctacctccagaagtgccatatatttagtaagtttacaagaaaagcaactttccttgctccgtagactaactctgatcttttgttccctatcatggttatggaactcactaattattcagcatcagctgtcagaatgtttaactttgctatttaggtttgtgtaagttatgggacaataactaggataactagaattagcttgtagcttatgtgggttagataatacaattgcatatgtaagtagtgaatattttggcttaataagtgaaggagtatttaggaagctatctggaatgttatctaagtcaggattctgaaggtaactctagcctcactgtcccttactcactatttctaaacacccaccaatcctgcctactttatttacttggtatttctccaatctgccatccttctctgtccgaccaatcactaccctagctcaggccttcaaagtctctcacttgacctactccttcacctcctttgaacctgtgcacaaatgttagcttcttagtaaggctttctctggtcacctgtataaaattcccatctgctacatacttcctggttccctgtattgccttatattcctcagtggcatttatctccttgtatactatataatttctgatctctgtcctttctattaccaccccacttcaagatggcaaggatttgtctgttatattagtgactgtcctaataggaaaaaaaatggcacatttatattagagtaacttgagaagaatttttaaaagtcagtatttataaagctgtagatatagagatagtgaagtactcttgggactagtaatcattgggcaggtgataccatttttaagcccaaaagggcatagtgaaagagcaggtgcctgaacctggattcagagagactatgtagaggaggccactaggcaggagctgtggcctttgcctcagcttggctgattacctcactaatcctcactaatcctaaattacccaagttccttcttttctggcccatttcacagtccaaagccaactttaagccagagggcaaggggagcacttgatgcagtccatgcagtatggcctcccagtgaacagggcaggtggaggatagaaactaaatctagatggaggagagggaagatattcagaatatgttttttctttactgtcagcaccttgaagagtgcctggcatatagataatatttattgaatgaatgaatttgttactggtttactggcctcatgaactttagttttgcctattctattataacttggtgactacattcctatatacttgataccaactcctcattaactacaaaggcagtattcccctctccccctttttaaacatcaaaactcttttttaaaaaaaattcttaaatgaatcgccagtatataacacataaaagtatgggtgccttgattggagtggtgggtaaatgatcctgagtctgtctgtttgggttccctctttgcctagcaggaatgtgactgtcttgtttaaagcccactgaagtagaaaacaggatgagagacacactcttcaacatggcataagatttccatgcttggctcctgcctatctctgcatcctcatttctcagtagtttcctcatattttaccatcctgtaattgaaagaattacaaaactagttctctacacaagctttcttgctgttccagctgctgggaattagcttcctttgtgcttttttttatttgaatgattcatgtttacattcattaaaattaatgaagattcattacagttgttttctctttaggcataattggatctcctatactgagacattgaatgcaactttgattgtttttttcccccattatatgttaagctccttgaggttcttttcaactttgcgttattccaggatttctatcgtaagagttaaggttcatccacttctctgatgtgaggttcatggcaggaaggttccatgttgctcagctgcagagtagaaaatactgagcagggcttaaatagattaggatgctgccattataatataaactgtgtttacgaaagagcatcatcaattcagaaaatatctttttcattgactacagtggtgcctgatgatctttctattacaatcttaaattatggtcattttaattatagaatcatacatgggtttatttatgttaaaataaggtaattatcaagctagctgtgacctatgagaaaaatcctgaagaaatgatgaagggatcaggtgactgtttttgaagtcaagtgtgaaaggtcagaccactctgggtcatgggaccctgccaaggcagagcaggtcaagtgctgtgcccagtggggccaacccccagtatggtgccagggactgggtgtgagaagtcaaaaattaagaatacacctcagaaaggggacatggacagatgccacagacttatttgcgtatttcatgatttagcccttagcttgtgctgatactggatcagatattttcagagttcagtattttcaaaagcatcgctgatcacctgttggcattgttttacatctcaaccaaggaaaaacttttgggacatctgtttaacaaggggtaagcttttatttgaaatgttcgattaaagcagaagagtcaggcatttttttgtgcctccccaaagaaagatttgtttactgtcctgtgtgaataaatataatgtcattatttcccgtaaaggaaaagctgatggggagagtaagtaatgggtaagattaggcaatgttaagctcatatattagtatgtttaagagtgatcaatttagggatctctgtgacagagatgccaaatgctcacagtgctatctcatgttggaaacatgtgtctcctccacttttcctcagtcctctgaaatgacggccctttagggattgacagatactatacagatttctgtgctgatatgtgatttgtctaaaacaaaagtttcacaaaacaattcttaccattgccatttaagagtcactctgatatgctctgtttccattgcaaacaaatgctcattatgatttgtgaaattaacttcacaatttcctaatggataacaccttgaagtatgaaaagcactacaggatcttttatagcttccctcctccagctctctataatctgctcccatctgtggtgtaggaaagatttcagcagtggccgctgaaggccctaagatcttgtctcaacagatagcaaggtgcataacagactttggacaggttgtttaacatgtctgagttactgtttattcactggcaaaatgaagggcttatattatattgtctctaagtactatcagttctgaccacctatgaactttcattttaaagaaaatacctatttctatggcctttaggcattagggaattttgtcaaattaaataaatctcagtaaggtttgatggtcaatggggcccactgtctggtgtgtgtggaggggtgttgtattttacatcaggaacttcagagccctcatgaatttctaattagaggaaccacctgggaaatataagtcaaagccctttgctcgccttactcagctttagggcacagtgactagaggtgggcaatcgctttggtgtaggtattgtcattggaaaggaagaaaccattttctggaggaaaagaattggttgaggctagctttaagcagctatttcatgatggacaaaaggactagctcatccattcttcattcgtttctctgtatcctctatcaaatttctgagtaaagattttatacaatgcttgattagcattcaaatagtatgtttcaaagattttaaaaaaaataaaactaggcctttgaatcataattatggcttataactctatttttcatatacttactatctcaagttacaaatttcatgttatgtttttttcaaaagagtattcctgccacaactcagagctcagctgaattagagcagtgactagaaaatctgagaaggctgagcttcaaaataaggtctggaaagtgtttcttattgttacaagagagtcaaaatgattttcttgagctttaagtttatgtaagtatttacttgacacttagcagtttaaaagataatgtgcaaaaatatgaaaatgagaaaaaacaatttcaaaacaagagttggtgattacgtgagacttagtagagcaaagtatattctaagtattaatctgtctaagctgtttgggaacagatgtacgtgaaatggataccgggtgttctgttgtgtacaccccaagtgagacatctgttggtagactgtgtggtcagaaataatggaagcaggggttaaaccccaatatgacctattactcatgtgaattattgaaggactaattactcagtaaaacatgatgctttgattcatcagtctacacgttaagaaaaaagcctctttagaaaaaaatttagttctgtttctaagctgtcaaatttgaggaaatttttaagatgtatgcaaagactcaaatttccatagtaactgcaaatactatctgcttataaagttttaaaatgttttgacaggtctactaatttatcataaaaatagcctcaaaagttttagctttttgttagggtaggttgggtctcacagaaaacaaatgtagagtgaattttctaaagcagggctgtccagttagacttcctgaaatgatgggagtgcactatatctgaagtgttcaatacagttaccaccagctacatgtggctattgaacagaaacatggctagtgtgactgagaaactgaatttttaattatatttaatttttattaatttgaattcaataactgcatgtagcaagtggcaactgcattgtacaacacagctctgacacatggagagttgaaaatgtttgtttactttcttcccaagttttcattttagtctttgtttctacatagaaaggaagatatagcttttgaaaaatgaacctgaatgtagaactgatatggttatgcaatttgagctgcctatttaaagataaagcaactgagtttagagatttcaaagtggcagagtcctttaacatatttcgtgggctggccacggtagctcatacctgtaatcctagtactttgggaggctgagatgggaggattgcttgagcccaggagttcgaggccagcctgggcaacatagcaagaccccatctcagggaaaaaaatatgtgtatatatatgtatatatatatatatatatatatatatatatatatatatatatgcatacacatatatacatatatacacacatatattaacatattttgtgtgtacaaaaaatatttttattatgtgtagattagttggttactagtaaagttgaagtcttgtctatagaaatcattgtatttttcatggtcattgtgatacattgtttgaactgaaatttggcaaattcaatctgtttcttactacaagaatagtacatagatttgaaatggtaactctcttagtctgtgtactctgaccctgtgaacgtctggagactaatgttattcctaaatatgctatgtccacatggcagcatctgaaggcaaacactttttaaaactgatctacttttgtggacccttcctctctctctttcctgcatcccggatggggccctctggggctggaactggcacagaactattcccctaggagtgggttcattgaagccaagggacacacaaattgagaatcagatagactggaccaaggtcattaaaccagagagggcaatccagatggggttgtccaaagtaggaagttctgaagtgaattgcagaaatccaaacatggcaaagctaaaggaatagagaaccagggcaatggatatagagaacagagcaattgggtatgcaggaagatgctattgcctagactggatgtttttgtaccctctgtaatttgagaaaatggaccgtccttgttgaaatggtcagggatgtagtagataaattcattgcagttgtgtaatctcagcactagaatactgatcataaccatatcacttgttatcccacctagcctgccacttgattgggttattagattacatttcagacattgacaagtctacaagcatcattaaaatcctaaacacagacttctgaccgtattcctacccaagttttagaagcactatgccaatgacgggggtagtatatgctgagcaggtgagttttgattgtgtgtgtctacatgtgtacgtgggtgtggtgagcaacaggaaggaactctcagccatgactctaaatgctcttgtgttggccaaaattggtataagctaggaggagaaacacaaaggagagagaggcatgaagttgaaggacattaaaccatttgcaaacttttggcatgcaaaccagaatatgaggaaacttagtgtaatgggtgactgaattcagaggtagacaggcaatcaggaaggtataggcaccaaaaatagttaccattggtgagcgtttttgtttttgtcattggcatggtgttatgaacttatgttaagcctaagggtaagtctaaaataatgtaccagctggcatcagggaattcccatgtacattcctagattttcattagaaacagtgttctggaaactaccactgctgctacacagcagtgcccagtgcttgactgaaaatagtgaacacttagatttgtttactctgccaggttctgtgctaagtatcttatcttgtttaaccttagcaaagaaactatgtagtctagatagaatttttatccctagggcccagaggtgttaaataacttgcccaaggtcataccagtaatttcagttgctggggttcaaagctaggcagtctgactccagagcctgcactgtccccatttggttatgttgcttccccagttaagcaagcaagagtctatctgacatctgagttggtggtagtaaagcatcatggtctgaaccaaaataataaaaacctttgaaacaacattatctgacttctttcaggcttttaagacagttccatcatcaacagcttattccatttctctggccacttccagtttctgaacaaatgaagaaaatgggagtgataaattggagtttttaacaagtttttttaaatctaattttttttatggaaaccaccaaacatacccaaatgtaggaataattatgtaataagtcctcatgttcaaccctaagaggggtgaagctctatgtgacccattactgagtttaaacagttttcaatttatggccagtcttatttcatctatactctacccacatcccttcttcccctggaatgattgaagtaattcctaggcatcatataatttcatctgtaagcatctcagcatgtatctctaggagataaagattttctaaaaaatcatattactactcttcaaatttaaaataatctttatagttttacatatccagttagtgtccagattttcctgatattttctctattttttaaatatgtcaaccttgaaatgaggtccatattatagctgatggctatgccttttaaattttctcatccacagattcttcttccttttttttcctttcaatttatgttttgaacaaactagtttggcctatagtttctcatgggcaagaataaccttcagactgggatggccatcactctgatacccgtaaaggggatgaggcaggttggggaagggagagcctcagaccatgatcagatgtcacaagatttttgcttacctagggtgaggacttgggaaaaagattgcccattaggagtcctgccttgggcaaaagtggccaaacttcagctgtgctgtcacaggctgtgggctgccttggaaatgtaggacctcaactcctctgaagttgaggtggagcttgagggtacgaatccctggtggccattataatgactacactcattgggatggcatggcaagttcatcctcaaagatggatcctagcatccaccatgaccaatgaggtttttttattgttatgatcactataaactcaaggatttaaacctattaaatgtttttcaattcacagcaatgattatttttactgatcttcaaattgtcacattttggatttttagaccaatgggagccccttcatcttgacttctgagttcttttgacattcactcagctgtctgatagcttccctgctttctggaatggcaagatattccaggttcatcttgaacatttcatgcttgagatatggaatcaagctcatcatcagagggtcctggttccttttactggatagtggtattagagacctcaatttgagaactaagcaacatcattgctaaaacttcccctatgtgtaccttgttacttaggtttttcaaagaacagagctagaaaatatgttgggtttttttgttttgtttttaaagaaaaaatgtatcataggattatgctgatacttccaattcaagtgcaggcctaagcttttcacattgtctcttttctcctacccttaaagtcctgattcctaactataacaacatcattactcatttgctttatcctgcattatgtagacacaatagagtaacaacaccaatgctgccaatcaaaagtataattactgaaacccacttaagatagtcctgcaatttttttttttgttcatagagtgtacactactagggaggtgtagtcaaattactatgttttaaagacacttggaataattcatatctgtgaagttatacccccaacttatttgttttttgtattattgtttcattttgcttttgatgtttaggcatttcttttttaaaaatcaattttataattacgtgaaatacttatatggttccaaaatcaaatctactaaacaaactatattctaggaagtatagcttttatgtttcccttctatgcttttccttccttcctgtaggtaggaaagcttatttgttcctcaaagctctgggttgttcttttattttatataaataaacatgtgcatatattcttttcattacccccacagtacccaccgtcttaaacacatgtacaatatatgtgtttttctaccttgatttctttcttacttagcaatatgcccagaagttcactctgtagcgctttacatcagcatcaaaatccattatgtactatcgtttattgacctctctgttggagaaatttggattgtttctagtcatttttgttatcgcaaatagtggtttaataaaaaactttactttccgttttttgtttttcaatgtgcttttaggatagatgcctagaagtgagattgttgagtcaaagaataaatgtgttaataattttgctcaatattaccaaattctttcaaaagggttgtgcaattttgctttttaaaatcattattgtataagggcatgtatttcctgaaaatttctccagaagagtttattgccaaactttaaaaaaacagcctgatacataataaatgatatctcagcatagtttaaatttgcatttttcttgttaaatcattcatgtttttactgtagtcctcctaacatttagggagcaccaattatggggtctctagaaggttccaggattctgtaatcaatttgacatgatttctgtcttcagatattcacaatcttcaggaagatatattgacaaaagaataactacatgatctattttgtgtgcaacttagtacttacagagcattataaatgcacatggaaaaataggtaaaggagaaaatcattctctgttgggcgggctgagggggaagtcaggaaaagctacagagaggttcgagggtaaactttaatgtgggccttgaagtatgatttggagttagcaagacagacaaaggagcaaggaaaccattctagaaaaagaaaattttgaaaaatctccagaaaaggatgctttggcctatttggaaaataacattgtcttatttatgggggagatgacagtgctttgtttttagtcagtagtttatacaggactttgaatagcatgcaaggaagttggcgtctcaacctgaaaattgaggaaggtgtgacaaaggctgggcattaggtgagatcaagtatttctgtttttttttttggtaaattaggtagcaggatagattataaatgggctccacactgaggagcccagtgtgatggctgatccagcagatcagggggcagtggctgcaaagctgggagaatggcaaggtaagcctggatgcaagggatattgtcaaagacaaaatttgggggatgtgaggcttaaaagggaaataaataatggtgatggtgagatttctagcttgggcagtgggatagatagtagacgctgcgcaaattcgtttttaaatcagcagaatgagaagcatcttatttgaaatatattctaccaaatcttagcatcaaatgtgctagtgactagcaaaatatgtaaacagaagggaagtagcttgaaaagtacacaaactggagaaattgctcctgaaggactgtaagttgaacccttttaagcctaagatctgtatttcctatgagccctaggctctttccttgtgtatcctgtttcttattagagtagaggctacttaaaaataatcatagtttaaagcgctctattttcagaaaacattattcattagatgttagtaaataatgtaatctttatacattcataatatttctgcattattggagtgtaaaaagtcagtgaaatagtcatttgtaaagatgtcagtttttatctgtggaaaatagctgttcataccattttaagcttaaaagttcttcatttacttcttaaaatatccatgttggtattattttgtctaatacaagtaattaatatttaccccaaattaagcttttaagtttactaaatgttacaaacataattcaaagcactgtttagtgtccatctgtgcaggaaaaataagatcaatacaattgagcagctgttagcatgtattggtttccttatattttaagtatgttttcatgttttgaaggtgtaaagggatgacagtatgttttgttgtggttttcatcatacagataaaaacttattacagttgaaatcttggtgaacataatacattttaaaatttccattcctcacccatttatctagatatttagacacagtaaaataaataacatggatacatttttgtcatgtgatttatgttttttaaaaagtagaaataaatttctctaaaagttatttttattttttaaatttagcatttttcatatttgaggaaaaaacaatatgtcttggtaccctagcttctgaactaataacacacctgtcattttacaggttattttaatgtttttcattgggatcaaacctactctggaaatatctcatgggtgagctttatttttatgaaatgttcttggcacttgaagacctttgtaggtacatgccagactcatcttacatccagttcttctgcatggaaaatatgtgcattgaaattctaagtgccttttcaaatttgaccttcttagagaataatatgagtcccaacaattaggaaaactatggaatgccttttggcctttacttttcaaagattttcagtcagtaatgtttaattagcattcattgtgtacattgtccttttttgtgtgatatggctagttccaaaggaatattctagaagatctcagccttctgctattgaaggtgataatacactactaagttatgtgttgctttacattaaaataatgttgcagcagttacttattgcttaactagcgggtataggacatcaggttgaaataactgattttgaagtgaagagttcttgtttatatcttaaactaaccaagtatgttcattaactttgagaataacaatgatctttttcattattcttgagtagactggataaatcagaaaacccatgttagaggtccctgtaaaaacttcagtcttatttggtaagtccctttataagagtttcaataaaatcaggtaaatttaaactctgaaaattctacgtactgtctatcatgttcaatttactgttaaccagtactatgcactggaaaaaatttttttcaccttaatgagaccactggtcattactgctgctactgatgctcttttgtctgcacatactgttgcaacataatgtgttgtgcatttgatacggatattatcatattgccataaggagctgctattattttagacaccaactgattccatgatagtgtcagatttctttaacatatgcttatgtttttgtacaaatgaccccaagaaacatctgctagttttgtggtggtatctactgtttcttttttagaatttgacctgtcagtcactttttaacgtgaatctacaatatttgagttgtattcctttctcgtttttatgctattgatattaacaaaattgagtcagttttatggcataattcagagagaaaccgaagctgtctatggatgttattttaaaaatacctttttcatgatgattgtgcctttaaatttttgtcattgattgacactttaaaattgaaaagtgcccttttaatggatcctttaggttccaaaatcttaagttgaaaatttctgtctattggtcctgaaagtactctctgaatttgataagtatgtagtagttgtggtgtatccttggtcagtttatatcctgtgctaattgctaatcttacttagtttctttgatgcgtgtgtgaagacaggcaaagaaaaaggaagtggaatttctacaaaactgtgaaatctttactttatggagactagagaaatttctaagtaaaagaagacactcattctattgtagttaggatcccttcttttacttgcttttcatgatcttgactgaaaagcaacaattgagatttccattgcccgacgctttctcttctgcttttctttttgtttctcttgcatttttaaagacagctatttattcaaaaacaatatgaacttttatttattggacttaaacctggaacatcaacaaaacaaagaacaaacaaaactacctttccaaatttattttattagaggatgctatcaatacaattttgtattatgttcacacttgataccaaacctaaacccaagaaagtgtgtcctgtgttacagcctatccctctgtttaagataataactagaacaatttacttttattttctactcatctgctttctgtgtatcagctgttgtcctccctcagcctcgaagcatgtcatcatttccatctccgtgctcattcagtcatccttgctgctcttagtcccctttttgtcccttgggtgacttatgtcattaggacaaccttctgtccccacttggctgaaactgagctgaggcccttgccagttgcattaggtgtggcacctttcatggctcagtttgggcctctgtgatatctgtgtgccttctactccaaactccattctgccagaggtggcagggtgactggaagctttagtttcagtgacaaaacccaagcgtggctatgctgagtgtctaagtagctttcatttaggcctgaaataggagagtcaggcgcctctgtgtcccctgagaaagagagatttccctcagctctctgggcccagcactcaaccatttaagtcagctggttagtataatttccctaaattgtggtttagtttccctatgagtaggactggagtaggaccaagtaaggaaagtccctagtgacctttctgcctcctgaggagcaggccatttactttgagttgtagcttcccatctgtctgtccccactaccctatccaaggccctggaggagccacaggatgagggaggagattcatggaaaagcgccttcaggtactgggtatgtctggagtaacatttaaagtttaaaagactctttaacaattttcctctgatacttactactgcctatacttgtttggttttagtacagtaagttttgcctatcgtgggggtgaagaaaatagaaatattcccattaactttgtatggtgcttggtatgacaccctgaacaggtgcacccgtaattgtttacttgatgttctttttaataagtcaattatatcatcggaaattgaagaatagcaaagttaatttgtttaatcattctatgggaactcttgcatgctcgttcactagaggaacattgcgtttctcccttaaaggacaaggctttgttttgtttttaataagacacactctttataattaaaacaaaatcccagtgttaagggatttctgttttaaataattggatttctttcctttgttcctctaatccctctatatgagaaaaaaatctaatggtgtcttaggataaatatttttagattaaaaagttctcttaaccactgaaatttaataatacttctcaaagtttatggatgatatagaatgtaatgtaaggttgagaattttagatttggcaaaggcaaagatacaaaaactagtgaaaaacaacaaactggaaacacttttaaaatactgatgtatttatctttgcaataaattattcagaaatataaataaactcactatttacatagttttatttaaatttgtcctcaaaatactaaatttagtactatatattttcttctttcagataaatgctttcctgaaaatggtattttaatatctacagatggtttagtttaacaatggttggggtaaaaatgacatagggaaaagcaaaatgtgacagcccagcttggttacctttagagaaactcagaataaactctattcccatttccttctctttcccctttccatactcgagagcccttttctgagactcttaagtcatgtttgggccttggagaggataaatagcagggtgggtggtaaaaggggagagtgctttgcttgaggcaaagttttcctccatatgggaccttcctcaagccctcccttcaaaccctttaaatgagagcatgagctcctaggacagaggtcatgtggaaagcagcattagcatgaaggggggtgctgtggaggggtgtaaggtgcaaaaagcagcattagcatgggggaaggtggggtggaggggtgtaaagggaatgagatgtgaagtggttaaagggccatttttctagttggcctctgggctttgatgaaccttttccagtgtgcctgtttctccacttagccctgggctaatcttgactcttaactttccaggtgtgtatctatgctgatttctcctgggtttggaagctctgagaagctctggttctagttcaatcacaagacttttaaagaaccagaaaaataaaacaattttttaaaaagtaatgaagaaaagacttttaaagaaccagtgaaaacctgggagtaaaaatatagaagacttgagaaatttcatctttacctttcaagtgggcagcatgagaaattcttgtaaatggtgctttcaaatcttacacaaggttctcagttacctttatttgtactccctagactgtattgcatcccttgctatgttgactaattcccacctaaaataattcaatggcctcccaatataatctggcattctaattaataagctaagaaattatttggtttttcactcattggcgttaaatattcttcagtgcccacatttggaaatattggaacacagaaatgaaaaaagatacaatcagtttctctgcttgccatgttttccttgatatggcaatacgacaacaggtcaccctttgaagaaaattcagagatgctaaagtagaaattaaaactgaagataagtcaaggcaggatagtataggagtctgctacagctgccatagcaaaatactacagcctgggaggcttgaacagaaatttatcttctcacagttcttgaggctagaagtccaaaatcaaggtgccattggggttggtttctgaagagggttctcttcctggctttcaggtggccaccttcatacagcatcctcacgtggccttttctttttgcctgcatggatagagatctctggtgtcttccttgtaagaacaccagtcctattggattaggaccctatgctatgacctcatttaacctaattaccctatttaaggccctgtctctaaatacagtcacactgggggttagggcttaaacatattttaggggaacacaagtcagtccataacacgtgatttgctatagttttcctttacctaaatcttttccaaccttgagagtggattttggccaggtgtggtggctcacacctgtaatcccagcactttgggaggccagggaaggtagattgcttaagcccagaagttcaagatcagcctgggaaacatggcaaaaccccgactctgggggggcagggggagtgggggaattagctgggcttggtggcgttcacctctagtcccacctactcaagagggtgaggctgaggctggaggattgctacagcccaggaggcagaggtcacagtgagcagagatcacaccacttcacttcagccctgggttacagagtgagaacttgtctcaaagaaaaaaaaaagtgggttttattcttccccttaaattcctattaatagtgaggtgaggcttcttgtgttttttttttttttttccaagacaatggttaatgtgtgattacttaaaaatgatatataacactaagaaataaagaattgttaagtgagaaggaacatattaaaatggcttggaaagatgggtaattttttacattttaagtaggttttctcaactctaactctgtggaacttggtcaatctaatcagtctaaatatagcacaaataataatagttatatggacaggagaaatagtagccctcaaagatagtgaaatacatctgaatatcactaacaatgtcatgaatttgcttgttctaaagttttctgaaagtatgaattcataactgagtttttttttttttgcctatgactactaatgtttgaggagagagtagtgtcagaaccacccccccatttattacatgtttatttcatattttggtactgaaatcagtgtttattttgtgtcttcctgataaatcttgccaataagtaattaccttccatactgaaaagttcttaggattaccaggttgctgggggcaaccttaaaaggccatgcagaacattgacttaggtggctattaccctgctttattcaggtctgagcatttactttcctactacaatcagaatactgacctacatttaaaagtgcaacactgccctgttatctaaatccactgtgttcctgagaggaaataccagaaaagagggcaccaatattatttttctgctgttcttgatcataagtgattacctttttttttggttaggcattctgcttctgaaagataactgaggttgaagttaatagaactaagattcttatataaaatcataggaaagataattttcaggattattgaatcatattgaaaaatgatataattgtgttaaaagataaggactaaaatgagttaattcaatttggaaatagttaaattagaatttgcttctgtttttgatgaatactgctttttgaaaaatcttctgagtatttaagcttttactactctagtcattctctctaaagtagacatagaagcgtgttcttatcttgatttggtaaggctctgaaaatgcaaagcaacagatgttgtacccagcataattatatgtatcctggaaacacatctttattgagtgggatttgttcttggggaaacaaaaatttggcaaacaaaggacattaacttgctgatctcagcagtaattacttgggttagattataataatcttgtgtaggtggtaactgcatgcatatattacaaaatctaattctaaaatacgtacattaaaaggaaaatgaacttgcgcaaactttagatcatgtatccccttgaagagcagaaaagatctcaatttcattatttgaaagttgtttgaacagctttttggaagaggtttccaggattccaaatcctaatatgtgtattgatactgaggctttggactaatctttgggggttactgccttttttatgcccactgaaaatagagcatttcaaacaaatgaactgatctctgatctttaagcatgccagtaactctttggaacaaatccatagttatttttaccaatgactgtattaaaacagtactttctgtattatctcttccattccaaggccattttaaaacaccctctttctcttctcccaataggtaaagtacgacagagctccttaggactgggttatggagaattatctggaggtcaatttgagaaccactgtgcaaaccatttcttaaataagtagctacaaggttgtccttacaaaaatttctgaagttgatggtgttgcgttttggagtctgaagcttaaataagagtttgtcagtggtcatggtctaaatagctgattactaccaaggtcatctaatttttttttaacacaaaaaaatgttctgagcacaaatgaaaccttcaggacaagacatttatgttttgagaatgttcttaaatgattcctgtcgtgtatcttattttacatatcttaatgatcagcatgtattttttgttgttgatgatgattttataaatgtgctatcacctagtttctaattcctaacagctccttcatcagtagaatattgctgtagcacagttttgccatctgttaagaaaagatggtgactaataagagtggcacatttcagggctggtgtgctatcgcaacatctagtgttttagtactgaggacagtgatgtatgcagtgttccttacagccatggggtgtgggaatgttttcctcttcggcaaagtctgtgtatttctatagctgaactctcaggatccagaggaaaaccacaagatgatgaaaccagatgattgtcatcaaatttctattccccactacatgattattagttttcgtcaaaagaaatactcatcctatcctgggttggaattggtaaagaattttgcattgtgactaggacacctaaaagtttttaggatgagtacaaatggaatttgatagatttccccaaaatgtttgggaaaagatttattcctccctaggaacagcaagagtagcagcatcacatgaggcaactcctggtaattttttcttcttgctcttatttcaatgatatcttttcattcttttctgtatctctcaatttctatgtttctcctcttaatgtatcctgtaaatttcttagtagaacctttttactaatgagggtttcctagtttgctttaggaggcactcaggatgcccccttttgtaaggcagtaaattgaaaataagaacttggtgaaggtccacgtgacggttagtttccattctccattgtaccaaactgctacagggaaagaaccatatttaatcaacctcaaatcctcaatatttaggtcagaaaacacttggcatagaagagacactcaaattttgcagctaaatagattattgatagaaaatatgtttcttgcctctacaagcaatatgaaaccaatacaatctctaaatatcttcagactactaggggcaaatactgtattataagaataattcttcagaaaggaaaatccagctactctcatatcacctctctatgttgaaagctagggaagataaactggcttccagccagtgagagtccatgtggacctagtgctggctggagatccctaatccaaaggcaagagccagatactggttgtctgctgaaaatcagaagatgacctctctggtagtaaggccagtgactcatccctgcatcttttatcctcttctgatttgtataaggatctctcctttttccccagtacccactctcaagaattgctttcctttttaacatgatcataccaaaatgtatctaacagtaccttgatttcctttctgaggaatttagggagcatatttactttgtcagactcattagaggtttggcttcttggtcgggttcttaaatggacaacttgtttgggtgatttggcagagaataggagaagccagtcccctctgatagagcaaacctggggagctgtggttgacccacctgctaactgtcctgtacaattaggcatgtggcatcagtgggtgactgaccagagccaccatctcaatggcggctgttctttccttcctgtgccttctcagatctcttttttgttcttgttactccactatattggtttttcttgagtttttttcaagcaaatatcattattcacttctactgcagttcctctgttgttcgctttttctcttagtcttcattgttttccattttgaacattcagagatccatcaaaaaaagtaaaataacaggaagggagaggtaaacaccagtcaaatgaagtattataatagtgtattactatactctttaaagtaattgaagggtggttttttggggtcagaatatctgttagaatttggaatttgccactcttgagactggggcaagctatttaaactctaagcttatctgtccttcctcacaatctgtaaaatgggatcataataatggcacccagtttatggtgtagtgagcattcactgacacaattaatctaaacttatttgcactacatagaacagaatttttgtctattaaacaatatagcgttttaggcatgaaagaaactttagattaaattaaatatcatttttcttaccacagggtaagtttctgttttgtttgcccctgtttctctaactcctagaatagtttccagcacatagagattaaacaaatattcgttgaatgaatgaatgcatctattctaatcctcttgttttaggaatgacccgtcaggctcaaaagtgaaagcatttccctcaagattggtgacagagttggggactaaatctaaggctttctcttcctacaccagtgtcctttctgagaacacgatgccattttctcaatatttgtttatttatatggtaaattggtaggaagctgtgtggtactataagaggataaactttgataatgaggtatacttgctatcaaattctaacattctcatttaaaacatggcataccatttgtcttctacattttcatatgtaaagtgaggtgatttctaccttatagaactattgtgaggattaactgaactaatctttgtagagcacctggtcccatttattttttttttttgctcaccccaccccccaactttctagctagataacttatacattcactctgtttttcattccttcttgaatctcctgtggccagacttgacccctgtcactctacagcttactcgtcaaggtcagtcctcatctgacttgacctactaagagtctgacaagtagtcacactatgctccttgatacagctttcttcacctaccttcttggatgtcattcttttggttctcctcctaccccattgggctgctttttcccagtctccattcttgggtattctcattttcccatgtctgtcctctgacttcttattgtctctgtttctgttttctctggttggaccttctctagtttctggcttcaaatactatctaaatgctcatgtctttcaaatttgtaactctagtctagacctctcctctgaattccagttttataaatcttctacttaaatattagaggtctaataaacttctcaaacttatgttctacaacaaactccacattttctcctgcagcctctaaatatgtacctcctatagattttcccatttcagtaagtgggaacttcattattctgattgtccaaaccaaaaacacttggagacttgctacattccaccctttgtctttcattctacatccaacctatcaacaaatcctgttgcctcttccttggaaatatatccacgcttgagcagcatcattgtcaccacttggtgttatacactctcatttctcacctggagtattgtatttctcatctggagtagtgtctgtccaacgatgtcccccatcagtctgttctccatgtagcaatttcgtttttgtttgttttaagattgggtcttactttcgccttggctggaatgcactggtgatcatagctcgctgtagcctttaattcctgggctcaagtgatcctcctgccttagcttctccagtagctaggactacaggcacacaaccacacttgactaatttttttttttttttaacttttactagagatggggtctccctttgctgcccagtctagtcttgaactcctggcctgaagtaatccttctgtgccagcctcccaaagtgttgggattataggcatgagccaccatgtctggcccagatgttaattttaaagtgtacattagagcacatcgttcttctgcatgttcagcataaaatccaatgtccttaatgtagtctatattaccctacatgggctacttgtgcctgatccctctactcttatgtcttatccctctcctgctttctcactagcaccagccacatcttaccgttccttgaacacaccaagtatgcatttgccacaggaccttgatgcttactgttccctttgcccagaaacccttggaaccagctatgtgttaaaattcagatatttactgattttagagagctaaaatggggtatatataatatattacataacactcacagctggtttgtggtagcatttcataattaaataatatttctgaatgaaacattaagaatgcccatgctaagagggatgagtaaagactcaactctcattgtcagttcagctgcagaatgaggtcagctcaagatttgctgccaaatgacttaagaaaaaaatgtttttggagctttggggatttcagaattgcagatgagagattctagacccgtacctacacagcatgctcccttattttgttccaatctttgttcaacgattatttattgggtagtcaaggaagatctctgtctaaaaggcttctctgtgtggaacaagactggcatgtggaaggtttccaattaacgatattgaaagagtgaagctcaaatcatttttcactcaaatacatactatttagaagacagtggccagtttaagaataatcattattggaaacaaagtactatttgattagggatagttaacacaaacacttattagtattagggatatgtgaaatacttaatggatgagtcatgtgctgacataaaacccattatccattttagttcctggtagcctaactggttgaactctgttttattgatctattattgatttggcctgtaacttcaagttacattttaatgtaatttcatccttttctgatcaccttgtgtcttcaagcatttttaagcagttgatagatagttgaaagatattatcactatttcaatctaaaagatattatcactattttaatctacttaaaatttttactacattcattttaagtatgacttatggaacgaatcgaaaatacaagatagtgaaaaacttgtgaggatcacctgaaattttagcattcactttccttacatagaggaacttagtctctctaaagaattatgagtaataaagtatcataatgatatttgtcttagttttggttaagtgtactccacaggagaaagttaggcatgagcaggaattattgtagtcccacattctcaaacagttctccagtaagaaagattttatgtgtttccagaaatcattttcctcctcttcagagctttgggaccataattgtatttaaattgctaatctgttttaaggaatcataataaattgtttaacatttatattcaatcaactttgtaatttgtataaatttttcagggtgacatttgaacaatttttaagaaaatgggaaatacagaagtattcttagttttaatatattttaaaaagatgacatgtgatctactgactgaaatccttcaatcatttttgtttttctccccaagattagatagaatggatgtgattttatttttaatttgcattatggagagtacttttggggggttttatgaaaaagacttcatttattttgttagtggtacttcagttgcataagaaaatgttcttttaaatatagtggtcatttgtgtgcagccttcaagttagcaaacatgcctttgagtagtcactatttttgaaggtctttatatctgattgcaatggcttatattcaatagtcctcctactaaatgaaataaaaatggatgcctcttctgccacagaggcacaggtggacatgttggtagcaagccccatgcggtgtgacacatggcacagcccaacatgggggcaaagagcatgcggcttgagctaggagtcactttatggctactttagtgtagatttgtgtttttctgtggaacagccattattgaagacatttatatagtatgatgtttgtttttcattaaatgctgattgtgatttcttaaaaatagttaagacttgattagcagaacctatttagaagccagagttcccctgcttcacctcttgctatctatataaatgatatttttgactctgtcctttataatgttggcaccctgtgcatattagatgtaatcagggctgaaaggaaacttgaatccatctggaagcaataaacttttctaaaagactgcacagtgttatttaatcctgtgacttcttactgtgagtgaaattaaggtttgatgcagttgtgtcacatcgtattgatatcaaatttatctttctaaaaaaaaactgacagtattacagcacagaggagaagatggcttgctgtaatcctgtaagctattttacattgattacatgctacataatgtacctaagtatataaaatacttgatctagaatgtttatgttttctccaaaattttctcatcaggtaatactttctcaacttcacctttagttttggcttcttatcatagtactaactatgcggtagtaattgtgttatgatgaaaggcatggagaagaaattataattttaaaactattataaagtggagacacacttgtataattaccatctatgtagactgccaaggtataaacatttagcttattttagtatcagactctttgaatcaatttaaggctttttcaataaaattggcttcctctaatttctactccaaaatggttaaaattttgttttacttcaaatacgttgtagggtatcatatttcatgtgactaggagcctaaactatatcagctgactggcataatttgtgaattatatgtgtgtttattaaaatttaaagtttttattaagacttacaattttattaagacttaatttttttccttacattttgagtaagtccaactgaaaataacttagagacttaggaaatttgactacattttataagtaatttccttgtaatttttctttcttgtggaaacaattcttactgatttacttaactcttttttcaatggcaaaaatgaaaaccaaatatatttgtcaactatattcttttaattgtggaaatgaaaggttcatatcccccatttgcctagcatattaaaaataaacatgacctttgtcttgaatgttgttaacttggattttaaaaatcaaaccaattataagctatattaaaattgcttatcaccttccctttgtcttcagtaagtctgggcctaaaaatactcatcatatgaataaataaagttttacaaatactttttagaacatcttgaattatatgtgtgtttgaagcttacttttggatgttcggtcaacaaggcttctgacagtttctttttatcttccctctattccctgccactgtgcaccccaaagtgatccctgaccacagtggtcccattgctggcatcaggaaggtagactgaggagttcaggtatcctagaggctgttaggtgaatctcttctacctctttcctggtcctaggaccactggacacttcaagtaaaaataacaattactttaatctctcaggtaaagtttcttctcccttccagcaacacagatctgcctgtgccgagttcaaatactctgaactttcaacagttgttctgaatacttttttgtcatcttatgatcaaatattgagagcattgaggggataactgaatgggcatggtataaaagtcagacttttagtgtttctaagtagcagaaccctttggacaatttagagggctgtgcgatatcctcaccgtgactgctgggaagtaatgggatctgacctgcagaggtactaccttggctgacaataatgacaaaagtgagagcaaagtacatatgactatccttgaggtcctcaggaaaaaaagagtattagtgagttgaactgtatgtaagggtctttaccaataaggaagcccatgcccagacataatccttacaccctggcaatagaaaccatcattgtggtttacatctcatcctgttcctacagtccagcaagttcaggccacaaaaggtttaagcactttttcctttgttctcatagcaacagttgcccatggaggttcagttacactaatattaacattttaatatacacaaagaagtgcctcgaatgtagtaggtattcaaacttgttaaatgaaagaagtaaactttcagacttaccttgaactactacagttttattctttctctaacctctcccactactaccatcttaaaaccaccatttaattagtattttataacaagttattaaaggctttcaaagacctttgaaccttcaccctctggtaagttaataacttctgatatgcgattaaatgtcaactgagtagtagtgggccctaagagctcagagggactgagaaatgaaggttattgtttagaagagtggctcaatgtgcttcgacagttggttaatatttgaaaagactagagtcaagaaagccttccatgtgctaggaaatgaaggagcaaaggtccagaggtggaaatgtatacagtgtgattaagggattttctgattgatagtaaatacagtcaataaaaaacttttattggaagcctagcctgtgtttgaagcattaagctaggtgctgggatacagagattagagatgaagataatgatgaagatattgttgaagtgaattgctgagaagctggagaaagggccaattaccataatctgaggctcaggaggaattggtgcaaagatcatctggtatgatatatatgaactgtatatacaaactgatctgtgtagctgaactgataatgccaaaaaaaaaaagactaggtttttgattaagatgaatccattaaggtcatgttttctgttggtgccattcttggagacctcccccaaccctatacatttataaatgtttttcctgagggactgagatggaagtggacatataaaaggaaaggtctgggcaaatacataagtaggtagtaaaatcaaggaacaaatgatctcaacaaaattgcccttcttgaaatgaatgaaaatgatgaaagccaatcacattgcatgatgaacttggggtatagaatatgaaatatttaaaattgctttatttcatgatgtttcagatgtagtaggaacttgttgcatagatggtgtaaaaacaatctagtaataaaatcttaggtatttaatacaaggtgaagaaagatgcaatgcataaatcatgccattttaggcttaattttcataaggctatgcctgtctttataagactatataccaggagttctcaagctttttggtcttggaacccttttatactcttaaatcgttgaaaaccacaaagaccatttatttaagttataaccattgatatttgttgtattagaaattaaatagacattaaaaatatttactatttaaaaataaccaaaaagatgggcatggtggcccacacctgtaatctcaacactatgcgaggccgaggcgggtggatcacttgaggtcaggagttcgagaccagccaacatggtgaaaccctgtctctactaaaatacaaaaattagccaggtgtggtggtgggcgcctgtaatcccagctactcaggaggctgaggcacgagaatcacttgaacccagggagatggaggttgccgtgagccgagattgcgccactggactctagcctgggcaacagagtgagactctgtctcaaaaaaataaaaaaaataaaaataaaaataacagtaagttcattgcatattaacataaataacatatttgtattaaaaataactattttccaaaacaatcaaaaaagcagtaccactcttctattttaaattttttcaaatctcccttttctaaaaaaaaaaaaaaaatattgtgtaagtttaaggggtacaagtgcaattttgttgcacggatatattgcttagtggtgaagtctgagaatttagtgtatcttcacccaaataacatacgttgcacccattaaataatttttcaacacccacccccttctcactctcttgagtctcctttgtctatcattccacactctgttcctatgtacacattatttagtacccacttaaagtgagaacatgtggtatttgactttctgagttttttcaactctggcttaatagaagacagctgaaatctcagaatgcttcttcatccagtctgttgtgaatatgttgctttgattcaagtatctaaggaaaatacagttttacacagatgtgcagctgaaaaggaaacatcttttaatatgttcagataattgtggatattgtcctttgatactatagcaaaacttatcaagtgctaatttcttaaaggctggttataatttgaaatctgaaaacatatctatttaattgtagtttgctatttgaaaatttattggtctgtcttgtactttgaatggatattttgcccacgtatgattttataacatcctgtattggccttttggaaaatttggtttactattatacagtttctaaatgttgataatttttattataatatattttaaaaagtctaatgtcactgccagtctcatcagaaaattctttgagattagaaagctgttaagatcatcatcacacttacaagttttacaaaattttaattttactcaaaactttatattttatcattgacaaagctctcagttgctttgcttagtgactgactcactttgttcattttccagaaagtgtttaccaaatgctgctgcctcaataccagagtctgtattgtcagttgatctttcaagtaaaaagtggtgttctatgaaaaacagctagttcagctgcgactgaaatgatataagtgtttctcctggagcaaaccaccacttcgatttgtagcagaaatgctgtatgtatactttccattgttattactcataacatttttaaaaatatactcaagggtggagatttttttaaaaataagtgttattgcttcatcaagaacagttaaatgaaactggattttttaaactgagtttgagttaatgaagaatgcagcaattattagtaaaatttggtgctccaccttgattcatactgacactccaggagttttacccactatttcttttgtacctttagtgcaaatgttaatatggtaggaatggtaaatgacatctttagtattattataaaaatcgtttttaccctgtatactctttgagactacacattgagaattgctgatgaaggtgttttaatttatcataagcactgaaaagatttacttaattcaccaatttctcctgaatatttgtttatataaaacaagactatgtgtatacacctacctttttattaatggtagagatctaggaaaattaatttctaagaactagccaggatatttggaatgtgaataaatcatatatccagaaaaaagctttagaagattgtctatgattgaaagtcaaacagctctcatttctattatactgttctttttcaaagaatttaccaattttatgtggtatttatgattaaacatacaccatgtaatttaacatttttaatgtcacttttacatcataggtattaaagattagcatttttattgtctgtattttaaagctcaaagaataacatttaggctgggtgcggtggctcacacctgtaatcccaacactttgggaggccgaggcaggcggatcacgaggtcaggagattgagaccgtcctggctaacacagtgaaacaccgtctctactaaaaatacaaaaattagccgggcatggtggcgagcgcctgtggtcctagctacttgggaggctgaagcaagagaatggtgtgaacctgggaggcggagcttgcagtgagccaagatcgcaccactgcacttcagcctgggtgacagagtgagactctgtcttaaaaaaaaaaaaaaaaaaaaaaaaatttagatttttgactgtttcattgattcatcttagacttcacatgaaaatatctgtatatcctcaaatgcttacattcttaagaagtatctcagccatttacacatgatagaaacaactaaatggaaaaaaattgcagttggaaattcactattttttatttgatccgataacaatgtgacatttgcgattggactgtaattttctgtctttctctctgaaaataagttcaaaaatttccctctaattcttttactagataagaagcctacttcgttgtaactcttgatatatgtatgtatttaggaacttaagcttttctgctaataaatgttatgtcataattcttgaggatagtattatattgtgatgggttttcagtaaactacaggagcagccctatttgtttaaaccctagtttaacctgattattaacaattaaattgtgttttcttctaacaattaaagtgtgtttaaatttattggtcccttgcttcacagatttatctcagtatgtggtgtattcaaacagaattttgtatttttaattaggggattagataaccaattctgaagagccaaaaaaattgttagacatcacattgcttaaccatctaatataccataagtgtgtgtatacactatgttgtgggagccatctatcaggcaggcctgtttttcaggcagtattttaaaaagtggacatgtgcagaaactgtgagcacaattagcgccaagcagataaatccagctctaatcctgtttacggtctacatcagacagatgtgccaagattgatttagacaagcccgaggcttacagtaatatttttaaaagtgccattcgctgttctatttttgttaaacctttgctaaatattcttaagtcttgttggttttgctcttcttattaaccaccgtaagtaacctactttaagcaggtcccgctttgctctcatggtgacaaggtaacctgccaggagaggttatctttattccctgtaattaagttgacttttccccccaaaaaaatacaacaataggaagtgggtgctgaattaaataaatagcatgatacccagtagatgtatacttaagttccttgcaagaacagatggtccccagtatctctgtaagtaatgtgagaggacagttaatgttctgaaacaactagctataaccagtatgatactaatgaaccagtagatttcaaataataaaccacatgccgccaagcaaaattatatgtcattcataaggatttaattatcataacttgcaaaaaagtgtcaatagatgatttctatatttttatctactgatatcaaatatcaatttatgaatagagtttcacttcatattttttaccaataaaggtatgttttaacattaaggtagaattaaagttatatttaaaatacatgccccaaagtatgtggtgatttttttttaactcctcttttactatactgtctgtatgtattgggctgtatatggaaatgtagcttttacatacaattaggaaaacaattgcttttatttctagcagaaacttgtactataacagaagtggctagcatgggaatcagagtagttatcttgtagatgacaactgaagcagacataaaagatgtaatattttttcagcactcaaaaatttataagtaaaattttataaacaaaaagcagtatttttgtgattcatatggaaaataaaatgagtctgagtcattcttaaggtgataccgtaaaggtgtatagataagaagtccatttttaaatatacccaagacaacagttttttctctcagtatggtttgttttcccttttttctctttaattatgtttcccataagtatttgtatattctaagaatgtccaaaaaataaatgttttgcagtgggggttgaaaagaaagaaagacctttttagatttcagctgatcttatcagatgatctctagaaccttgaaccttcaaccttcactgaagttagctggagggcttttcacctggaaacctgagaaacctcagaagccttctgctttagctctctctcaagtctaggaagccagtggcctgcgaccccacagagccagctggtccactcctcatataagaacttcggtaacaatacaaagacatagcaaagcaccatctaatctgataactcattaaacaatatttagatggctcaagactttaaataaaaacattttaagcttgtttatagaatactaacaagttttattcccaaagactatattcagagtgagaaaacaattttccttaaaactaatattatatacatgttcatatatgttaggaactagttatatgcaaaatcaagtgactcttgtgattagaactggtcacatttattcatgtagcataaatggttaatattgccaaaatgagtaatagatcagattttctatgtgagatattgacacctgagagatttacagtgtttcactgttgtgaaaaatggagtgctgaagaacatttgtctattgttatacatttgtaaaagaattcacaaattactaatttcaaataagaactaaatatttcttctaagcctatagtttttctttttaatttcttctaagcctacagtttttctttttaatttcttcttgtaacattggcaaaaagaccattcgtgtgaaaacctcagattttgatctgtacacaaatgcaggagtagagattggaagcttgagctggaaaagcaggaaatactgctcagagccttacaaggattttcagaattttcactgttgggtcctcctggttgctgcagtctaacctcgcatctccttgaaggcagccccagtttctgatgaaatactcttcagttaatttatacatatgctgtcttgctgttttcctaaggactgcaggcagaactgtggttcacctactgttttaaatttggctagatttaaaaacagatgatctcacttatatgtggaatccaaaaaagtcaaacttatagaagcagagagtacaattgcggttgtcaagagctgggggaggggaagcaaggggatgatggttaaaggtataaaatttcagttagacagaatgaataagttctggatctattgtatagcattgtgactatggctaataatgtatacttgaaaattgctaatacctgaaaatcactaagagactacgtcttaaatgttcttacaacacaccaaaaaaaggtgtgaggtaatgaatatgttacttagcttgattttaatcatttcacattgtaaacgtgtatggtactgatcttgtacctcatttcattttccatatgaatcagaaaaatactgctttttctttataatatcttatacagcatagatacaatttttagtggtcaattatattgtaatatatacataaatatatatgattttcattggtcaattatactgtaataaaacagcaaaaaataaagttgtaattaaaaaataatttggaagaaaaaattagcaagtggttggagattgaggaagatgggaccaataagtcctccaaggagagtcatacattagttttttttaaaagtccattattaatcttataatatttaatatgtttaatttcttgacacttattaatccaattaagtatgagaacactgtggataaatctaaaaaccttaaagttgagtaaaataaaccagatacaaagaagcacatactttatggttacatttatatgaagttctagaaaaggcaaaacttagctatagtaaaaaaatcatggtcctgagggaataactagagagtggtatgagggagctttctataatagtgggaaaattctgtatctttattgggatagtggttatgtgagtgcatatacttaaaaaaactcatggaattatgcccttacaaatctgtaatttttgttggtaatttataccttaataaaaaacaaaacagatgacagggttagtgattgtttccttgaagaaggtctttacatgggtctgttgttaacgagttgtagtaaaaatcatccaaaatgcttggattcaaatcttagatctgttcctaccagatgtgtgaccacagacaagttacttacattccgtcttcagtttcttctcttttaggaaaaagcatctagtttttgttgtagagattaaattagataatacaaatgaagtacagagaacagcgtttggtgtgtaacacatgttcattattagctacccttattttttagagaatggaaatttttaaatttaaactaatcaaactattttaggataagcaagtgaaacaatctttttttcaatcgatcacagaaatattttcactgaagacaaattagacatttatataagcaaactacagtgtcattaccattcaaattttcatatgcatattcatgcttacatgcatatgaaagcattacacatatgtattctataaatatatacaaaacagtaatggaaatgtgctgtactattttgaacatctttctagtcagcccggcattttatttacttttgagacagggtctcactctgttgcccaggcttgagtgcagtagtgtgatctcagctcactggaggctggaggtcctgggctaaaggaatcctcctacctcagcctcctgagtagctgggaccacaggaaagcaccaccatgcccagcttatttggtttattttgtttgtttgtttattttttatttttttgtagagatgaggtctcactatgttgcccaggctggtctcaaactcctgggctcaagttatcctcctgcctcagcctcccaaaacactgcaatcacaggcattagccactacactgacctctacattttaatagctgagtagccttctgttatatgaatatacttttttttaacaaaaccaatactccattattgtacatttaggttgtttccaagtttcactcaaataatgcttgggtaagtaagtatttttatttattattattatttttttgagatggagtttcactctgttgcccaggctgaagtgcaatggtgtgatcttggctcactgcaacctccgcctcctgggttcaagcgattctcctgcctccacctcctgagtagctggggttacaggtgcacaccatcatgcctggctcatttttgtatttttagtagagatgggatttcagcatgttggtcaggctggtctcaaactcctgaccctgtgatccgcccacctcagcctcccaaagtgctgggattacaggccgtgagccaccacgtctggcctggataagtattattttagctaaattgtgcatatttattcccttagagtaaattcctggaagtaaattgctggatcaaaaccaggtatattttaaagaattttccttttctacattaaaaataattataattctgattacaagaaaggaaaattatggagcttcataagaaaaaattagtctcatatttcatacctcatattgcatatttaataggtaaccagtgttaaatttgttgtgtgttttccactgggatttctttttatctcctttaataaaagcaggatcagatccctcagattactttgtaacttgcttttattctactttttcatacctcttagcatgaatgtctttccagaccagaatacagagatttcacttactcatttatgagctgcagaagatgactatgatttattcaaccattctcctattgaagagcatgaatattgcttcagatacttttgttattataaatattagtgcaattaacattttaaagtcttttgatacatattcccaacttgttctccagcaattaccatttttgcattcccaccagcactggggctacttccctttagttgcaccatcatttagcattatttttgatcttgtgccaatctaaaaggcaaaaagtggtatcttgttgttttaatttgcatttctttgattactaattagattgaactttttcatttgttcattggtcaatttgcatttcttcttttgtgaaatgcctgcttgggtcttttatgtactttaccattaaagtgtttttcttgattaaatagattatgtaactgtcatatgttgcaaatatttctgtccatttggcctttgcttatgactttttatgagtctttaggacttttgaggtctttattaggtattcaataattttaatgttaaatatattgatgtctgtcttcctttgtgtcttacggcttttctatttaaggttacgtaaatttctaatatacaaatattggtgtatattatgaaatagggccctatttttctttacaaaagattagtcagttctaaatcatcctttgctatttctagcggcgcttagatgccaccattatcacatcagtgaatttttaaatgtgtaattgtttcctgatctattcatttctctattcctagatacttctattgtaatagctttaccaaatatatctgatagggtgtgtactccccctcattacttcatttatttatttatttatttagagacagagtttcagtcacccaggctggagtgcagtggcatgaacttggctcactgcaacctccgcctcctgggttcaagggattctcctgcctcaacctcttgagtagctgggattacaggtgtgtgccactacacctggcaaatttttttttttttttttttttttagtagagacagggtttcaccatggtggccaggctggtctcgaacttctgatctcaggtgatctgcccttctcggcctcccaaagtgctgggattacaggtgtgagccactgtgcctggccccctcattgcttttaaaacattttcttactgtaatatatttattccaagagaattttcaaatattttatgagattccttgtccattccttacatcaaaaaataccacggagattttgattgaagttctattataagtagttacttggggtggggggaggggggagggatagcattgggagatatacctaatgctagatgacgagttagtgggtgcagcacaccagcgtggcacatgtatacatatgtaactcagctgcacaatgtgcacatgtaccctgaaacttaaagtataataataaaagaaaataaagagaatactggcatggaaaatatgtaatcttggaacttgttgtatctccacttattcaatcctttgtctctcagtagattttgaatggctctttatcccacacgagtctagaatcattttgctaagtttattcctagatataatatgctaattgatatgggaattttttttatctccattataccttcttcttgggtgtagacatatttgtagccagcttcctcactgcatattttttattaggcctaatggcattaagtttattattttggattttacaaaaaaaattatgataacatctttaaatagttagtttcaactcctcctttccccttaaatccatcaattactgtcttttatttcactttccttatgtactgactagaatgcctagaataattgaatgctatgagtaataataggtattcttgccctgtttttggaaatccttctggatttcagtaagtgtgatgttggcttttggtttagtatctttaaatttgcaatttacaagatattttacattggaatagtcattgagttgttaagtaaagcacaaacatgttaaattcagactgaagtacaggacttcaatgaaaagttaaaagagtttatttcatcactttcattttttctttccctcagtggctgtttgtcccctccccccaccccgctccatcccccagcttccttcctttgtgctcttattgttctaggtttgactacataaaaagagactctcaatttatatgtgatacaagaccataactaatattataaaattagtctagaagaagttatttgcaacctatataataagggactaatttcaagattatttgaaggactttaaagattggtaagaaaaaaatagacaaccgtttagaataaggcaaagcatgtgtagaggcaactcttaaaaaaaaaaaagtgagctgggtgtgatgatgcacacctgtggtcccagttactagggaggctgaggcaggaggatcacttgagcccaggagttcagggctgtagtgcaccacagtcacacctgtgaataaccactccattctagactgggcaaacataagaagactctgtgtcttaaagaaaaagaaatgaaaagatattcagtttcattaattgtttgactagctgatttttggaaaatacccacaaatataaccaagcctacaagttattttaaggtgggtaagagatacatcttatctatatgcattcacctatgtgaagcggacacccagtaacacccccgtgtggaagacaagcttccttaaacttcacaggacagtatttcccatgtagtccatcatagggtgaggatttttcaggacctttggtaagcctgcttgctttcattcttgagggtagaggaagggtgcaagacttccctggtctctcccaagcattttggggaccctggccataagcctacttgctcaacaggtgcaaatgactggtaatatgctgaccagatgcaagtgtaccaccaatgatttgctgtgactgagtttggtttcctttgcatatactatccagctttttgtttctaatatattcttccttaagggaaccaggacttcttggggaatccagatgagcttgaaacactgtttttataagagaagggctgttttcaaaaacatctatagttcgtaacaaaggagttagattgaagggactctcactgttcagtctgtgacaagcatgagtgttaaaatggagacaagaattttagttaattgtaatgttgaatttgtaaaaggctataacttcataatatgatcaaggggaacaagcaatctaaaatgtgttaaagtagcattttcaaagtgcggtccagggactctcagggttggtgaggtcacaactgtttttataatattgctaagaatgtatatcactctccttctctccaaggatacggtggagttttccagaagctatgggatatgtggcgatagccttgccctaatggagtgtgtgctttgtgctttgcatttttgtcctttaaaaatgcttggttttaattttgaatacaataattatagatagatataacctacataaaccaaagttatttgcggccctcagtctttaagggtgcacagtggggcctgagactaaagagtttgggaattgatgttctagagaaaagtcagtcttactgatgagggttaatcaattagtatttactgaccgggacaggacaaaccattcattttataaagacacacagagcatttcactaaaatacttttactctgattaagtggtgattttagtaatagtaatgattgtttgattttctgatacctgaaggaaaaagagcctgttgaattgatactttgagggtgttgagttttaggtcactgggtgactgtagaaatggaccaggagaagaactgaaacttgagccttctaagaaatagaagaccaaaaaatgtttagtgttaccctatcccatgaccacaataattgagaaaaaggcctttccgttccctcttccctaccctcccccttctcccctaccctctcctcccccctcccctccccctcctctcccctaccctctcctcccccctcccctccccctcgtctcccctaccctctcctctcccctaccctcccctccccctcctctcccctcccctctcctcccccctcccctccccctcctctcccctcccctccccctcctctcccctcccctccccctcctctccctccccctcttctccctccccctcctctccctaacccctcccaacctttcccctccttctctgtccccctccccctccctccctgtcttcctcccaccccccactccctgtcttcctccttgtcttccatcctcccttccttcctttccttcctgtctttcttttcctttctttcctttttcttctttccttcctgtcttccctcctctccgtctgtctccttctccttgtccccttctctctgtcttgcctttcctttccttctgtctttttctttctttctctttctttttcactcttcctttttttaatttcccttttacttgccttctctctttcattccttccatgctttcttttttttagtggtatgtatactttgtgagcaatcagactatagcttgcagaatagttgggagaggccaaaaatgcccctgagaatgcaagcaaggaacttcttagtgagcatatgaacatcctcactccaatcggaggataacattgttcatacttcaaggactaaaaagctgagagagggtctctgctttctgttacttttagcactcgagtcatttctgcatgtatttctactgattactttttctcctattttggttcatatgttttctgcttctttgcttgtctagtgattttggattagatgagtgacattgtgaattttactgtgcaggatggctgaattttttttctattcctgtaaatatttttttggcattgttctaggatgtagttaagttacctggaaaaagtgacatccttttgagaggcttgcttttaagttttgttaggtggaatcacagcagtctttagccagctcactaaggaccaatactcttctaaatacttaccataatgtcatatgaatttccatgtttttccacttcagctggtaggaacacctgtgtcatctctaagcattgtactgttaattcttctagtagttcttatctggctttgtacatctgctgatcaatactttcagctaaagtctcaaggggacctctgcaaatctacagtgttcactgttcagctttctcttctgtagtaaattgcacagtgaactctagtccccttagccttcctgaacccccagttctccttaactcagggagatcaccaggccccaccaggattcctgtatctgccctgtgacctggagattctctgcaggcaataggttggggcggtcgtagggtccactttgttttcctcctcttcggcttcactgtcctgtgttacctgatgtccaatgtctgaaaactactgtttcacgtatcttgtgtgcttttgtagttttaggtgaaaggtaaaactagtttcttattattccacattggccaaagcagaagttttggaagtctttttttaaggtctaaaacacttctactttgagagtcaattgaaatggtcttttccacaataattattttctgacctatggtttaaagataagtcatgaaaattttatgccactatttttttttaagtctgattatggttaaattcagggggctatttcctcctagattgacagagtttataatgtttcctactcacaataattgtacttctgcttcctctttgcatgtgttactttaatgggaatgtatatttccttttcgttaaggctgccttcaacaatttgtcataaagtcacttctgttagtgaattctattttttctgttactttactctatccttagtaccaaagagctccttatgtgacaccaatttattactaaaatgtcgctttgtttatgttcttggaattcttcatacattgactatcctcagatgtcgaatgttgtaggcctgtgtggcagggactctcttccatttattctatttttaatctaattcttgacaaaataaacccaatttttcttttcttcccctttccatctcacgtagggactggcataaagggcaatccataaaattacaaatgatgaatttttttggttttaactattattcatacatttaagatatggtcacaatttttatttcttactagtaattcattttattttttaacttttaggttctggggtacacgtgcaggtttgttatataggtacatttgtgtcatgggggtttgttgtacagattatttcatcacccaggtattaagcccagtacccattagttatttttcttgatcctctccctttgctcactttctaccctctggtaagccccagtgtctgttgttcctttctatgaaacacaatggttttaattggaaaatttatttttttttcaggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggtaagtactcctcatgggaaattttaatcagcccagtttccttgatatacatgattaatctagacatgttttgagtaaaaacaactttagtgatgttgagatagtttccttctgttcctagtttttgtcgtgagaaagtgttgaaatttgctaaatactttttctacattaattgagataatcatatttttccctacatcctgttaatgtggtatcttatattaattgattttcatatgtttaacatccttgcattccaggaataactccccaatggccatggtgtataatcttttaaagatgctattgaatttggtttgttaatattttgttgagtatgtttgcatcaatattcataaaacatattgttctgtagtttttctgtactgtttgtctgactttggcatcagggtaatactggcctcatagaatgagttaggaagtaactcttgaatgactattttcatgaagaagcttcaataatctgaaataaaatacttaaataatttagttcacctgagagttgtttttagaagcgtatttatttttctattaatgtcttttttgaactatataagaatgtattctccttccactcacacattgatggcaagtgtgtatttgtactctgtggcctgaaaataagatttttttgaataatcttaagaggccatgctttatactctggtaattgagaattacctatttcacagtagctttttctaaaggttaatttccagagaaaagagaacatgtttattaggatatatctcttaatgaattcagtgtatctgaaatttctaaatgacattttcatattttgcatactaaataaaattcataagtacaaatataatgcaattcataagtacaaatataatgcaatttggatttctagaagttatctagttaaaatatgatcttaggatttattttttttgtcttagatttatgaatcttgcttgtttttctgttaattcatttcttcttgtttgctgcatcagtcagatcagagtagaggcagcttgtatagttgatggcacagtttagggttagatggcacaggatagaaatgggtgctagacaaagagcagtcacagaggcatgttagaaatttccagttccagcatcattgatgaagaaaaccatgaggacccaagttgatcaaaggcagccagccaataaagctatgctcatgcgagatgagctgaagtgacattacattaaaattggaagaccctcttactaagtggctccatgcttccctgctagcccctttgggacttccaagaagacttggttatttcaagaagacaagaacccacagaggctgtagtttagtttatctctctggaaacatagagaatatgtataattaaataaaagcactttaatagtgaatcctttacagtgttatttgaaatttatgtcaagtgatttaaaaagtaaaaatgaaaattaataatttcagtggaagtaaattgattaacatgaccaggaatacataaaacttgcatggtcttgtctataaaataaggatatgtcatttaattaggagagtcaaagctcattcttgcgcttaaggtctgaggaactcttctcccatggggcttatgaagggctacactgaggcaacttcctcaatatatctcagccataaaaccaagagaaagtaagaagcagaggacatcacaacaaagctcaattcagtaaaagcaattttataggagtagagggacttgtcaaaaacaaaaacaacaacaaaaaacaatgtccaaatatttattcagcttaatgagtgatgtttttgtttgatctagggttaaaatctagacaaattacagagatgaataaactacatatcctttagtctaccatcctctgaaaatgttactttttgaaactttgattttgataagagctggaggcactcagggagtcattctctggcatggtctttgagtacagagtgattttgctgattaaaagcaaatagattgacttttaaaatcaactcatacaaacaaactgttaaaatcctctaatgagagtgaagaaacctaaccaagactgactgatacattactgctccatctctgcaccaaagtggactcagggaggcctgtaggagatgccaactccttatcctactccccacaaagacagttcttggctatcttcatcagacacaaatgaatggttgaggctccaaagctctctaccaattcttgtgttacactggcacttttaaaaaattttgtttattttttatttttaaatggagtctcactctgtcaccctggctggagtacagtggcgtgatcttggctcactgcaccctttgcctcccgggtttgagcaattctccctgcctcagcctcccgagtagctgggattacaggcacccgccactacgcctggctaatttttgtattacttagtagagatggggtttcgccatgttggccaggctggtcttgaactcctgagctcaggcaatctgcccaccttggcctcccaaagtgctgggattacaggtgttagccaccgcacctggctggcacttctcttaaaactaatatctcaagaagttttttctttaagaatcttctttcaattgcaggtccatgtagttctggtattcattaaagtgcctatcccaggggttttggtatgttgtgtttcaattttcatgtttcaatttttttgatttatgcattaattttgttttttcagaattcaggtgcaggttgtttagtttccatgtatttgtgtcgttttgagaattcctcttgttcttcatttctaattttatttcattgtgacctcagaagacacttgcattgattttgattttttttatcttattgagatgtgacttacgactatgtggtcaattttagagaatgttccatgtacagatgtgaaaaatgtatattttgtgttgttgggtggaatattctgcagatgtctgtcaggtccatttggtcaagagtctgatttaagtccagtgtatacctttgttagttttctgccatggtgatctgtctggtgctgtgagtggggtgttgaagtcccccactattattgtatagctttttttccccataggtctagtagtatttgttttatgaacctgggtgctccaacattgagtgcatatttatttaggatagttaaatcttctggttgaattgaaccctttatataatgccctcctttgtctctttttgatgttgttggtttaatgtctgtttcttctcatacaagtatagcaacatctgttcttttttaattttctatttgcatgctagatctttctccatcccttcactttgagcccatggttgtcattacatgtgagatgggtctcttgaattcagcagaaggttaggtcatttaaaaaatctaatttgccactttatgtcctttaagtggagcatttaggccatttatgttctaagttaatattgatatttgaggttttgttcctatacatttgatatttgtgtattgttaagtagttgctttctagtttgaattgtgtaattgctctataagatctctgagccttgtacttttgtgtgcttatatggtagcaagtattgttcttttgtttccatgtttagaactccttggagtatttcttgtatggcaggtgtggtggtaacaaattcccttagtgttttcttgcctgggaaagactttatttctccttcatttatgaagcttaatttggcagattatgaaattcttggctggcattttcttttttctttaaggaggctaaaagtaggcccctgatctcttcttgcttgtaaggtttctgctgagaagtcctctattagtctgattggatttcctttataggtaatttggcccttttctctagatgcctttcatattttttctttggtgttgaccttgcatagtctgatggactatattccttggggatggtcatcttgtatcttgcaggtgttttctgaatttcttgtatctggatgttaacctctctggcaagattagggaaattttcctgaattattgcctcaaatatgttttccaatttgcttacttcttcctcttctccatcaagaatgccagtaagtcataggtttggttgctttacataatcccatatttatcaaaggctttgttcatttttcagattctttatgtttgtctaactgggttaatttgaaaaggtggtcttcaagctctgaaatcttgtcttctgcttggtgtagtctgttgttaaaacttccaagtgttgttttgttttgttttgttttgttttgagatggagtctcactctgttgcctaggctggagtgcagtggcatgatcttgactcactgcaacctctgcctcctgggttcaagcgattctcctgcctcaccttctggagtagctgggattacgggcgagtgccaccacccccgactaatttttgtattttttagtagagacaaggttttgccatgttggctgagctggtctcgaactcctgaactcaggtgatttacccatcttggcctcccaaagtgctgtgattacaggtgtgagccaccatgcctggcctgcttccaagtgtattttgatgttccctttagtgaatttttcaattccaaaagttctatttggttttatcttaatatggctatctcatgtttcatatcctgcattgtgtttctggtttatttgaaatggattttaaatttctcttggctctcactgagtttccttgcaatacatattttgtttttttagtctgtcatttcaaagttttcaacttggttaggatccattgctatagagctagtgcaattctttggaggtatgaagacactctttttgtagtgttggagttcttgggcagattccttcttatctgagggagctgttgattcttatttttgaatttcctattggttgggcgggacttaaactttttttttttttccccttgagggtatgactatggtgtatgttgtgtgtgatcattcaactttgtttctgggtgctttcagggggccaaggctctttatggattccttgggcgtggtagctttcttaaatgctgcttattgtagcaatgtattggatttgtgagctgacactctatctcatgtggggctgagggtgcagaagtctcaggaagcttattttgtggagtagtgctaagcctttctggtagtgggctttttatttgatagtacagttcaggctgcaatccagtagatggcacttaaaaaataagaaccagcttgccctcagttaggctgatgtccagtagaagcacctgtcctgacaggggagtgacaggaagagattctgttggtgtgtgccgaggcctttggggtcgctggttggggggagatagggggaggtgcactagctcctcatgcaggaatgtgatctgcttttctatcataccccatcagagggctcatgaccttcagttcataaagattttttccttgggttcccagccatagtctgtctgtaggttatgcatatgcccctctgaaggcaaccaccaaaatggtcttggggcagagcctcttcccccagtctagggcagacaactccatgacttgtatgtcctccattgctgggacactgctgctctgtgtagggatggggagttgggccccaccctttatgtaagcctaagtggcattctcactttcagcaggggtggagccatcttgaaaaccatgaaaaactctttcttcgagtacctgtgctggcccccagtgggaagaaccactgctgcgtcttcaacagcgtgtggggtgggagggtattgccacagatgaccccctctccatatccgttccttgacatggtgttgccccctttagcgattggcactgtgcccacctttcctttgtcccaaaggggttttggcaagttgtgtccctctcccttataggtggcctacactaggggggttagatctctagaggttccatagctccctgggaacttgctggccccctgggcttttcaaagtcagaacaggttatgaggtatgtttgctggggatctggtgctacagagactcaagggtagagaatccctgggcagagcagaggcccaccactggtgcacaagcaatatggtgaccaccatctcagtttgtgtctgaggggagtatgggaacccctgcaggagctggccacccagttctctatccctgggaaattcctaaattaccaccaataacattgccctgggtcacaagggtggggccttgaattctttgggggttgatctctgccagactctagctacttttcctttctgcaccccagcttcttcccatgggcactccaaaaggtcctggctctctttccccagttttccattagaaacttgtccatttgacagtaactttgatcttctttctaagaagagctggcatccaaggtctgtggtcagctatgttggaaaaaagaaggagaaaaaaactagtttgtattaaattctgaaagactagtggcactggttaagtctttaaaggattgttaacaaaagaaaatctttttaaaccaaactcctaattttatcagaattgtaactgaaaatataaatgtatgaaaacataggtattatgtaaaatttgctcaataaaagaataggaaaaactactatttatcttggactgatagcatgttagtttgagatttgaaccctttctactctagtaagtagtggtgggaaaaattcactgtaggagtctgcagacataacaaactatcattagactgccaagacctccacataataaagcaagcagagaatgtcaaataagtatgtgaaaaatgatcaaaaaagagaaattgaaaatataaatagggtgctattaaaaaaggatagcatttatgttatgacatatgtacacatgaatatcactttttagaatttcatccttcttaggacttattcctgagtccgaggattgagaggttctgataaaataagtctcagtgggttccaggcatgggctttctttaaaagtctctccagggattctaatgtgttgccaggaccaagtaccatggacagccaagatctcatcagcacagtttgattgaatgaacttatgtagaaccctgaatgccacacttaaccaaagaaacctttccagggattaattataggtgacagaacatgctatattcttattaaatattattaaaagttaagcaatacccattcctgattcatgtaaaattctcacttattttccaagagttttactgtatgactggtttatgggatgcttggaaaaggttgacagacatggcaaaggttcctgcagtgtttctctttgtccatcaacagccctagctcataacctctaccctttcagctaaaagcaattagctcttcagaagtgattcattctatttatacttgggataagtaacatcaggcagtcttccctagggcttctcacgggccctggtggcatttttattctaagagagggttatatttttacatgtaattggtcataattatactaaaaacaagtaattggtgtcttatacaagaaaattatatttctgctttagtcattgacagagtatcctgagaataagagttaagaagtatattcattgtcatcttatttctgatatatttcaaattcttttgctaggaagaagcccttttgactgtgctttgtgtaacaaaacttcttcggagaaacaatttagataaactttgtcagatcttatgtgattatattcaaaatgctaattgaagattctctaaacattttcagtaaaatgttgaattgttttcatgctgttaaataagttaacatgtcttcctttactaaagtcattattataaaaatgtaaatcctaatgataatagctgatgtttattaagcatttagtaggttccattttttgatagcaacttttatgaattatctcattaaatcttcataataatagcatcaagaactacaaatatgttttcatgtaagaagggaaataaaattatgagttttgctgtgaggtttgaagaatgaaaacaatgcatgacttagaaaatagtataattaagtgaattttattatcattatcatctcttagtttataaatgaaaaaactaaggcttacataatgtaaaaatcagttaacaaggttaaacaaccggtagatggtagaggaggagctgggaataaatctgtacatgtctgaatctggagcaggaacccttaactgatgtgtcattctagcaggtcatcagttactctacaatacctattaagtatactttatttactgtgtttagatttatagtagatttagactctactgtaaaaacaaggacttcatacacctgctagaaagtatccatatcatcttgtttgaaagttgtcccgctctagtgttcttttctaatcatgatgattcagaactccaaactcttgaagcagggcaacccgtagggtcagcattcataatttctcaatacttaaaaaagtttcctcatgactgttgctattattgagatttctcaaatgtcttggcctgaattgggtgtgcactatgaaaaaaaaaatggcagacatttctttttgttaaaggaattttaaaaacacatataaacacactgatttgtgacagattaccaggctttatgtttagcagggtttcctaagcaaaacacaaattctgtaaatctacagaattagataaaacattgactcaatccttagatgagagtataatggattatcacttaataacttctgtcactgaaaataaatgatgtaaaaagtaataaagttctactctcacagtatgaataaataggaaatacataatactttaaattaggcaacaaatcattaagcccccagcattcattagactatcattaatgataataaaattgtgtggtatttatacagatattatatgtaactccaggaattttgttataattgtgtatgaatatatttgttgtttgaggcaggtagatggatatttgcagcagctatgtgctgaagcattctggtaatagttttcaaatcaaccatttttttctccttgtcgatcatctttaaagcaaaagcaccgttttttactatattttttgaaaaaaatacattaggtgtaaaattatatattttgaagaagttcactttctgtttttactagtttcacacctttgttattttttcagtggaaggagcagagataggcaaaggcgaagcctgtgtgtgtggtcaggttcctgggcccttcatagcatctgatgccaagctgtgttctcttttgtgtcattgccttcccacttgctaattacgtgacagagctagggacttccctctgtctagaatgccccccatctcttgtttgcctagtgaaatctggtttgaagttcaaggtctgatacaaaccaggtgatcctctgcaaaactaactgtacctgagcaaaccaggcacttactcttttatatgttcctggcactgctgatactctgatagaaaacatcatcacttaatgctaactgtgggctcacaaaggggatacttctactgtaagaagactgtaactcttcttagcacagagattagtaagtacttgaaacagagtttcacatataataagtgttcaataaattttattttttatttctaacacttggcacactgcatagctcagtaaatgttggtgaagtgaactgagtattctccttatctattatgtggtaggcattattctagttgcttctgttataaaccaactcatttaatccttatcacagcacttttattgtggtcaatattttttaatcctcacagatggctaaggaatcagcactctgagagattggttgacttgctttgggtaaggtgcttataaagtggtagaacaagattcctatccaggccttctgattcaaaaatacattctttttttttttttttttagtagtgttttctggaaaggcagggtataactgactatgctgtgtatttgggactaagtatattattgtcaagtatattaaaaatgtcgcaacactggaaaggagtccatcaatgggctatgcaggttgagggatttgtagatgagaaactgataaatttggttagcaaggaaagccatcaagctgtgaaccctttatattggcaaaagagagggtcctttgaaatctaagggaacagaactttcctgttctccaagtttggagcagaataggtaagctctaggcagtctaatgcccaacttttaccagtggtgttttagttttttttttttttccaaaaggaaatgatggaattctttatatacttctgaattgtctatcttttcaaaaataaaaattttcattttgcagtacatacagaatcaaaagactttcaagtcctaactccacaaatgtttattttgaagctctttaaactgtttaccacggatattagtaaatctgtcagaaatgaggtgacttacttatccttgtcccaccagatatgtgggaaggatgatcacgctagatagcatggatgggtcctctatttatctctttttacttgaatggaaaacacatcattcagattaatcaattagtcattgtgactgatagaatttttatatggataatctgggtttggtccctagctttaccacttacttggggtctttatgtcttctatggtctcctatctgtaaagggaagttgataatgccaatctagctaggttactgagatgcttaaatgtgtaatgtatgcaaagcagcaggtactcaataaagggtaactcttactattattgtatagctctccaggtatgtattgagcttctatagaatccatagccccaaactctttagccctttgagaccaagattaagcattgtctttccagaggagagggtgagagagattgccattatactaatagaattcatcattatcaccgtcatcatcatcatcatgatttcttggtgtgtcatggaatgtactgtgtttcacattaccaacagatgttaattttcacaacatccctgagacaagaaactatgattacattttacagataaggtcatgcagctataaagttgtgaaattgggattcaaactcaggcagtctgtccccacagtccatgttcttaacccaccatgctctcctgacacttgaaaagttaggaggcgtactccatagcctgtaatgttgctgcagagagaatctaattttaaatccagtgaagcatattagttgctgtctttgatatgccattcagattgtgctatccttatgatgcctaccttggttgtatatgtaactgggcgtcaaatatataaatactcaaaaagtgataggtgccaataaaatattttatagttaatacttatgtaatctgtgttctctgtgtttgagggctggttctaaaatactgctctatatttgacttctggttaaaacaataaactttgctcatattagttatatagttgataccattctcatgttgctaacatgtctgtaagtaacagttgaaattgatctggcaattttagagctgtcagacccaggagatgagagaaacatttaaaatgtttataacattaaatcagctgagtcaagagagagaaagagaaagatgattcagatttcttgtactggtggatgtaagtgcttggaactgaaataaaggagaaggtgtagggagggagaaagataaagaagtcttccctttatacaagttgaaattgagttttctttgagatatagaggtgaagacattttaagaaacttcttaaaactctctaatgtggcttttcaacctgtttccatcaatttggcacatctcacttttcggcacaacagaatattctaggtttatctcacaccttccttgccccagcccaggaatcagccatttctctaagaaactcttgtttattttggtggggaacagtattgggaaaccaacatctgggagctaaatatactcctagtggttaggaggtcataccttgtagactcttgtagctgacggagttaggacatatttattagaaatcataagtttatattgatcttgctaggatctatccaatcctacaagattcttccctgtgtctctcctttgtatttgtgtatcctttcttccatattaagaactgtggctcccaacaacaaggcatgtgcccatttgcccaatcgtatgatgtataaaaactactttgagaaaagtggcagccaaaccactaagaaaaataaacttgctgaaatgagttcaagatttattggcagctctttttttggcccctagactgaaagtatatatttcaagtattgtgttcaaaaattatttgggttagctttttccacctttcataatagtaatattatttacttgaaatacagttggctttgtttctatattcagtttttttctctctatcttcattaatttcattatatatatttaatatgtaggacattaacatgtttccaaaagaagaaaacactccttcctgtatcatttccacctcatctctcttaccccttataggtaaccaattgcactggtttctagtttatcttacttatattcctatttgaaaagttacctcatatatgtatgttttttaaatttttatacttttttacacagaaagtaacgttcagtatgtactttgccactttccttttaaacttaacagcgtatactggaaatcactccatatcgtgtcacagagagcttccttatattttttaatagctgtataagacttcattgtgttgtctgtaccatattttattcacttccccatgtgtggacattttgactgtttctagtatctgcaattactaataatgctgcagtaaactttgtgcatatcgtaccttggtaaatttctagacatagatttctgggttaaaggttaagcacatgtgtagttttgttagatattgataaattcctttccatggggtttatatcatttttaaaatatttaccagcaacgtataacagcgtccattacttcaaagcctcaccaacagattgtatgttttaagtacttttatgttttagaatttttccaatgcgataggtaaacaatggtatatcaatatagttttaatacattaaagttcagcatcttttcaagttcggctagtctcagggctattcttaatatcttgtgaattatcttcatattattttcccatattccataatacttttggttttttttcctcctcaattctgacaagttctttatatttcaggaatattagccattttatttgatatgttacaaatatttttctcccaatatataacttttctcttataacgatttttttttcatgaaaagtttttaattaaaaccttttatgggcccaggtgcagtggctcacacctgtaattccagcactttggaaggctgaggtgggcagctcatttaaggccaggagttccagaccagcctgaccaacacagtgaaaccctgtctctactaaaaatagaagaacattagctgggcttggtggcacatgcttgtgatcccagctactcaggaggctgaggcatgagaatcacttgaacccagcaggtggaggttgcagtgagtcaagatcgtgccactgcactccagagtgggcaacagagtgagactctgtctcaaaattaaataaatatataaacaaaaccattatgggccaggtgcagtggctcattcctgtaatctcagcactatgggaggtcaaggtggttgaatcatttgcgccaaggaactggacagaccagcctgggcaacatgggaaaaacctctctctaccaaaaaagaaaaaaaaaaaaattagctgggtgtggtagcatgcaccagtagtcccagttactcgggctggtcacatgagcctggggaggtcaaggctgcagtgagcagtgattgtgccattgcactccagcctaggcaacagagtgagaccatttctctaaatacatacatacatacataccttttgtggagttaaatttacacactttttctttattggctctggcttttgcattgtagtaagactttctttacactcaacttatagataaattcacccatgttttcttctagtacttgcatagttgaattttagatctctagtccatttggagtttattttttgtatggtagaaggtattgatcctattttttcccaaatagttgttacccagttgtcccaaaacaagttattgaaaagtccatctttgtcccagatagactggaacaaaatgaattaaagacttaaatatgaagatttttacttgtgtatcctttcttcctagaaagaaaacataggcgtaaagcttcatgacgttgaatacttcatgccattggtctggcaataatattactattatgaaaggtggaaaaagctaacccaagtaacttttgaacacagtacttgaaatatatactttcagtctaggggccaaaaaaagagctgccaataaatcttgaactcatttcagcaagtttacttttcttagtggtttggctgccacttttctgaaagtagtttttatacatcatacaattgggcaaatgggcagatgccttgttgttgggagccacagttcttaatatggtagaaaggatacaccaatagaaatatttatatttaagtctggcaatcatttttaagatgtgaacttgaacaggcaacaaaagcaaaaataggtacgttggattacatcaaacccaaaagctcttcacagcaaagggaacagtcagttgagtgaagagacaacctatggaatgggagaaaatatttctaagccacacatctgacagagggttaatatccaaggtatataaagaactgcaacaactcaatagcaagaaaacaaataacatgaataaaaaatgagcaaaggatctgaatagacatttctcgaaagaagacataccaatggacaacatgaaaaaatactcagcatcactaacaatcagggaaatgcaaattaaaaccacagtgagatatcgcctcacacttgttagaatggctgttatcagaaagataaaagataagtattggtggggtgtggagaaaaaggaactctagcccactgttagtgacagtgtaaattagtatagctgtgatggaaaagagaatggaggttcctcaaacagtttaaagtagaactaccatatgatccagcaattccacgactgggaatatatccaaaggaaatcagtatattgaagagaactgtattttagtgattattgcagcattgttcccaatagccaagataagggatcaatctgagtatctatcaatggacaagtgataaagaaaatatggtgtgtatacacaatgggataccattcagcctttgaagagaaggaaatcctgtcatttgccacaacgtggttgaacctggaggacattagctgagtgtaataagccagccaccaaaagaaaaataccacatgatctttcctatatgtggaattttaaaagttgaactcaaggaagtagaatagaatggtagtgaccaggggtatgcgataggctgagggatcaaggagatgttggtcacgggatacaggatttcagttagataggaggaagaagttcaagaggtctattgtataccatggtgagtatagttaattataaagtatacttgaaaattgttaagagtagattttctgttcataccacaaaatgataagtatgtgagataatgcatatgtaaattggctcaatttagccatttcacaatgtatatatatttcaaaacaacatgatgtacatgataaatatacagtttatttttaattaaaaattttaaactctctaattggtcttcaacatatagtacacaagtcttttcacgactctttataatggaacatatgttcttggaatgctaaaaattattttttttggaggccctgcaaataactaaaaatttatcttaaaagccacacctaattacttacatatgatccagaaaggatactttgaaaaagctttttaattgataaaatcattaaggtaaaacatattcataaaagtgttctctaataattttataattttctagttcatgaaggattaaatatacaactatcatttgaattggattttttatgaggttaattgtatttaaatgctaattattttaactaattttgtggttgacttctatgtagagtagggaaaaagaatttcctaaagccagttacgtatatctctttttagtctggatttttaattaggaaaagtgatatagttaaataggtctactctatagcatcttctaaaatgagtaaaaattcattatatcaggataaaaaatgataaagatatatggatgacacatttggctgaatttttcttcttcgctgttctcttgctctctatttaaatagtcttagctcttttatcatttaaattctgaagtattgaggtgattattccggcagcaggtgattctgctaattactgttcagtcagttttagctattagaaacagagatatgtttacattgctgggctgcatgtaaatttagaagttacatggctttgtttttactttgacttacggcattaaaattattttcatctgtgtatgtaaagatctgcatctataagcttttgtggataataaggtgaaattgatgcattttaatataaattgccaatataaaatatctctaactcagacctctactggaaagttgtcaaatcttatgtaggaaaggcttttaccatcactgttacacattaactgggcatagtttaatattaatagctcctgagacttgtggttaactgaggtttctatttcctgtgtttgggttttatctttgcaacaacttggttgcttttctgtgtaaaatagtggtgaatatacacaagagtatgacaaggttctgggctcttaactttgatgaacaccatgccatttccatcatgctgcactcaaaacagcacagatgtgagtctgggagtggcgtccctgccgctctcatgagcctttgtttggagaacaccctgattaacccccacccttcacggttcattgactcactgatagatcaagtttaaactagtatatattagcacatttgttaccaacagaggaacagttggccattctgttttacattgctggttcattgcaaactggcgtgctaaaaaggtctgtactctagagtatgaattgggaagttaccaaaggactgagaaccaagtcagttgcatattaatgttgaattatacctatattttaatcttggattgtctacttgggggatgcttacactgttgtcaagttatgaataagtgataattaccactttgaaattcatctttttttttcaaggagtttaggggatttaggtgtctcaatatagctttcatattaaacagtttgtcataattggatgagagcagagcaaggtcatgactacctgatgccttgtgttggagcattttaaaaatgttttccagagagttatttgtacctaatgactttacataagtccttacattatactttatttctaggtcacctaaaaatgttaattgtttagtcaagagggttaggatgtgtgtctgttttctcatgaaaaaaattaagctgttccctttttatcaattttcttgcaatctaaaggcttttttttcttaccttcctaacctagtgactaaggtcatcttattgttacagttcctttcatgggagataggtttactgcatcatttggcagtttcatagggtgaattttgtcttggcttcatctttccttactggttgtcatcccctgggccacctgcttttttgcattttcctttctcttgtgagatgatgaagctctgtgccccgatggggatgagagacagcactctgagttcaagtctaggataaggcaatgggcttgcttttcaaaacaaactagtgtcatacgggctgctgctttcaggtccactgtctgattttatcactgatgacttgtttctggaaggcaaactgatttaagttctgagcaaaagggtcggtgtttattttcaatgctactattaatttagagttttaatttagaaaagattttttaccagttctcaaatatgatttttctattgactttaagtttgtagatataaggagtagacatgagatagagactgaattgcttttttgtttttaaaacttggcagtaataaggggttgcttgttttttcatgctaaatattttttctaagggatctagatacctatcagaaaacttaactttgataactctggttctttattaagtatttttgtcttattttaggaattaatagaaatagttgtaattttagacttcctttataaaataccaatttaaagagaagctttttgcttaaatgattgttttgcagtgttgtgcttttgttttctttaatgcagttgaaatcgcagctttataacttattttttaatttggggtttttaaaagaatattagttatttatttatatttattgggcacctactgtgtgccagacactattctaggaactagtaaacatagcagagagcagaatcatgaagttcttgacctcaaggagcttaaatcctagtggtagagggggaattcaaaaaaatcaaataaatgtatttctattatgtcaagtgatggtatgtactaccaggcaatcagatgaaaatatttcctcttctatacacagtgggcaaggaaggcttcattgactgtggagttttagaagaaagctgaaagtaatggggaaagagagccatatcgatatatgaaggaaaacatggtccaagcagaggaaacgaaaagtgcaaagaattgagcaagaaagtcatgttcaagtggagtcagcaggggaaagagtaggtcacaaatgcggctgagggtgggtcatgaagggccttacaagctttgtatgagtttttacttttattctgaaaaaaacaaaaacaaaaacaaaaaaaaccggggagctatttggggattttaatagaaaagtaacataatttccttttaaaatggatatgtggccactaagtggagagagtggtgtatatatgagtggatggaataattgatacaggcaagcaggagacaggttaaatgaaaaatggattaatccaggcaaaagatggtgacttaaattaagctgggagtgggagagatggtgagacatgcttagactttggattcatttttccagatagaactggctgacagagacatgtcatttaccaacatagacatggcagattttttttttcttttctgagacaaggtcttgctctgttgtccaggctggagtgcaatggtgtgaccatagctcatggaagcctcagactcttgatatcaagtgatcctcccacctcaacctccctagtagttgagattacaggcatatgccactgtatccagccaactttttttttttctgtagagacaatatctctctgtgttgcctagggtagcctttaactcctggcctcaagcattcctcctacctcagcctctcaaagtgctgggattataggagtgagccaccatgcctggccaatatggcggttattaagaggataagtcaaagattacatgaatattctgttatgaaaagtgtcaaacatatagaaaatataaacagtattccagtgggcacccatatttttatcaccttgattctacagatcttaacatttttctgtatctgcttcaaacattttattctgccaatgtgttctaaagtaaattgttgatattgtgatagttctctccaaaatgctgcagtgtgtagctctaaaaatagatatttttcagataaccaaatatcattaacctgccaaatcaatgaatgataattgcttattaacatttaatacttggtccatagtcaaattctccatattttccataatgtcttttatagttaacttttaccaactagtgtctgatcaagaatcattcatttaactaattacatttaaactgtaacattacaacatgttttttcgtatgttttattctctctgacattgacttatggaagagactagattatttgtcctgtagacattttatcatacataagagttactaggagagctctgattactagtccccactctcagaaattttgattcagttgctctttccagtgagctgctggtgatgctggactttcattctgaagaccatactttgagcactactgctgtaccactatccgatggcttctttgtgatatcgtttaacttgttgttctgttgcctgtatttcctctaaactgaattttcaatctaaaggcttactgagattcatgtttgatactttgggcaagaatacttcataagttctagtgcttaatgttaggtagcacttaattctgactatttcactattcatgaggctaagctaaggaggtgacagcctgatccttctattgtaatgtttcatgtgaaactactagataatttgttgagttggggggtgggtagggaagagatatctagttttcaataaatatttcacctaatggttttaacacacattgatcatccttgcctgaactaattatttaattagggatggcaacatggagactttctaattcaatctttttttttttttctaaatgaatggccttgtttttatttttaaatggatgttacttcgcaactggggttatttgattacccagaaatatagcgcatattaaaaaggtaggataaatgcttagttaactaattaagcaatttttaattaccagttttcacagtaaggcactaaagtttctgacttgagcaaagataaagtggaaagataaagtggtcgtttagtgagatgggcaagactgtggataggtagactaggtttggtgggaaagtcagaatatcagttttgaatatgttaagtttgagatgtctattagaaacatatgttgacgaggccaggtgcaatggctcatgcctgtaatctcagtactttaggaggctgaggtgggcggatcacctgaagtcaggagttcaagacgagcctggccaacatgtgaaaccctgtgtttactaaaaatacaaaaattagctgggcttggtggcatgcacctgtaatcccagtaatcccagctacttgggaggctgaggcgggagaatcacttgaacccagggggcggaggttggagtgagccaagatcccgccagccactgcacttcagcctgggtgacagagcgagactccatctcaaaaaaaaaaaacatatatatatatatatatatgttgacaatatttcagttgaataaaataaaatattctagctattttaggtagaaaggcattttataccgatactactactaaagggtaagaagatatgactgtagtacattaaatatgctgatggcctacaactgttgctgtgttgctttttcctcttcaccacacatatgcagcctcatgaaacattttccatgaccagcacactgaaggaaataaaaggaacctagtttagagatggttctgcatgatacaacaaaaatgagctgctaaagcattacaatcccactcaagagtattcccccatcaaatagtggggctggtattttaatcagttgatactaattgtcaaggtgtgatggccaagggattgatgtttatcagtgtatggacagtggttcagagtttggtgaattagtcgagttgaaagagaaagattggtgacaaagatgtatgaggtggaaagtatactttcacagaataagaacagaaaatgagatttatgtttttttgtaaacgttcaacaaagaaaattcattcagaggaggaaataggtaggcaagatgccctattctacagatgttagtcagcatcactgcaaagcaacctcagggcttatgcagtggacacttaaaatagcactggtgcagggatgggagaaataaatggatttaataagcactgctgcttaccaaggttgattgaattgccactattgccaagtgttctacctgcaaacagatcaaccttgagccctggatatggcaccatgtcccagagcaaccagccagccacctggtggcaggttgattgcattggatttgctccattatggaaggtcagtggtttgtcactgctgcgatgaatgcttactgtacgtttggatttgcattccctgcccaccatgtttctgtcagcaataacatggccttattaaagccttattcaataatatgacatcctatataatattgcttttgatcaggagactcattcacatcaaaataagtgaggcaattggctgtcaactacaggattcactggtcttaccatgttcctgttgtagcatattgtattctacctggaagatgaaaccttgtgacattaaagtagtttttagttccataaacataatacaggggtctatgaatcaagaagtggaggtagaagtgttgtcttttacttcacatctaatcacatgttcaaaatattttttcatcttgcctctgcaactttgaactttgctgacacactgaggttttagtgtgaggaaacaatactttcacatgggaacatgatagtcgttcaattgaactggacatttagaataacctggccacattactgaactgtataactgaaacaacaaatgaaaaaaatgaagatgctacgctggcaaagatgattaattttgattattgggagaaatagtattgctactgttaggaggaagactatatgtctagaaactaggaggaaacctgggttgcctccttgtagcagggtaaaatgagtgagtaccttgtctaagaaagggaacatgaccaaactgaacccagaagacataggaaatctaaacagatcaattaacaccaaagaaacgggcattttttggtacttctaaaaaagtaccagactgatattttcacagagatgttcgttatacccttaaggaacaggaacagaaaacttctatactatttaaactattttagaggatagaaaaggaaagaaaactccagattttatttatagaacttgcatgaaattgataccaaattctgacaatgcaagttcaaaaaggaaaactagagatcagtgttacttatgtcaaacagctcttaatagaatagatggatatggttatcaacatgataaatatgtttatcacattttaaagcctacatggagaaacatttgaggttttcttattctagaactgacaggaatgtcctttattatgagcactattagtcaaatttttctggtggaactaatgtaagtagactgctgaagaaaatgaatggtatgaacattggaaaggggaaattaaatgattattatttacagataaaataattgttaagctggaaaatccaagtgaataaagggaaggcctacaattaagcagttaaggaaagggctaggtatagaaatcaatagttttgatatatgcaggctatagccagttaggagatcagttaggggaaaaacacgttgacagcagcaacgaaaagctgataaacctagaattgttcaccacttatcttaaaatgtttaacatggtactgagggacacaggagattatttatgtggaaaaacataccatgtttctatacagaaaaattgaacatcacaaaagtattatttgatcttaagataatttatatttaatgcaatctcagtgaaataccaggagaatgtttttaagctagacaaacttatttcaaagatcatatgtaaaaataagcaaaaatagatgtgaaaaattctttaaagtaatgagagaccagtcttattgactattaagtcattataaaactataatgtttaaaagatggtactgacatatgaatagatcagtggatctcagatgggcagtgcagaaagagatccaaacacatacaaaaatttagtacctctaaaggtggcatttaaaatctgtggggaaagatggattttccaatgaataatgttgggataggtagatagccatctggaaaaaatgaaagtcaaatcccaactttttaccttttatcaaaatgaacttcagatacaattgaaaatataaaattgagaccataaaagtattagaagaaaaatgcagtttttaagtctcaaaaggggactcttaaatatcatacaaagcccagaggccataaaagagatgattgataaattcaaatataggtccgtgtaagcgaaaactttcagtatggagaaaacataagttattaaggcaaatgacacactaggaaaagcatttgtaactcataacaagcctagttttcttactgtgtaaagtactgccataattgacaaagaaaatatgaagaattggcaagtgacatacatagaaagttcatggaaaaaataactcttaaacatttacaaaattttacaacctctcatgaaaagagaaatggaaattgaaattagagtcacatacagtatttcacttttcatttgtcaaagatcaaaaagtttgaacatactgtgggtttatgtttataaggatgtaagaaaacaggcaatctaaattccttgtagagtgtaaattggtagtaataagagaaaaatttactgaatactttgtgccaggtgcttttctaagcactttacatttaattatctcaattaacttatccagaaagtaccattatttctgtattacacgtgaggaatttgaagaaaagttagacaagtaattcaaagtcacacagttaataaatgacagagtgaagatttgagaccatttcctttttctcaagtgtccacttttggtcgcaactctgctgtttctgtagtgagtgatttaacactatatgataaaaccttaagagtacgtactctttgatccagtgattctacttccagaagtttgtccattttgcatcaaatagatggagaatagcattcattgcattgttatttgcagtaaaggaagattggaaacaacctgaacatttatcctcaaggactcatccatacaaaagaattgaagtaaattcatccagatgaatatgaggcagctttagatagagtgagatggcatcctatgtagtgatatggagtcatctttaaaatacagtaaaaggaaaaagcaagatacagaatagcatgtagggaagctgctgtctatgtgaaaagctgtagaatatacgtgcatttttgtatatgcatagaatattcctagacaaggacaaacatggtggttcatacctgtaatcctagcactttgggagactgaggcaggtgattcacttgactccaagttcaggatgagcctggccaacatggcaaaaccccatctctagaaaaaatataaaaattagctgggtctggtggtgtatgcctgtggtcccagctacttgggaggctgaggcaagaggattgcttgagcctgggaggcaaaggttgtagtgagccaagatcatgccactgcactccagcttgggtgacagagcaagacaccattcatctctctatctcttttctctctctctctttctctgtctacacacatacacatacccccccacacacatatatatacacacatatatgtgtgtgtgtatatatatgtgtgtatatatatacgtgtgtgtatatatatgcgtgtatatagatacatttctagaaggattctcaaagtgatatcagtgattgttgtgcaagaaggaaactagatatcagtgaatgcgctaaataaggtgattttgaattctgtagcatgtgtatgatttacctatagagaaagcagtctagcatgagcgtgggtttctcaaatatagaatgtttgcagtgaggtcacttggtgaaaagtatagccatgtcagacagatgtaggttcagattccaggacttccaggactgctgaaagggaaaggggctttggatctccttcagctccaggcagcattgctcctttcccagctttgacattagctggagggaagacaagttcttagagctctatgtgcttgggacaagaccccttccccctactgccttactcgccaaccataactgctgcaaacaattcttacctcttccaccccatgtcactgcctaaaacccttcatcacctggcctcccatgcctctaagtctctgtacatcccctagcctgatactgtccccaaccctcctcaactccagacaccattttactctaccctctggaattgtccattattagcaaaatctcctttattttcaacctcctttctaagtatttcccccacattcttgttgtaatagagacacagctttcccaggactgtatagctttccttgcagtcctctaaagtggtaactggtttctctgccatacatttcataccactggtcctggagatattgtcaatatcttaatgtcttccttccatctcacttaaattttgagaccataattcctttttcctctcttaaaagttctcagtgttgaagctcaatccattagatacctctagctggcactactagttgcagtcctgtgcagactactgagtcattttctttactccctgaagacttaaactctatcttactctcactctctctgacattactcctattaaaatgttatgtttctttagctattctttcagtttttggtctcctctccttcaacgaggatgatttctagaatgttggttctcaaaatgtggcccctttgcagacatcgtcagcacctgggaacctgttataaatatgaatctgcagaccacaccccagactactaagcccaaaattctgggggctggagcccagaatctatgttttaagaagcacgtcaggtaattctgatgaatatgccagttccttagatcttgttattgtcattactgacaactttctctgagaccacaatttgaatctaccaatttttcactagtactcacccatcttaagtccttactttccccttaccagccagacatttgaatattccttgactcttctctttcacatactatatccaaagagtcaacaaatgctgtcagctataccttcaaaatacatgtagaatctaacttttaacctccactgcagtcacttcagtccaagcacaaccatttcccacctggagtattgcaactgttcttgtttggtggcccttggccctactttatctactttccgcaaagcagccagagtgtttctttcaacacctaaggttatatggcttcattgattgaaattcaccgtgcttcacctctttctctacaaaagccaaagtccttgtaaatgcctgtaaggctcgagggtgatctgaccttccctggcctgtcgtgtttcggtaaaagtaagctgagtctttcatagttaaaggacagcaatattgtcctgcatgatattttaaaaacccaatcaagaatcacacattgcatttaattttcatgcctttagtctccattaaaagtgtgccctttgtattaataattggagtgatgagggacagagtttaagaatatataaatattttgtccccaactgactgtcactggatggctttggcacccattggtgattcttacctgaatcagtaattattgtgatgactgaaaatagtgatttttctcactgtataattcttctatatttattaattaccttaatattatcctatagaacagaatgttcccttctcatcttttgtttgtttagtgtcagtattactcatgaagttgggtgtttagaaaattcaatgttgtataatactgttattattcaatattgtattttctcagtttgagtcttccatctgcgtcctttcatgtaaatagtataaagatcagtaatagaggaacatagagtaaagtgtgagcagagaagccttactctgagacaaacttcagagaggtgaactctgttgctgattaagaaaggcttcactgaggaagtgttgtttgaagtgagctttgaaaagtcataaaattttgacaaaagtggggatggggtggagcttaaaggaaaaactgtctgaacaaaggaaggcccggcagactaggaatttggcaataatacagtggttttggaccttgatgaggaagttgaaatggaacataaaaaccctctgcatttagctccatttatttgctcaggcagctctcactgcctaaaattttcacccctgctgttttgctcaggggtgggatgaggggtaatgagggaggaaattttagggggtgaaaacagcacaagccaaaaaccctgctcagatactcccttctcttgaagccttttccagatccctaataagaattaaccaccctctctcacacactctgttgtactttgtccttctctgttaaccagcctctgtgttttgtgctgtctgtatttgtggatacatcttcctcctttaaagcacgaatcatatcttaatcccttggcccttcttcccagtacttagcacaagtgctcaatacatgtttctttaacgcgtgtaacagaggaaggcgaggagagtgagtgggattgggagcaggaggattctgaatgtcattttaaggggtttgggctcgctcttcaggcagcaatgagccatagccgcctttgaactgtgcagcactgaccagagctgtgatgccaaaggatgcagtggaaggggaggacagccagcatgcctgggcatggtccccaagtcagaggacatcagtgggagaagggagaaggcatggaagcaagtggctaccatcttatgaatctgagcactcattcaaaggtggcaaggaaaaaggaaggcattgagcacggttttgaggtttccagcctgggtgattggaggctgatgcaggcttcttaccaaaaagggccctaggcagtttcaccaggaatgtttaaggagtttatcatgaccctatctcttcctcgtctaaaactctccctaaaatcaaaacagtatgtcctgttgaaatactttattgtatcaaatataatgagaagtaaaatattctctctacttgatgtatgaaacactgacttcttgtagtggacaattttcacttgtctttttagtaatggtttttattaaaaatagatgttaataactgcttgtttaatctttaaacgtggccctctgagagcagcttaccgtaaaagaaacggttgtcagctttctttttgctcctcagtccctcctgccccttcctaacaacagaaaatttgctttgcacctgctccaactgggttcgaagagataagcatcttgcaagcccagaaaattgtagtatcaaatctcagccccaactgtgaggcagcactatcattgaatccctgctgagaggcgttgctttcccaattcccaaaagagttctttctcccctggccccttttcaggcttgaactctgaccgaaaccctctttttaactcccagcatgcactgcacttggtactgacactgacccatccctgcttcctctgttctgcactggactcatcagtaggtcaggcgttggtagccctggggtcactggggtgcccaattccaataatgagcacatttagctaaggagaggaaatgtacccttctatttgttacagtccattgctttttttccagaaacaaatgctaaaagaacatttgatatattgtggtttggtaaatacacatagcactgcctaatattcacaaagttgcctcttttttttgcatcttccttcataaattaaatatattgttctaactcatgatttattttaagagggatatacctatttcacagctaggaaaatgttttcaaataaagttatattcagaatactcttgcaagaatttcaaataaaaatagcaaatactatttaaatgcatataacattctaacagacttgtgtgtcattttaaagggaaagaaaaaaaatgatgacaaggactttacaactttgtctttaaaatttcttcttaggctttccaaacagaccgaagtcattaaaaatactccttaacccccaaagtcacaaaaaagaagctacccaggtttattatgagaaggttgaacctctgttgaagcttgcaggaataaaaactgatgtaacaagtaagtaattttcagaatataatttcaccatctacaaaaacatacaaaagcaaaataatctgaatttgtccttaatgcaaacttgggaaactacttgtaatatctatagcatttttacgtcttcataacctactgcagccagctcgagggttataatttaattatttttgttatttttattagaatattaatattttctctttagaattttttcagatattttttcagacttaaacaattgttagatataattacaaaggaagctgtatacttgtttacatcttcatggagatgtttgctacttacacgttaattttgcagttaggcaagaaattgattttttgctcacttatatagttgatgtctttccatggaattcttccttgggttgttttcgttctgactctgacccctggtggttaggtcaaaactaagcactgaactgctggttttattaatagatgaatttagagatgctagaagcttaaatttgttgtctaaactaagaaatgtacttaggtttgtgccaaggaaaatagaaacttgttaatgctaaacttaatagatgattagtaatatcctttttgatttttttaatttggtagtcacatttctttgtttctttgagacttattttcgtatggtggggaactgagtagaagagtcgatgctatggagaatcgcaaccttcctagctttatttctatgtggcttcgctaacagtggaaatttgcaataaattttaattgatgaaaagtattataaaataagcctactcaggggacaagcccagagtgcaattggaacttcctagtcccagttatagattcctagggaagggattcacagtgatgtggctttactcagctgtaaacaaaggagataagtttcaagatgttaataatatcattgaaacctacacctagtgatctgatggattgaggtagaagaaagttcaaaaaaaaaaaaaaagcaagttttgtaggaaggtcagcccccatgaaatgtgcctataactatagaggttcgagagaaactaccatgaaaaactcaagaggaatttttgaattaaaataaagttatagtgaagaagttaacctttatgtttgtgaccttcggcttatttagaggtgatttacaagtaaaagagaaaattcagatttatgttttctttctactgaagatttccaaagattggctgaaggaaaagtttgagatttgtattagggtgagacaattaaaagttgaataaacatattggcatactcaatgactattttgttcattgcttttacatgtgaatactacaaagcagcttaacatggatattgctatatagcattcacttcaggaatctcattgtatgcttgctctgtgttcaacatagtgcaggatgcgagatgaataagctatcatacttggatgactttctacattattagagattcaaaaaaatgcttaaaaccattataactggggtatacataaaagaactttgatgtctcagaggtgatattttgatcggaagattcaagaaaagcatttgaactaggcagtttttaagaggcagacaaaaaatgagggaaggaagtcaggctaacaggcatgtactgtaaaagttgggagggggggcggagagagagagtgtgtgtatgtgagagagtccatgtgtgttacacccatacatctggagagtttgtgccataactttgctctactttcctcagtttttacattatctgaaatcttactctatcatcataaaatagctgccagtgaatttcatcctttcttattaatatccagtgggatggggagaggtgtgcatatgtgtgcaagagagacccaacatgctttaatcctgaagatgaattaaaatttccttttttaagtttgggcacagatactgtattagcgcagtcaatctggaataatcatttatttaaccatcaagactcttcccaggggctgaggacagatccccttttcctgatgactgaaatgcctcagctgaatctggattctgttagggagaagaaagggcaaaatgacttctaggaaggctctcaacaatgtatactacaggaggtataattccaggttatggatggatccttaagctgcactcagcagtttactcatcgtgtattgatccacagttggtgtaaatttttttttatcatactgttgcaatctggtttggcaaagatgactccaccagcagaattaaaattaaaaaggaagagagaaaaagagattggagacaagaaaactgatatacaaggcctgaactaaggcagaggaaatcatctaaatgtgctttccttcttaattgtattggagacaaaactattatgttctaggatttttttctctaaatttgtaaatattactaagtaccatatttaaacataaaacaatagaatattccgtaaagcaaatttagaatttacttacatttgtgcagaatggctaattattagctgcctaacactcctcctacaggcaaatttataaaattacatcatttgcttataaaaccattttagtatgcatattggctcaatatttatgaaaaatatttcttgaataaacctgtgaatatttgaaaagttttagtcttcctgcctatcttacagtgttatttttgtagttgaaataatatatttgaaactttgtatattatactacagaaaggtggtcataatactgttagtttcagtttcaaaaattatgtcatagtaagatcgaattcgtactttatttgaaagtatatggaagagtaaagcagaaagaggacatatcttctgcatgtccagtgggacattgttttaatgtatccttgtgtgaatgggtgagtccaaatggaattggaattacaaaataaaccctatatgatgagttaattaggaaatagtgctatataaatatgaagtataatatgaagaattacagctagatatatacactataaggtactgtaattttttcataaatttattttaaaaatggatcttaccacattaataaaaacacacttctttcattttgggttgtgctgaaatcctaactacttctgaatatagatcagcatcttttgaaatatttgtgctaaagttgcatccccactctgctaccaccaccaaggtagtatcttatctaatagcatcagaaaaacttccgggagaacctggaaagaattattttttcctaattacctattcgtacacaaatcaaagaagagtatgaacgataagcccatgctggcatatgatatcatttctcttgcttctgaaacaaagcaagttttagagattgtaccattaaaggtgtgacagatattttgaggatcagagatccataggataattcatagtacaatagagtgaaaaagttaaggcagcagagaaatcagactgaaaagaactttcgaggccatatggttcaatttttctccttgtgggtggagcacaggtgtgtggcactcaactttggcttggccacctacactagaggcagagtacgttgttactggacaatactgtttgacattcttatgaatgttcagagttactgtacctttgggcagattagaaaaggcacctcctctgtgctgacttacaaaaaggtgccctttcttccagactaattcatcctttgcttataaaaccatttcagtatgcatattggctcaatatttatgaaaaaaatatttcatactttcaaaatattcatatttcaaaaatattcagcccaaggtcactagattcagcctaaagtcatttgttagattgcaaatccgtcattcccgttagccaagtacctttgtgctaggcataaactgtacaaaatgagaacttgtcagctgacattcgcctctttgtaatttttatgtactagagttaatgttatctcttgtagtaatatgaaataaatgtgccccatctattgtataggagtcattgagatatttgaagagagatatcctgtctgcccctcatctcttgttcacgataggtacttccatcgccttcagttactttttgcattaacagagctgctagaccttatcatggtcattatcattatcatactcaaagacatttatctgaaggaaaccttgatctctgccagctcagggctcttgggagtgcctagtcaccagataattttacctcctgggcagagttgtcaagaaagtggtgtttgttatcattttccccttctttctcctaaaatcacgcttctaacatggctgttaacaagcctcttcatagtgtttctctggttgtttatggctctacttgaagccttccatttcttggaaatgcctcttgcctttctaaatctcacccagcagaaagctaggccatctaatgaaactgtgtcacaaaagattccagtagcctgaggcatcactccttccaattttacctgcattttaatacaaaatctgaaaagtaaatgttcatgcatcatatctagctagagagaaagataattctgtgtaaaagattctttttgttacctcttaaataattgtgggtgtatatggccagtcctgttcccagcattcagatgtgagttaggaagttggaactttatacctggggacgatgaagactcactaatggggtatatacaaaaaagtgatatgattaaatatgtatctgaaaatggttattctggctagagtgggggagaggtttgagggagacaagataaaaggctattgtagtacaggtggagtatcccttatctgaaaggcttgggaccagaactgttacagatttaggatgtttttagcttttggaatatttgcattatacttaaccacttcagcatctctctaatttgaaaatcatggacacaggaaggggaatatcacactctggggacagttgtggggtggtgggaggggggagggatagcatcgggagatatacctaatgctagatgacgagttagtgggtgcagcgcaccagcatggcacatgtatacatatgtaactaacctgcacaatgtgcacatgtaccctaaaacttaaaagtataataaaaaaaaattaaaaaaaaaaaaaaagaaaatactccaatgagcatttactttgaacgccatgtcattgctccaaaatttttagatgttgaagcgttttggattttagatattctggttacagatacttaacttgtctacacatgaaagatatttagtgatcagatcaatcagctaatttagggaattagctgggagaaatggaggaatgctatggcataatttaaagacagaaacaactggccttggccatggagtggttctggagagtggaggaaagggacactctagaaagaagtcattttcctgtcttggggtagatgatggaacacaaaaagaacaatatatttgagagagaatatatttgaaggtatacataatggattctgttttgagcttactaactttaaagtacctacaggacaggaaagaaaatgacatttcagtatcatatcccacactagaattttatcaccaaaccaagaaatgtttccttatgtccaaatcaaatctcacctgattttatttcaggtgattttctcatcaacattgaatatcaaccttaagactttcttgtcttcctgaggaagttgcatttgcaccaaagaggggagggggaaattcccagcagtgagaattgtgttcaaagacctgtaaactgtgaaggcttcacatctcctatttagaaagagcacaggttggcaatctcataggaaaaggcaaatagatgaaagaagaggctgggttacattttttgaaattacatttatctagcaatcctttctttgtttgtttgtagggggatgatttgaatctggctgtcactgattccagggcccacaatagcctgtctaaatacatatttggtcctttctactatatttaaatagtaatccagatcactctttatccttttgcctaacattgttttgtataaccacctattacttcatattataattcattatttcattagcatatattgtctatctccagaatgcaaattcctgaggccaaagactaattcattttgttcattttgctaatatattttatagatgtagatagtcaggttcttttcattttgtttctttgttctagatctttgattttattggacttttgcaatgttacttaaaaaattgctattttcaggcaggttgcattagtgtataatcaaattccacccacaatatcaaaaaaagactattacaaattaaaaaaataaaaatagcattcaataataacacagttctaaagctcattattggatctgaaaaactttaccaatgtaagctttggtataaaagtaaggcttggtgaactgattcttagcataaatattttttcatgatattcttatttttaatgtgtatatgtaagatgttttattttgcattttaaggttgtaagtacttgctgtagttataaatgaatgatcagcacacatcttctttgataacctttcaactttattaatattaatgtttcatatgtagttttattatggctttcttctgattggaatttaatatagagaggttttattcatgtgagtgttaatggcattttgaataagctatgggagaattacaatgtaacactgctggatacagaatgattcttttagacaccaagactaataatttttaacaatatcgaaaaacattgtaggaaaagcttgaaccatgctggcaccagggacagacaagcatgaaagattaatgtaatcttgcatataatgacacacattcttacacaaaaaatccatctgcaatgtcatgtcagtcagcagaaatctttgatgggtggatacagctgggctgtctcttctggcagagctgccctggaaaatgctaaatgtggttgtgatgcttggtgccatctgcagtgtgcccgtttatcctgtcttcactggcatttacgatactgcatagggcatcagtgactgtggagacagcgatacagagtgacagattcatttcctcggagggtctgagctctggtgggcctgtgtgccaccctccttcttgggtctgggtctcttataattggtgttggctttactttgtattttcacatccaactcttcctctttttagtctaacagttccagtacacattcttctggtttgtaaatcttacactaaccttttgactaatttattcatgtaaggttgccaaaccgatttaagattgactgttcaatgccagctaatatgccttatttccaaaatactgctcctcctaagcctctgatttaaaggacatgtgtcttatttagggaatactaaacaggcaccaggacaaattgggtaaccactatgcgtgggatattcccaaatgactttatgtagttgaaacaaatatatgaccttctcttacataaagctataaaacatcaggccagtaacacttagtcctcttgcccatgattaaaatataaatattcaagaataaatgctgttttatgacttgaccatatgtttatcatattattttgccagaacaagttaaaaagtgtgatcattgtttaaaactgtcactttgtgtatgtgtgtgtgtttttttaatagtaatggaatatgaagggcacgctctgtcactgcttaaggaatgtgaactccagggatttgatgggtaggttatattattaatcaatatatgttatatcatttatgtattaaatgccttcactagttttagctacatatttggaacctaacatttaaaaatatttgtagtgtatgtactttggctctatcttgttcatatctatgtaataataattaatgataatatgacatggtcatctatctctcaggatctggcataggaaagcaaaaagaggaatctaattattaaaatactgggaaatgacagtgtactactctatacttactaatgtgcatacatttgcatctataattatttgcttttaccatatatctagagaagcactaatggaagatgttatactggtcacatggcataactatatgatgatcttcttttgcaaattaattgataggtttaatagctacccattggttaacttgtctgtgatagattgagggaagatattttataaatacaagtaaataaatacattatttccagaaacaataagaaataattttaattatctcataatgtagtgactacaatttaggtatgttattcacagtgggcatcggaaaccattgttcgcaatacattggagtgtacagagattgttcactggcatgcaaacgttagaaccaaggcaagtgatataaatttcattgccattttttaaaattaggtgaaccaatttgctaaagtgttggactgatgtgtaagactaaaacatattatattcctttagggaagttctttttacgtgagtagatatttgagaatttaaaaagttgacaagtgtgtgaattatttgtgttacatggtgatgggcagggggcaaagacccataaggtcaggaaagggagttaggtctgtactttcaccaaagtgaaaggcattaaccttcccaaagactgatttgaatgtgctggggagggaagtgatgcaatcaaaatggagtattggcagggctgtttttcagaaatgcttatttatttatttattttttggatgaggagaaaacaatagctgttgagaaagaaaatgtggtaagtaaaacatgatttttccaaaaggaatctaattgagggaagtaaatctagatagcaatattatataaacattgggaatcaaaaatatggggtaggagattacttcagaactttatacttagaggtagacaaaaacattaataggcttcatttagaaaattgtcttacaagtatacaatttaagaaaagtccttgtgggaatcatgcataccaactacctatttgaatatgctgcatagtccctcactagacctcatgagtacatgaaggtagctgcattgcaaatgagtacctgcttcaaaacttgattaaagaatgagaataaagatatcacagatattaaacttgttcttacacagcagcattacagaatgttctgctgaatgcagtatctatcaatatgttttactggtatttgtactgggtaaagggatgaaaagaactttgcagaatgaagaaagacgattgctgaagtgtagtacaataatatttttctctttacctgaacatatttaatccttatttatttttcatggcaggtgttgttatttttcagtgtagagctaaaagatgtatagatttttcagttattatattttataaaccaaatagtttggcctaaccattatatgaattgagttatgtaagtgtttctaaactctatggcatgctgatttatttcagacttacaataatttcaaatttctactgaaagtcatcttccgtgttctaagactctttaaatcaggggtccccaactccgagactgcagatgaatatcagtcagtggccttttaggaactgggaggcacagtaggaggtgagtggcaggagagggatcatttccgcctgagctccacctcctgtcaggtcagcagcagcattagattctcacaggagtgcgaaccctattgtgaactgggcacgcgagggatataactggtcatgcgagggatctaggttgcgtgctcttgatgagaatctaatgcttgatgatctgaggtggaacagtttcatcctgaaaccatccgtctcccaccccaccctgcagtccatggaaaaattatcttcccacaaaaaagtccttggtaccaaaaaggttggggaccactttaaatagcttatttatttttgtggggtcagttttcccagtagaagctgatatggtagttggagtaattatcttaataaactggcaattttaagtcactgtacttagaattacatagagagatatatgaggagaataatagaaacatagtttcttcaggtacttcaaaggaacaattctcttgcaagtaaaattgtttgaaaatggaatattctacattggtgagttttctattcctgaacctgttctaaagagtggctaaaggaaaattttgggggaaatttatagaaaaggtgcagagatgagagaaggttaaccccaaaatgctatggcattttgatgagagacagactcaaatttctttaagaactttggcctgaagcacctccgtctgacactagtggaactattaatagggagtgattaggaaatcacctaacagtttggtttctagatacaggctgaagaagttaagagccaagaaagattctatgtatagtatttagtaaagcaaaacaatttggtaagtaatgtttaagaaatgctatttcctaagattttggagttgtatttattttttttaatgaattacatatgtttctatgagacatcttgtgacatttctaaacccaacagaaacagtgtatcagcacttatgacagctagttctccactgcagtgtgtcctaggaaacactctaagatccactgttaaaccttatgagagcttcagattctatattgctccctattttactgggcatgagtaggaagttttaggaaggaaaataaaagaatatcagctgcatagacttgaagcagtaacacttgcatttataagtgtgagtatagttttaaaaatctatagattttatgcaattgtaaatatatgaattcctcgctattaatatttgtttcagaatttttaaaaaaattgttgagttacttttcttttgttcatttcaccattaattagacccataatgttgtagacattatttggattatattgacattttatcagattgaacatatctgtattacttagtaaggtaaaaagcaaaaacaaaaacaaacttttccagaaagaaaaaaaactgtgaatcaaaactacaacaatatattgaacatttcatagatgatgggttcatagataagtataaaaacattcattaaaaaaatctttatcactctttgaaaaaggatatattatcacccagtgtttcttttctagacagaataattctgtttggagccatggcaaggagtttacttattttaaaaacaagatttgtcacatgcaaaggattagttactctaaggtttatgttttagagtgacacaagtgtgattaactcactataaatgattgaatactttgctttttgcctttcttgtatatttagactcttgtgatatttttgtaagaagctgttgatgaaaaaaaccaaactgtaaaatatttaaagaggtttattttgagccaaatatgagtgctcatggcctatgataaccccaggggggtcctgagaacatgtgcccacagtagttgggttacaacttggttttatacattttggggatacagaagttatagccaaagacataaatcgataaatgtagggtattcattggtttggcccagagaggcgggatatcatggagctggtgggaaggggagctcacagatgaattcaatgattttctgattgtcagttggttgataagctttgctgaaagattagaagtcagcagaaagaaatgcttgagttaagataaatggggtggtgtaggctgggtgcagtggcttagcagtggctcacacctgtaatcccagctctttagaaggctgaagaggggagatcacctgaggtcaggagtttgagatcagcctggccaacatggcaaaaccccatctctagtaaaaatgcaaaaattagccgggtgtgatggtgtgtgcctgtagtctcagctacttgggaggctgaagcaggagaatcacttgaacccaggagggagaggttgcagtgagctgagatcacaccattgttctccagcctgggcaacagagcgagactctgtctcaaaaataaaataaaataaaataaaaaattataaaaataaagataaatgaagttgtggaagcacaggttcttgttatgtagatgaagcctccagatatcaggcttcagagagaatagatggtcaatatctcttatcagaccttaaaaggtatcaaactcttagttaaatctctcctggatcaggaaaagacctggaaagggaaggagattctctatagaatgcaaatttctcctgcaaatgatagctttgcagggccatttcaaaatatgtcaacaaaatacattttgggataaaatactttgatttcctctagggcctgctatttgttatttaatgctataccagagtcaggttggagttggggatcttattgctaccaagtctgttttgtcagtcttatgatctattttttttttttttttgagataaattctcaccctgtcacccaggctggagtgcagtggtgcaatctcagctcagtgcaacctctgtctcccaggttcaagcaattctcctgccccagcctcctgagtagctgggattacaggcatgcaccaccatgctcagctaattttttgtttctttaatagagatggggtttcaccatgttggccaggatgatcttgaactcctgacctcgtgatccacccttggcctcccaaagtgctggaattgcatgcatgagcctggccaatgatttacatcttaatgccagtgctggccatttgcgcctaaactccaaaagacaagagggtataaggaggcatatccaacctcccttcctgttatgacctgaatagtttttcagattttctttgtgaccttcatggccaaaaggggaggatccattcagttagttggcgacttagaattttatttttgttttacaaaacttatttcctaggttgagtcactttacctgaacatgatcttaatgattgaatagttgttaacataaataaatacatattttttctaactcacttaatttcacactggttctactggtaaactgtttttcaaaataataagattctcataaggctatttttattaggtttcatatatagaaaaggtatctaatatattgaataatattgtagcttctaagaccaaaatgtcttatttcaaatccctgttctattacttactagtggtacaatcttgaaaaagttactttatctttctatgttttagtttcctaatctgcaaattgaaggtaatattacctattgcatacagttatttctccacttaaatgagttaatacatggagagtgcttaggaaaatgtctgatatatatatatagtaattattcactaaatatttctttattgttataattgtcatttgtattagtttcaaaagatttaacacagaatgtattatgacaaaatttcagatgtttcagaacatgctcatagggaggccacctctaataactctagcaatatgttaacatatgcatgacgctataattgtatgcaacattctaggagttaagtgttcgcatcctatgtatgtaagggtcaagttatttggtgctaaattagatttttttgggtatgactccacatagtctttttggtcacacccatatgtcagcatttagacagccatggattgagggttacgtttaagttcacagattagaaatctcatagagatttttgaaatcaggtaagtttcaagtcaaaccttggtttttttcattcataaagatgggactgtggcctattttgcagacttctgaggatttaatagaaattagtaaacacattacctgatatatagtttgtccttagtaaacatcattccttttctctgaataggtggtcatattgcgaacctctggaatcagtttagacataagaataaaacacacctaatcaaacatgacctgggtcatatcttgagtcttctaaccagagtagccttggattgcccaggctatgtggagctagtgggatgaggaagatggggactagagggaatagatggccgagagaaagatggtgggaactgactggaaagacactttcagcctttggtcaccaccctccagagcttcctaaacttagagaaccagtaactactgctgactgtggcccatagacagttttgtttgaaatagtgtttttaaatatattgaatgctagttgcttagtatttacaaattaggagactcagccttaaatcagaatctctggcttctgtagaaaaaccagatctgggtccattaggcctcacacgtgatgtgagtgggccacagcaaagaagtggctgcgcctttagattgagcctactcttccattcctgctgggcccttgtagcccttgagttgtgacacctgctttcactgaggcaaaatccactttccattgggttaactggtgacattttgatacgtaagaatattttgcttcttttgaacataaatgattatgaaatgaatttctggtacttctgtgttattttaatggattctgcccccatagtctacttgatataaagtcttaaaaaatatactagtagtactatctaggatcaaaggctaatagtattacatctagaagcaccgtatagcaataatgtcaaggagatgaaattcaggtcaggtttgtaattactacattcatatagtaatgataattagcagtttcttaaagcttcatattttatatgatttttattgctatctgtcttttcagagctttattgagaattagcaggattttatgactttggttggtgttagttaaatgaattgcagatgacagtattattaacaagaaatgagaatgatatgcttttggatgttaacagagcaaaacgctggtcagatgtgaattaacatgttcaaaagttttcatatctcttaacacacttaaagctattttgtctatggggaattatctagttattatatttgtgaagtaaacttacctgtgttgtgtttgtgttgtcttacccattgacacatattaacatgtttaaaggtacatgtgagcagttatgcacatagactacaaattagtaaactattttgaagtctagatttcatgacttattaccaatcattctgaagttttgccttctttgcttgatttgtatttttctagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggcaagggagtggctacagattcattaaactgacccttctccctcttttcctttcttacttgctaatctagacagcacaacacagaattaatgaacagactttgaaagatccagacttctggcatccccactagcaaatgtgagacttttgacaagtcatttaatctctttgagccttatttttctaatctatagaatagggatcacagatatattattcactttattacaaggttattgtagtactaacgtttggtttagtaaagggtttaatatatagttaaaccatcagtatatggaatggttattattctcccttcgcataaaaaatctgttgattacacagtaccaggtaagaagtttcaaaacagggccactccagtctagctgcttacaattccatatgaggtgaatatggtaacttgcataattgatgtataaccagataaccttgagaatgccaaaattacttgtgactggaagggaggataaggtttggaagggtgagattcttaagggcaaggctttttaatctttctactcactgccatttttcagcatctagaatagactatgccacagtgatgctcagtgaagcctattaagtgaatgcatgtaaagaagactttatatagtaaatgacacttggattaggtcttaaaatgggttggagctggcctgaaaaggtgagaatgagttattttcttggctgcaaaagtaataaagcaaaggcaaaacccaggagtgtttgaggaatagtgaaaaggccattcagtggaagataatggtatcaaaataggcccaaccatggaggctcctacatgccacagtaaggtctctgaattgtatttgataagcagtagggaataatgggatgtttcagagcaagggggcaacctgattggagcttgttccaggaggattcattttgcctcaccgtgtggaatgattagaggttgggagcaggagaaagtagaggtcagagacacggagaaccgttagagcaacactgtgatccagaaaagagggaaacatcattcaaaagctgattgtattacacaatcactcatccctatttaacgaacggtgctgggaaaactggctagccatatgcagaaagctgaaacaggatcccttccttacaccttacacaaaaattaattcaagatggattaaagacttaaacattagacttaaaaccataaaaaccctagaagaaaacctaggcaataccattcaggacataggcatgggcaaggacttcgtgtctaaaacaccaaaagcaatggcaacaaaagccaaaattgacaaatgggatctaattaaactcaagagcttctgcacagcaaaagaaactaccatcagagtgaacaggcaacctacagaaagggagaaaatttttgcaatctactcatctaacaaagggctaatatcctgaatctacaaagaactcaaaagaatttacaagaaaaaaacaaccccatcaacaagtgggcgaaggatatgaacagacacttctcaaaagaagacatttatgcagccaaaagacacatgaaaaaatgctcatcatcactggccatcagagaaatgcaaatcaaaaccacaatgagatatcatctcaccccaggtagaatggtgatcattaaaaagtcaggaaacaacaggtgctggagaggatgtggagaaataggaacacttttacactattggtgggactgtaaactagttcaaccattgtggaagacagtgtggcaattcctcagggatctagaactagaaataccatttgatccagccatcccattactgggtatatacccaaaggaatataaatcatactgctataaaggcacatacacacatatgtttattgtggcactactcacaatagcaaagacttggaaccaacctaaatgtccaacaatgatagactggattaagaaaatgtggcatatatacaccatggaatactatgcagccataaaaaatgatgagttcatatcctttgtagggacatggatgaagctggaaaccatcattctcagcaaaccatcacaaggacaaaaaacgaaacaccgcatgttctcactcataggtgggaaatgaacaatgagaacacttggacacaggaaggggaacatcacacactggggcctgttgtggggtgggggaaggtggggagggataacattaggagaaatacctaatgtaaatgacgagttaatgggtgcagcacaccaacatggcacatgtatacatatgtaacaaacctgcacattgtgcacatgtaccctagaatttaaagtattatatatatatataatatacagccttatgaacatatatatatataaaggaaaattaggcaaaatagcattacttgaggtactcaatagcctggcagagcagacattaagggtaagagagactggacttgaatttcagtttggtacttgactttgggtgggtaattagcctttattagtcttgattacacatttaaaaggtttaataaggccgggtgcagtggcttatacctgtaatcccagcactttgggaggccgaggtagtggatcacctgaggtcaggagttgaagaccagcctggccaacatggtgaaaccctatctctactaaaaatacaaaaatgagctgggcatggtggtgtgcgcctgtgatcccagctactggggaagctggggcagaagaataacttgaacctgggaggcagaggttgcagtgagctgagattgtgccactgtactccagcctgggcgacagagcgaggctgtctcaaaaaaaaaaaaaaaaaaaagtttaataatgtccatccccatagggccattacaagaatcaacttttaaaaagtcacacattatcactaaaaaagcaaaatatttttccctatgattatagaaaataatgcacattgttgaaaaaaattcatattttgataaccctattcatttagtatggattttagaatacttagtattgttgataagttgacagagcataagatattcaaatgcccttttagagtgtaaagtctttcagaaagtcagaatttaaaaggagagagatattcagatataatctgataattctagagtatataggaaaacctaaaatggtttctaagtagaagacaccaagatgattttgactcaaagagaaaaatgatgcattttgggccatcttttcatggcattttatttcttgacctttttgctttactttagtagttctgactataatggtggaaactttccaacatttccttccatgcaaagtggatgtgcttaggacacttcattagtacttaaattcctgaggtcattcattgactgccatacatcagaaatagaaagatgggtgtccctacaggtatgcctttgacataaatttggtggttggctataaaaactggtggttattcttatgttttagtatgtaattcagattttataaagaaatagcatttagttttatcactattataattttgaagagtatttctgatttggggagcattttatgtattctttggatatttgtagtaatgccattttaacctgtcttgtttagaagacacagtatgctgccaaaattctggtcattgcataggagttctagcattctaattccatctaataggaggggaaagtcatgtgtggggtatatttaatatgatgactgtatgcctagtcagggcttttgatagagaatgggaactagaactaggcaggaagttttcaagctgaacatgaggagacagtgtgcctttgaagccatttgcctcctggagagagacacccagagggagagtgtttagtaaattaatccactgagccaacagactaagctgctgaattatggtcagactcaaatggatcagatgtggagaagcctgtatttgaactgctggccattaggaatggtgtttgttgctatgggaactggtgctaaggaactatactgagagactctgattaaaagggggagggggaatggagaaaaaagcctgagaggacataaaaataaaaaagcaatccagttgttgtaaaacaaggctcaagccacatactgatggctgtgaaccatatattcctatagagtttgcataaataaattcatgctttccaattaatttgaggagaataaaatattgccgagggactgttaatttctatgatatttcaggcaaagaaccaaagtgtaggtgccgttttcatgagaattttagatatgcttgactaggaagtcattacatcacatttatctgtttggatgtgggagacattaacagccttatgaatattcatggtatctggttaattaagttaattgttctgcagaagtgcttgcacttccaaggacattttttttttttttttttttttgcctccatagtttctccctggtatttcatcagtaattctttacatgaactgctacttctgtccttacttttttgtatttggaacattttagcagctctcaggaggaagtggtaggcaaagtttctggtagtgttaagaaaaataactttcaggctaattaaaatgtttaccttgaggtagaacatttatagcttttgtgagaacattaaaattacgccattgttatttatgtgagcagcatgttcttttggcatgtagacatcttttcaaatagagtacagtttcctgaaacaaaatgtaatccatctttcagattatcccaacaaaatatagaacaagctatcgttttgcaattttacatatactttctcataaactttccttttttcttcagagtgtcaaaaaccacatttaaagactaagatacagattaatgagtagtcaatgactaaaataattttctgacttctagtcatgtctgttatcactgccaacttctacagaattagagaaaagttgcaaagcctgagaagacataaacaatttttaaagccatctctagcattctaaaaaaattttgtacttgggcatacccaccgtacttcaaactcacagggaataaatggtctttattttcttaagtcatgatatgtgtcattctctattgcacatgacattacattatgttttttaatagcctttctagaggaatgcttttacggtctactcataattaaccatggtaatggaggaaatgtgtttcatggagtactgtaatccatcgataatcctaaatatctgactctaattatgtggcctcctccaaaatctttaccacaaatctgattgggaagcacaatggattgacttgtttcttccttttctcctgatccattccagatttattagcaattagatggtcaaagggcaggctgtagagggccacaagatcattggaaagaccttgataaagatccactgagtaacaggtttctacactacttgttctcaaaacttagggtccatagactcaccttgtgaacttgctaaaacagagatacctgggtcctccctcctccaaacacattctgagtccatgagttggaggtagaacccaggaatgtacgtttttaacaagctcccaggtaatgatgctgcttggaccatgcattccagaggagtttctcaccaagtcactgtgcatacaaaccacctggggatctaataaattgcagactctgaatcagtgtgtctggaatggggcctgagaggcaacattttaaaaataatatattttttacttccattaatactgctattactgttttaatacctattatccttatttttaaatggacaaaaattgtatgtatttattgtgtacaatgtgatgttttgaaacatgtatacattgtgaaatggctaaataaagataaacatgcataaaattgacataatgatcacatactgattttacattgagaacacttaaaatctcccttagaaatttccaagtatataatgcattgttactaactattgttttagcctgttctcatgctgcaataaggaaatacccaagactgggtaatttataaaggaaagaggtttaattgacttgcagttcagcatggctggggaggcctcaggaaacttacaaccatggtggaaggcaaaggagaagcaaggcacattcttcacaaggtggcaggaaggagaaatgctgagtgaagtggggaagagtcccttataaaaccatcagatctcatgagaactcactcactatcacaagaacagcatgggggaaaccacccccgtgattcaattactcctacctggtctctcccttgacatgtggggattatggggattaaaattcaagatgagatttcggtagggacacaaagcctaaccgtatcaactgtagtcactaggttgtataacagatctcttgaatttattccttttacctgaaattttatatcctggaccagtatctccccagtccttcccacccattagccccagtaaccactattttactcttcgcttttatgagtttaagtttttcagattctacataaaagtaagtatttgcctttctgtgcctgtcttatttcacctagcataatgtcctccaggtttatccacgtgttgtaaatgacaggacctctttaatgccaaatagtattccattgtgtatataaacaggctgattgtccctaatctgaagacttaaaatccaaaatgctacaaaattagaaatgtttgagtgccagcatgatgccacaactggaaaattccacacctcatgtgacaggtagcagtcaaagtgcagtcaaacctttgtttcatatagaaaaatattttaaatattatataaaattatcttcaggctatgtgtataagatgtataaaacttttatgtttagacttgggtcccaccccccagatatctcattacaccaacagtgtaaaagtattcccatttctccacagccttaccagcatctattgtttattgactttttaataatcgccattctgactggtgtgagtgtggttttgatttgcatttctctgatgatcagtgatatttagctttttttttatatgtttgttggccacataaatgtcttcttttgagaagtgtctgttcgtatcctttgcccactttttgatggaatttttttttcttataaatatgtttaagttccttgtagattctggatgttagacctttgtcagatgggtacattgcaaaaattttctcccattctgtaggttgcctgttcactctgatgatggtttattttgctgtgcagggattgttttcttgatttctttttcagatagttgtaagtgtacagaaatgctactgatttttgtgtgttgattttgtgtcctgcaacttaactgagtttgtttattagctctgacaattcattcatggagcctttagggtttcctaaataaataagatcatgcctacaaacaaaggcaatttagcttccgtatttatgatttgcaagccttttatttctttctcttgcctaattgctctggctagaacttccagtactattttaatgacagtggtgagaatgggtattattgtcttcttgaggaacaagacattgtttctcaactcatgagagtaattttaataagcactcaagtattgtcattcctgtttgacagtaggccgtattttgagtaacaagggtcacagcataacttgccttttggtgaatcagttggaaccagtttgccatttagttaaaataaacttttctttgcactggtattactagaagtaattgtgcttatttataattaataataattaaatatgcttattcttagttacctaaaaaattatgatattaatgacctcttggttgataatggctaagctgcctcagcttctccaatttagcaacccaagtacatatcagttcaaagtaacacaaattgaagcaattatgtatgatcacataggaatgcttctgattaacaaaatccagaggactggtctttgccttcataaccggaacacaccacatgcatggtttcacagctcttggctattattggacttacttattatattctttaattcaagaaaaattgtagcttcattcattctgttcttaataattttaaattctctttagcctcctgggaatgggaagggctagctggtatagtcccctgtatctcagatttcagttacacataaacattaaaggggcctgacttagggcgctctttgcctctgtggactggtggggaaaatccaggtgtgtcttaaattctaataatcatgaaaatcagaaatcataatgtttcaaatacaaatcttcatacatgggaaatacaattgaattaaacattttcttcaatgtaggagacatttgtcagataacagaggggattctcatttggctaagagcttacctctaagattcattaaatgtgtttagagcatattttttgtagtttgtagttattttatttttctgagttattatttggattattttctcttttatttatgtatgcatttgtcactgctccccagaggcacctcattttggcattgaagctaaaaacccattcattaaggttgggatggagtgggctttgatatagctagcatttgggaggtagaaaatagacattcgtgatcaaaaaagctgtaagcggttactataaactatttttaaatttctaagtattttaaatattgaacaaatgtgtagacatttgatgtgcatctatactgtgaataagaacttaaacttctaatattcacattaactttcctgattttataaattctcgtttatttttcatctgaacattgaagaatgacatctacataaagtaaaagcaaatgttagtttgaacacattctaccctaatagtgcatgttttaaaattgctttggcaggatctaccaatgtattggcacattctcttcatggagttcctcatgtgataactgcaacattgcacattataatgggtaagaattcttccaaagcagttcatattttataaggaaatgttgatttatataaggaaggccatcttatttccatcagactttaagaaaaggcaggttctttgtctcttagagtagagaaatgtttgactaaaaaaccaaaaggcaatgctttactatgtggattgcctgtcttttcaaaatacttgctttgtaaagagcagtaaatgaagttttattgtaatctgtacagaaaaaaaatattgtagtgtgctcaaaattataattttataaccagatgaagaacattaatgaatactccttaagtatatccaacactgatgtaggactgtaccaagactctaggactaggattatgttattaatgaaaaaacataaccagaaaaaaatttcagccagtagatgtctatagatattttattatccctattggtaaaaagcatataagctcaggtatatgtaacactaaactactgttaaatctgtgtttaccttgcctatctactttaacttcgtttctttgaccatgttttataggaaatagcaataagctgaaaaatttagtactctgtgtttcttcactagtacctgaacaagttaaaaatggtaattattgtagttataggtaaagggaactgaagagaaagtgaggatgttcatggtctacagtacctttagatattctcctataagccaataaatatgctctcttatgtttgctgttttgatacaagtcctactgtactcactgattaatatttaatgtaatattcaagggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaagtaagtctttttcttaaaccaaaaattgtatcccaggttcaatgactgttaataacaaatttcattacattttagggcagaagactgtgaaatatcatttttaccatttaacagctctgatgatgtgcaagaaaggtaggtaaaaactcaatgtaatacagataacctgtatctttaaagcataaaacattctgacaaacaattgatcagacttaggatctttggttatttttctaacatagtagtaaagaatatagaatcacagactcttacaggtcctagtaagcaaacaactactcactcagcctttttctctttttccttccttctttcctcccttccttccccctgtctctccctccctccttccgttctctttttcccttcccttcccctttctttcctttcctttgtttttttccctttctttccttttccctttcccttttcttttgagtgcctactatatgccaggcactttgaatacaacaatgcaccaaaaaatgaacaaaacacacagttttgtccctcgtgataattttggtctagtgtgtaatacaaatattaaagccatattaaagaagggttatagtctttaaagaaatagtacattattattccttataatactagtttacctttaaatgaatcaacacattatgttggcagcaacaaaattgtacgtttttacttactatctaattgaagaaagtatttaacatatataatgatgagttctctaattttctcatatttaatagatttgtgtgtgtctgtgtgtctgtgcgcgcgttatctgttttatgtctttgttttgttttctttcttttaggagggcacagggatctcccaaatctggtgagtcgaaaagtatctccttgagaactgtgccaggttctgttgacattttgttctggtgagggaaaataaccaatcactttcattacctttagactgtaatgatcaatggcaaatgatccagggtcagttcttgaatgtcagcattatggcaattccttgcctgtgttcagtggcacctagaggcttggcacctaataccaggttagtaagcatttttattgaattgttgatacatttcttatagaccattttttttccagggtatccaattaactgttggttagctagaaacttaacaggtagtttatctttgtatattagagattctaagggatttgtcatcacagtaggttgagaacaactgttgaactggaataattatcagataatcattgactatttaacgtcactgaggctaaaataatatttcctaagttttattgatagaattttatgcctactttacttgatttattcatttagttgtggagaacattatattaaatactgatatttcttgtgaatgtctttgctttccaactttaatgcaaacataaatatccttagcatgaaaatcacacatatgtatatttgatactgtattagtctgttttcatgctgctgataaagacatacccgagactgggtaatttacaaaagaaagaggtttaatggacttacagttccacgttgctggggaggctccacaatcatggtggaagatgaaagtcacatctcacatggcggcagacaagagagcttgtgcagggaaactcctatttttaaaaccattagatctcatgagacttattcattaccatgagagcagcacaggaaagacccacccccatgattcagttatctcccaccaggtctctcccacaacacatgggaattatgagagctacaagatgagatttgagtgggaacacaaagccaaaccatatcagatacttttagtcaaaagaaacatttcagttctatttaatgtgaatagtagtgcatatcaatctcctgcccacattttcaattgaataaaatatgagacatcttatatatatctttttatccatgggatatagacattccttctcttgcacattcttcttaatcagctgtccattatggggctgaaaatatttctttcctgaatccaatcctgtagagtgtaggagaaaggatcgtgagtgttgtgaaatataggcaataaacggggaaatattcaaagttagagaagaaaaaagagaaactgcaaacttcgatattgaaaacccagatggcaaggtcctcattaattacatctagtgctaaaacttcaaaggagtattttgaaccttgtgtgatttagaaattgagcctggtggttttccccgacaccttcagaaatcctagatagctgtgtgctttcataatgtagtttccctgactaaacttgaagacgtggctagctgaccaaggagctatgtttggcaggacttgagacaatgtttatctaaccctgtttgtttaaggaccttcttgggagggtagacctgctcttctgggaacaatcgattcatagctccttcaaagccactccataaatgttctgcttgactagaattccactgttgactctgcaggcttaatcagtattaatgaatttttcagagaaggatgactaattagagatttcttctgtggtttataatcacaacatgccatctttgcaaagaccttttgatcaagactcatttgaccggagatttttcagagatgtagcttctgatgattcaggatgattgaacaggagatttcactttcttctttttcccccaccatgataaataataatttatgttagaatatctcagtgcaaattgccagtaggaactaatattcttatattctaagtattctaagattaaatgtgttcatatatgtgagacatttaaagcagtgccagccatgtaagttgtgtttctatttcaagtaaatattgcaaagcaggcataggatagtgcttttaatgtttataaattatgcaattaaagatgcacagtaacactaccatgaacgttttggtgctgtttatttttaattgggaagaagaagcatgatggaaagcatactgagcacctggagtattggtgctgatgaccattttttctctgtgtgcctttgaacaaatcacttaaacttggagttgtcttttccctctacatgaaatgagcgaatgatgagataatctctaaggtcccttacagctctgacttgagctttcataagatactaagagctctttttttattttgttgttattcttaaattaacttcatgtttgcactgaaatcaagctagaagtcatttgtatgtatttctgcaaactgcattctatagcttgatgcatttgtgagtggctgttttggcactaaatcacacctctgaattttcactctcttatattggatggaacagttatgcaagattaaaatgttcagtcatttaactgaacatgtgtggcagcatttgttcactccatttcatccatccaaaggccactttgatttatttcatttcctatgtcacttagaccttctgtctataaataaatatttaaatcacactttagattttagaaaatgttgagctatttgttacacaacttgtgcatattaactcttctataatacatcttttaacaacatagtttcacatttagaatttctaattacattgtattttaaattatgtcttgatatgtgagtaggacgcttgatggtttgctttgtaaaatgctctaatgtaagagcttattgagaaggaagccagtgatttaataaaactcatttgaaagcctgcatcatttaaaaaatagcaagatacggtttatgaattttaggtaaacgtaacatggtgatttatctatcttgtccaatactttcagtaaacagtatacttgttataaggaacagtatgtcataatttttggtataatctcttagtaaatttcttgatgtctaatagaaatatttaatttcagattaaataatggaagtatggctcttataattgcccgaaacacttctcggccagaatttataaaacacctgaaaagatatgccagtgtaaaaaatcaggtatagtaaattctttttgttacttatttgcaaagctattaatcatgtagaaaaagatgctgcaagaattgacatcgaatcctgcctcataagaaggttttattttcttctgaatatattaatcttctttttcccaatctatttcatccaaattttgaaaagcatccgccaggattaatatagattggccttttttgaatgatgaattagtggttatgtatctgtaaccacaaagataaaataggaaatgtagtgttatattgcaatgtgaaataaattaaggataaaattccatactcaggctgttcttcagaatgaaaagaagtgaaatttgagagtttagccttcttgatattatggcagcagactttctaaagttatgatctttagatcttcctgacatttgtttgcatatctgcattgattgaaatagatctgtagatatgtatttaaaaatatgacagttttatacaaatattcattcaaaatgagaatatgtgaagatatacatttccacttaagtgatttgctttaaagagaaacagtaactattacaagccatattattttggcagctgttttgacctgattattaggaaaatgatccttgaactatgtgaatttctgaaattgtgagtctttgaagtacataggtatggttgtaaaaccctatagtttcacactttttctttttctttctttttttttttttttttgagttagagccttgctgtgtcacccaggctggagtgcagtggcgtgatgtctgctcactgcaacctccacctcccacgttcaagcgattctcctgcctcagcctcccgagtaggtgggattacaggctcacacctccatgcccagctaatttttatatttttggtagagacagggtttcaccatgttggtcaggctggtctcgaaactcctgacctcgtgatgtgtccacctcggcctcccaaagtgctgggattacaggcgtgagccaccacgtccggcccacacattcttaaaggtataaaatggtgcttggatagagttgggagataacagacgggaggaggaggagagtaaacccagccaatgactggcagctgaaccttgcttatgtaccttagccatagcaagtctctccatttttgcctcattatattttaaaactttcttaggccatcttcatgaagtttgatctgtcagtaacattatttgatcctcatgtattgaacaactaactgggctgcttaggaacttaaatcataaaaaattacagtcccactttctttatatgtcaaagtagatcagcaggtataatgtaggttgtgagcctacataacagttttatgtatgtgtttgggtggaatatggagatttattgattttcaaaggaatatatgccctttcacattttaataaatttctaaacattaaaaccaatttttaaaaaacccaaagcactatatattcattgctgtttttaagtcagaaaatagaaacaagaaaatgattttaaagcactcaaaattccatgttcctcaagattagtgtcattaccttggtagaattttttccgaatccttttttattaaataaatgagaagtaaagtaagtattaacctcattcatgtacctctatttgagaacttaaatagtattaacctattaatgtacccctgagaagttctgtatttattttggggaggtgtatgttgcacaaattgtttatggaaggtctcttttgaaattgcctatggggcaagtctctcaggcaatttttgtaaacattcttcttcttcatttttttaaatcaatatacctttcttctgattttaaaagcaatggttaccttacacataaagacagacatacagaaaataataaaaatctgtatcgataggaagacgttttctaagagataatattatgcaggatttatcatattttctcatgtactctacgaggcatatcttgcttttgacacaagaaacagttgcctgtgtgtgattcactggccttaactctgatttatttatcaactttcaaaaattaaaatccatgctattttttttttttttgcaaagaattctaaaatattttgcatagtgtatatagtaagaaagattgattcccagggtgactgctttcaagcaatgttaatttgatttgttaattatccacacaggtgtgtttatttaggctctttccttcatggtgacattaaaaatgtgaatttatataaattttgtaagattatgaaaatcagatctatgtaaaaatcatgtctactgcataattcatagcagtgctggtattcaggaaggaaaatgtggcaattcagtttaaggagagtaacatctgcttctctgaaccatttttaccaggttgaataagcgaatgttactgtataacactgtaaaatagattgaaaccaccatgtgcggagtggctcctgttccttccccatctctgtgtaaaattagatagaggctgaacactacccttcaaagtccttgcagctccatcctattgctttgccccccttctcactgtccacacttttctctttcattgtgaccatttttggtagggagtttaaaaccttaaatgtgagtgcttcccccaggatttctttgcagccctctcatcttctcaggatgccgtctcctggatggcctcattgcccctcacttttgaactgtctgaacatcatgcactcccaagggttctgtcatctcgtcttatctgcaggacctctgtcttcttgtatgctgaagaggttctgaaattcaccggcatctggaggccaacatgtctacagccgaccttatcttttcccctaaagttgttccttctgcgttgctctgtgcgggtcaatggcaccactttctacccatccaggttaccctgaactgttccttcttcctcattcctcactaccagtcccctaacttgttctgttggtctcctcttaaatgtttctaaaatttctccctcaccttaattcaaactttaatcctttcttgcttacagtagcctccttttggccttcaggttctctggtcttgtcttccatacctctttttagagaaacttttttctaagacacacattggatttctctcctgcttaattcttcagtgcctttctcttgttgtcagaataatatggaatatcctcagtctggaacacgtggcctttgtatccaggtccctgcctgtgttgcaaccccacctcttattaccaccctccaccacattcccagtgttttggcattttattcgttggctaaggttgccataacaaataccacagaaaagatggcttaaacaaacagaaatgtatttctttcatggttctggaggctagagctgcaagacaatgtcagcaggtttggtttgtcctgagtcttctctctctggctggcacatggctgctttctcacagcacccacaagtgagtggtctttcctctgttcatccccgatgccttttcctatgtccaaatttcctcttcttataaggacaccagtcgtattggatgagggcctaaagacatcattttagcttaatcgtctctttaaagatcttatctccaaatatagttatgttctgaggtatacagagcgaggatttcaatacaggaatttgagggccaaggggcatgatgttgagcacctaggagtcacactgaattctgtgtagttgcttgaccatggtttgcctctagttttgtaaatgcttcctctctccagactttcttctccaggctaaatcttatatgttctttaaggctcaattcaaatgggaagctttcccaacatccatagcctgtttgcctcctcttgtttcctctgttgaactccacacttgcaccatcatggcactcccctgtatcaaaattgtaactgtttacttctcctccccgtgccccaaacataccctcacacaggatactaagctcttggctcccgaaagtcccacttaacagcgtctgtggcttcacagttaaagcatttgaaggatggctagatcttcattttgtgaggagtgcacatgacaactgctgatttaagataatagacttactggtggtggctgtcaattcttgacattccttggcttacagctgcatccctccagtctctgactctgccatccttggcattcttctctcataaggacatcagtcatattggattaggtcccgccctaatgacttcatcttaagttgattctacctgcaaagaccctatttctaaacaggggacattcacaggtaccaggggttaggacttgaacatagttggggtggtggagggaaatataatttagatcataacaggcagttgtgtgttttaaatgaattatcaactaacatgaatgattatgtagataattctacaaggatgaggcatgtagccaaggctttatacccgaggtaggaggtctaacgcagttactgtcaaacagttttgcttggggccctctaattctgtacctcagtcacaacagctgatgccatcatatcatctactgtttaactgtgtttacagtataaactggaaagttggctggaccttggtatctacatatgtaaaatatgggtgttggggaaaatattagttttctgtcaacttttaaaactgtttcattgaggtttacatgtggaaaaggggaaaaactatgtagatgatgtttaattaggaatgtatctcatgtcatttttctgaaaactgaaatgagtagttatacatttctgctcaagttatttggctatattttcttaattatgtcagaaaatacatagtgctttttcagtatagtttccttaggcaaacaagaaaaaacgcaagttgaagtttaccttgcaccattctatagtggtaagtaaacagtgatcttgcagcttgtgtccattgttaaagtgggaatggggcaggcaaacaccttttaaaatccatatttgattggctttctcttttaaaagaagacatacatcccattttatcttcagaagtttagacttgcgttcttccaaattaaattccaagtgtgaaacttgtactagtttgctttatgtcagctaaactaattgacaagttgataatggattatatgtcttctgtatctacaggccagtattaaagattatctttaattgaaaaatctacagtatcactattttatgtaacttctcacagatatgtactatttgtcataaaacaagatttctaggtgctagatctaaaagaacccaaaaggctttggataagagattccttcttccaaaaaaasttggagatccctgttcatagtctcaaagctattaaaatgtcagcatacatgctgatatttacttgtgagagagggctcagtgaactttgattcgcgttagtagctagagataaaccaagtataatgattatttgtatttatttttagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattaggtaagtctatttatttcaccgcttattgtcaaccagtaaacataaatctaatattacaacgaaagctctcttctctgaactatcaaagcaggcagttggttagtttttaaaaaatcagtaaatcagggaagcataaagagacatgcacaaatttcaataaataaaaagcaactttacatttattcaactgttatgtagacccaaggcattttctttggttatgcgtgtctacattggctttctaatttattgttgtgcataaactacagataatgtctacaacttccattttggatttttaaaaatggatcaagatcttaaatcttttagtggagccatctgaatagtaaagtgttagatttttatccttccatcttagtttcctctcactcataattactgtaacatgttttgttcagtaatttgcttttattaggcctttacagagcattcaacttcccttgggaacaattttacatagcaactggtataaacaggtttaggaacctgcaaacgcattcttggtaggcattgtgacactcagtggttagaagaagcatgcaggggtgcccactagacatgggtgttctagaggcataactgactgttttacagaggtaatggagagcattggacaatcaaggaagtcagttaaggaggttttagagcaattattgttgttgatgatttatcaatcagaccttctcagttttctagattacagctctgttgggaatgctgtgtttgttatcaatttgtatttggcattggcattgtgtaccatacttattaggtgtatgtgaaaaacaacaaaataagttgatgaaataatgtattttctttacagattgcatccaagacttatcagtctttatggaggaagcatggaagaaatgattccaaagtaacatgtaattgtttctaaaagaaatgtacaaactagaattttaatataaagaaatgtggccatgctttaaacctgtggtccccaccctttttgggaccagtttcatggaagacaatttttccgtggatgggggaatggtttcaggatgaactgttccacctcagatcatcaggcattagattctcttgaggaacatggcactctagatccctcacataccagttcaccatatggttcgcacttctatgagaatctaatgctgctgctgatctgacagggggaggaactcagtaatgctccattgctctaacctcctgctgtgtggccaaacggatatcctaatagaaattgatgttactaacaattagcctctagggctttaaaagtcaagatgaaatatcaattcaaattctgtttttagatatcaattcaaattcttttttttacaatgtgtttattggacacacaaaaaaactttgcaaccatcataatacatcaatatttaacctagataattctgaaataatttggattctttcatttttcaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttcttaaagtggtagggttttaaaattcatgatacaagtaacaaagtaagttgataacaaatactattttgaactgggcaaaatctagcccaatatgtaattgtgttccccttgtatctgagaggcctgtgttggacaaccatagtactctgctttcactgtgctcagataacctgaaatatatagttgtttctgagtagttctgagtaggaaagaaccaaatgtaaatttccttagagaccatcctggagaagacagttctaaatcggggcttgatttttcatctatgatcctagatgttctcctgaaagaatgactagcctttttataacgatacaaagttttttaaaaatacataaatgtcataaagtttattcctgtgtatacacactctgggttcaggaggttttgtgcttacatttcactactcaaatgccttcgcaaatctcagaacattcctcaccatcactgcaggcctgtgaacagataactttcatcaattaggatggctggctagtggcagggacttcatataaagaaatctttcccagaattgtttttccacattgccttctaatttgatcactccctataacagatgttcaaaattcggccacagctctcttatgaaggcagagtcagataaaatgatattctgcaattatctagatcataagcataaaataaatattacaaaaatgattgtatttaaagaaattttttaaaatccagaaagtcatttaaaatagaacctcatatagtatgaacaaactataaaaatattttacatttca

SEQ ID NO: 2 - DNA, 145347 bp, Homo sapiens
  mutation 142502: a/c SNP in reverse strand
attgctatttgggcaacaatatggctccttcagaactggtcgagaatttctgtggtctttgcttgaccttcaagttgggagtttcaaatcagaggctttgaagtctggaggagttcgcagccattaatccttccggggttgtgctaaaggcgtttctagaaagagatcggaaagacccgttcagcacaggcccattgcatcttctctttgaaaacgcttgtctgaatcaagtatcttatacagacccgagactgaggggagcaagagcgcaggtccggctgtggcgaggtgtccaccaccgtacttgtggtcaatgcctggactagagagccgaggccgtccagggcgggctggccagggaaccagaagcgtccctggactggctgagtgagggtgccctttccagcaacccagtggccatggttaaaaggcagaatacaaccgtcaaagaagtccccagctcccacataagagagcgcaaaggccaatggaaccaaggcctcctcgcgagaactagctcgctttgaggacaagatcctggggatggaggtggggactgacgtagtgagagggtctggaggaacagtcgtagctgaaggtcaggacatgaagaattgcacgtatggtagggatagaatggcaggtacaacttttctgtactgaaggaactgggagaggacgatccggttagggaggttggggaactaatctcaacgctgcgtttacagatgaagccgcttttatatggcgtatatgtttgcttagaggggccgacggagattaggagaagccatcctttggcgccaatgatcaaagcgtctgccaaggagaagaagccaagggatgggcctttcagagagggcaaggagtcatgctgctctggatgccagtgtcaggacaagaaatcgaaaggagcgaggactcttcactgcgtgcctcagtctccccgcttctgcctctttcacctctgtcctacttccggcgcgaaagcaggccactcgctctgatctagacctagttaacattagcttttcccttccttccctcaaatcccctcccccctctatccccgtcccttctgccgcctgaaagggttaatctctcctgcgggtaaaaacaggtccgcggagtctctaactggcgacagatgggccactttcttctggccacaaaggggccggaatggagcgctccgcggcatacaaatgggcaggtcacgtggttccaggctcttggctggaccgggaagaccatatggcgcatgccggggaggaaggaggaggggcgggggtaggggtggagggtgaggggagcggttgtcggaggagggcgggagacgagcaaggcgtggggagaagtggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaaggtaattacagttctttcatttttttgccccagaatagaagcaataactgaagactgatgaacctacatattctgtatgtgtgcgtttgcgagagtgtgtatgtgtattgagaccagcatccccctccataattgcccataagtactcacacataatgagtcgtgtcactcaagtaccccctgcaggctttctaatttaaattttaaaaatttgggtttcttttgtggatagcataggagcttcttggattttttaaaagaatgcacggtaactatgattatctgctagtgctgattttaaagtcccaaaagcaataatgacttcactttctcacttcttacagtaagaaaaaaaaatctatgttatcaatatatattttgtgtgcatgtattttacgcacattgggagtgtcaagctgtgttttcagtgaatgaaagggacatggataccttgagtattcacaccatggaaaataaatcaggttcagagatagtttagttgagaggggggaaagtggagaaagggagagggactcactcctgctacctgttaccgctccagaggcggccaagtccccagcagccactactggagccagaaattcagttgttttactaaaggctttttattttccttactagaagcggcaacttcgcggttgccaatcgctgaccattataattactcaatcttttaaagggaggtttgaggcgaactttgaaaagccccaataaagagcgggcggccctttcaatgggctgtttattagagaggagccttccgcacctgatccccggcgcgtgggagagcgctctgcgccgcgcccccagccctcgccctgcagctagcgcttttgtacaaggtggaaatttagcggtgggccagagatggaaggcaagaaaagaaaggcgagggaggggtggaagaccctgtccacttttgttgccaaatgttacattgatggtgaaacaatttggtggaaactatttttcctcctttctgcatttgcttttcagtatcccgtcgatgtaatcttcttaaaaatcgctgccagtattagtaaattacgcaatggctgttcaacttaaatcgctaagtatctggaagccaggacagaaatggaagtagaatgtgtgattttacagcttttttttttttttatggagttgtgagtaactttgaacacatttggataaacatgaagtcgctgaaatgtacagtcatttccacacacattatcctgtcgggcaaccaccataaacacatttaagttaatcactaggatacaaacacatatgcgtgagtggtgtacacatatacatattcactaccctcccccagtcctgtcctcactcctacgtactagcggggcacacgcacgcgccattataaaacactgcatttaactttttctcagaggcattcattttgtaatgggcaggtacttttcgcaagcatttgtacaggtttagggagtggaagctgaaggcgtatctggcttttgaatatagcgtttttctgcttttctttctgtttgcctctcccttgttgaatgtaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaaaccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtgagagcaattgttgcatttcttcttaaagggattctgtttttatttttggggaaagtagttgcttttttgctgagttaaaaaatactaaacactatatgtagaataaaagaaaagaaaaaagtttaccttggcatatgctcttgtctgtttatcttgcacagggagtcaccagttctatgtagataatgaaaagacctaactgatatttcattatttggaatatgggactggacggcagtacaaacagtgtgtttttttctttgttttaagtggcttagcctttaggttttttatttccatttttaaaaatgattgttacatgttttcttctatttctttttttaaaaggtggattttaataattattaacaagcaagacataaacaagtatcctagcttagtttgtctatacatttaagatgtataaaacattactattttcttggtcttctgttatctgtacatttttctgaactaaacagttttatcttgcaaactagtactgtcccagaaaaatttatacacctttaggaagtaccaaagggaaatgagttaattaatttaaagaatccaagagaagtaacattttataattgttctattaacatcttgtgatgatttccatcatttttccaagaaaaagcataatggattatttgtactgaagaacacactatttgtactgtatttaggaaggtgtaattatttcctccccccaccctttggggcactattctgttgtttcatgaacacaactcactggaaaaacttatggatgattctgtctattgttaagtccacttcaaaaaaaaaaaaacagtttggcatttcttttcctctggatgtattgactgacagtcatgattcctagggaatatcattttggcacttgtgccctggctctactgtggtgctctgattactgtcattagtaactccattgtttctactctgattcgggtgccacattggatgactaccccccttcccaagcttgttcctttaatctccttctcattggtgatttaggggttccagaaagctgacctcatttagcaagctgctccagaaaaatgtgagtaatgtaatggacaggaacaattagccatactaataacattgccaatgaggctgcgtcaagctgtgacagaagcagtaaggaatacttcgacgttaaaaaaatgtttgagagcaatttaaaatatattattttaacatgttttctatcagccttcatcacatgacagaaatacttttaagttagtcccaactttatctaaaatgcagcaatctcattccaagtgaatcagagttgttattttggaatcaagctgttgctttctatatcctggattgttctcactgttcttactttaagagacataatactgatatgatacttgaatactaccagccttccagtgtaggaggtaatgaagtgagcattcagatctgatctaacctattaagtagctcaatttcacctgcaattaaaattagacatcttcatgcaaactaaaatctgttgctgtagtgaagagaagaaataaaagaatgccattttgagaattccagcttccaaaatagcaaacagggaaatctagactgtgttcttttgtaaggtagaaatgaagactaaaagttaggttttttttttttttcttcccattttgccaatacaacttcattctaaaacatagggattctttcagtcagtcaaggagtaactcacatgccaccatcttttattcaaaggcaggcacagatgttccttctgcaggggaggatttaatttatgaaaatgatattgtttatgcatgaatgaactgcatgcactctgcataacacatagcacttccatctgatcagagaaataccacagaaccagtgccaatgtcagaaacatattctacaaatttactcacttaaatgtttaatgaatatttggaaggcattttcaaaccataagaaacattttaaattatcttcttttatgaattcctacccatatttaaaagagactcttacagtttttgtaattggctaatgcttatacccagtttgtaagaaaagaacatattttactaaatgaaaaccaaccaaaaaaaaatgctggcaagtttggcttcactggaaaaaatatttcgtttagttttgctgtttaatgcttgtcatgaataatatttgggattctatctgtttcttcatcttgagccacgactattcctatcaaataagatgcttaggtatacttgtttaatgtgaaaatcctatgaatagttatttctagaaaaagctggtatgtaaaatcagggggaaatttcataaagatgaaattgggctaaatattgtaacatgcataattactattgaataggaacacttcacataacatattttactttatataaccaattgcagctatatagtatgatctatctacttttaatcattaaaacaattatatataaattaaaatgaaagattataatatcaagagtgttctactaattttaggtttataatatgttacagtaaaataccatttgaaataaattttgtgttctaatttatcttaaaatctctctgtttttacatttgaaagtccttacattcttacaaaattaatgcattttctgaaagaagctagcaattactaaaatgatatatggatcattagctaacagtttgaatcaagctgttttagttctataattatacaagaaatttaaagtgaaaatacctattaagcaattaataaaactaggtttcaaaatattggctaattttctcctaatgggaaatgtaaaatagcaaaactgcttcttaaactacacaaaaacctcctcacttctccttttctctctctctaacaccacttatttcctgaaaatcatctaaataaaatatttaattccagggtctgatgaagaataaaagagccaatgcaacatcttgtggaacaccaggactgagaactcttgttgttaccattgcaaagaggcgttctggcgtcagatgcacagtgatttgtatggtggcataatcattggctcctggccaggcattatgtttcagaggacactattgtcaagaaccattcaactagaaatctgcactgtatgcactcaaaagttgagatcatctgccttcctatgacaggaagaattctgtgctggcaattgactcatggactctcttcacatacactaaggcttggtccagtggctctgatggaattaactgtgcagccaaactagtggcattgacaagacagggccacagtctctggggacttcaggagaaattgctaattttaaaatgcagagtattatgttaatgctggattaaatcttcagatacattaaatgtggatttggccatctaagcattattatgttatttgcccagttaatttagaggtagatggatggtgacaataaccatctctacagatccacaattctaagagatggatccaattgtgaaatgatatggagagatagagtaagttcaatctagcatatatgaagtaatttggtaactgacttttcttttaacaagatcaaaagctaacctgctttacactttcatgtctaaggacagccaaccagagagatggcttcacacactagcccactgctaagtgcttttcattcactttcatatttcatcatcaaagcaccctcctgccttatttatagatggggaaacttcaggaagttgagatacctagatatttgcattcctgtcttcctttcttcattcaggtttttctttcattgccacttcctcaaagaagcttttactgattcccatttaaaatagcaactgacttcaactccaccaaaatcactgtattgcccctccctctttccagagcatttgcctatcaaatgttatcttatgtatttacttgtatagcttaattttaaactatctatctctaggtcttctgagcacctgagaaacagagacaaagttgtctcttctgtgtgttgctgttcctctggtgcttagaagacctagaggatcctcaataaatattaactttccaagggaactgaagagcactaatgtgatgctaaagcctgttgccttaaccactatgctataagtcaaatcagttgagaatggagaggaccacaaattattttcagtccagcaagtgttataaacattaattctataaaaagaaaacaattgaaactaatttcttattatattgcatggcaccaaactccccccacttcctttttgaggatcatgagttgtctgtcattgtttctttttattgatatcaattggttaaatataatctggaattggaataaaagaaaaactattataggctttttccagaccatgtatttcaatgcatattattttttcctttctgttcattattctttcagtaattgcacttgttctatttttagtgttatgtaaaattactgtagctcataatttctattttgaagggttcagtgtataaacttagcacatcaatactatctttttagtgttcgcgctcaatggtgtcagttaagagatcaccatcacttttggtgacgtcaatgaaggggtattgcaatgcttaagagaactgttaatccctttccactggtgtcactaacaattgtagtgcttgtttattcatagcaggtacgtgactaagtaatgttaacatcaaagcagaaagaggataatagagtgttctaaaaagaaaattcggtggttgggtgcagtggctcacacctgtaatcccagcacttttgagaggccaatgggggtggatagtttgagcctaggagttcaagaccagtctgggcaatatggtgaaacctcgtgtctacaaaaaatacaaaaactagtggtgcatgatggcatgcatctatagtcccagctactcgggaggctcaggtgggaggatcacctgagcctggggaggtcaaggctgcagtgagacgtgattgtaccactgtactccagcctgggtgacaaagtgagaccctgtctcaaaaaaaaaatgatttgagataacatcacttgtcattgtttgttaactgaataatctttattctagccagtgcctaaatacataataaatgatagtacaaatggatataaattataactaaacctaagtagtgatatttatcacaatatttctttactagaagaatttctttgttaatagaggcaaggctacttgtttagataccttaaaataacataagatttttggataaataaattaatgattctttgattctgactggcatattaaaaatattaagcgaagagatctttgcttcccaggttttattttttgtctaattaactactggtgcatttatattaaaacatattgtcaagggaaaacgtatatatatatatgtgtatatatggtgtgtgtgtgtgtgtgtgtgtgtgtgtgtgcacacatatgctatacttggttgagtagtatccccttcccttgcccacctctctcccaaatttatgtccatccagaacctcaaaatgtggcctcatttgaaatattgtctttccagatttaattaagatataagatgtaaattgatacaagttcatgctggattacggtgggccctaaatccaatcactgatgtcctgataagaagcagacagaacacacagacacacagcatacaggaagaatggcatgtgaaggcaaagacagagactggagtgatgtgtctacaaatcaaggggccccaaggatttggggcccacatcagaagctgggaaagagacaggaattctcagcttctccttctgaatccctaagaaggaatcaaccctgctgacaccttgattttaaacttcttgtctccagaactgtaatataatacatttctgttgtcttaagctacccagttgctggtgatttgttatggcagccctaggaaactgataggtatactaaaatctctaatgaattgatgttaaatatatataagtataggagagttcatttaaattcttctgaaaatgtcttcttaaacttttaatgatacagtatataacaaccagtatacgtagttggtatcgggtttgacatttaaacaagctgacaaaaaacagctgtttaataaacatctgaattatataaaagttttattgtttattattcatgtgaatgacttaaactgacatctacatttagtgaagtgtgaatgggcctagccaataaactatgggtaatttttttaaagtctcatctttgaactcacaaaaaattatcaaatatcagctattatgtattcttcatgtgaagaaaatgtcatatttatttgatttgtggattagcatatatattaatagagcttttgaaagaacaaatgtagcactttcccgatttcatagacactcatttaacacacaagttcatattttaaagtacataattttaaaaaaattctagtccaaatgaatttaagtgccatgacttctaaaaattctgtctctatttttgggttttataggaccttgagccagtactcttctggtgagcttaagaggctaagacttcacctttagttatatggggctttcatctgattatttgtctattttgattgctctaaatacaagttagtgtgtatttcatctgaatgtatttcattataagttttggttttatgtagatctggggatctgtcttgtttttaatcttgattggtctgtttgttttgggatagttggtactttcatttcttatgcttgctttctttttcattttgtgcccacctttagtcaggtgaacatcagtaaggaataaaattttatttttttaagccactgaaaaaatttaaaaaccacatcataactctgcctctgctgactgataaaaatgctaacttattaagacaaaatgttatgcaagaagactttattggaatagagaaacatcctttttatgtaagaaatatcaacagagacatgtgcctttcttgtgacaaatgtggtatgtgtgtggattagaggtctggaatgtggcagcatttcagtacttggaggggagaattagagtagggtagaaagatagacggggagcagaggatgattctcacccagtagaaagcagagtgaagaaagaaaggggaattgttttttgcattatattatttgaactgtggattaagtctttccataagccatccctacgcctctaagtaggttttattaacttaagctggtttgagatgggtttttggtcacacacaagaattgcctgatacaagagaggctttgattttgttgttgcttgctcatttttatacactaagatggagaaaaccctggacatagtgaagacgaaattgaggaaggtgttgggtagagtggagggtagaagacctgtaacataggtacagaattacattaaactggaaggacttatatccagatataggagtcagggtagaaagagagaatgttagcagtaagggtaacagagtagcagaagtttattcttaccaggtcctgttatgtgacagtggaggcatgttgaccttctgactaggggagttaaaggagaacactgaaggtttagaataatgtctctaaggatagaaagagaaagtttcatcaagactcatcaataatagggcagcagggcttagggccaagcaaattcagagaccatgatattatagtagtttgtagtggtcttaatccatctaatttttcagcattttctcaatggccaatacttagcagtggtagtgttttatggcatttggacaacagaagtgaaagcactggtaagagagacgttgaagtgaaacaccatggggctcagaaaagcagagttgatccatctggtacatgggcaaggatggtcctgaacaattctgcagtaagttggaagatagaaaaaatacctaacgaacttgtagatctgggtaaggagatttttggcagaatattgtaaggctaattggcttctcttaactatatgagatagggttttacaagggagagataagcgagcataatttagaagaactatagggggtcccaggcagactctctggctggaaaattattctgatagcaagaaattagccccaaagcaaagatgaaaagtagggtacttccaattaaacatgtcataagggcaagcctcaatcaagagtgtggctagaaggcacagctcacctggacaaaagtgcttctaagcatattaggagcatataccacaataacctgacttggacccaaagttgagagaggccagtctcaaaaaaatttgagggaattgcttttgcataatatgatactttatatacatatctgttacatatcatatatatcatattaaaaagaaaaaaaaccctgtttttccttccgttctttcatataacccttctgacaacaaatgtggagtttttcacacactaagcaattctttagttcttgctggacacttcctggatgtcctacaattcaactcgattctcacacaactgcccagagtcagtgcagacccgcagattaaaggcttagccccaaaagactaccccccactttagatgtcaatcacaagtctcaacttcatttacttctgaaggacgagctatacattggaggaaacccctctttctttcaataatttgctagaatggctcacaaaactctgggaaacatttacttatggttaccaatttattataaaggatataactcagaaacagccaaatggaatagattcatagggtgaaaaatgggggagaggcatggagcacaactctctcagcacctccatgtgttcaccaacccagaagctctcagaactccttcatttagggcttttatggagctttatcaagtaggaatgattcatgaaatactggcattggtgattaacttaacctccagcccctttcccctccctcaacattgggggtgaagctaaaagttccaactctgtaatcacagggtgagcttccctggcaactagtcccctgatccttagggggcttctgaaagtcacctcattatcataaactcaggtgtggttgaaagggatgttttgaataacaaaagatgcgcctttttcctttatctttctgagttgtttcaggagctagggacaaaagactaatactataacaacaacaacaaaaaattcaatttttgcttttatctcttgggaattacaaggattttaggagctctgtccagaagccagtgatgaagatcaaaatacatatttcttattatatcacaattcacacatgtacatgatatccgtaagataagtgaactacataaagtaagctcacaaagtttctgtaggagttttgtccatttacaaacagtttgtaagctaaaagtatctgtgacaagcctcagtcaatttagaagttcatttttccaatgttaaggacatgcctgtgacacagcctcagaaggtcctgatgacatgtgcccaaggtgatcaggctacagcttggctttatacatttagggagacataagacatcaatcgatacatgtaagatgaatattagctcagtccagagaagcaggactactgaaagtggaggcttgcaggtcacaggcagattcaaaggttttctgattgggaattggttgagttattatcttaagacctggaattaataaaagggaatttatcatgcagatgaagctttaggtagcaggcttcagagacattagattgtaaaggtttcttatcagacttaaaagagtctgttctaacagtctttaggtctcagtgttgatgttaatgctggtcagctgtgcctgaattccaaaagggaggagagtataatgaggcatgtctgagtcccttttcccatcatggcatgaactagtttttcaggttaactttggaatgtccttggctgagaggaggggtccattgagatggttgggtggcttggaattttatgtttggtttacaagtttaacattaaaagcctctgtacctccaatgttttatggacaaaaagaaggctgaaaaagctacttggctgtaatcatgggccatttcttgctgaaaagaagaataaaatggaggcagaaccaaaagcccagaggctagagccaagagctgctgagaatgatgaattagggaaccactctcagagagcagatctggatgtgagataggaacattttctttctcagggtctatgaaactggcaacatatgctctcctgaatttcagaattgctatggaccagtgactgtgatatgctttctatatttttcccttttgaatgggtgcatctatcttgattatcctctgtctcattattgtatgttggatttgtgtgggacgataacatgtgtttttagttcctaggttcccagaataagaggagcacactcaaagagcgacatttatgagatactggatttttcacttgatatcataattgggtgagacttgaaagaaagtgaacatattttgcaaatgggagggatgttaaccactgacaaccacacccacagggtccactgtattagcctatctgcaaagacggctgccaaaaattccttctgtccatatatacattcccttttttaatgtgactgtttcacctgccagcaactgaagggctttatttccatttccccttgtgacttgtttgactaacagcaagaagcaaaagtaatgctattccaattctagacctgggccttaagaggcatgacagcttctgcttttactctcttgaaactcaatgtcattttttaaaagctcaggctagactactcatcatgagggaccacatgaaaagagataggcccagctagtttccacccattccagccgctccagatgagatgccagacatgcaaatgaagccatcttggatatttcagccccagctgagcttccagctaaatgtaagtacattcagttgatacctcatagagcggaactactgagctgacttcatccaactcacagaatcataatgaataacaaatcattgttgctttaagtcaatacatttaaagtttttttgttatccagttgtagatgaattatacagcctggggggaaaaaggagatagcacactgttagttgcctcatcaatattcatccccaaattctttttcctttttagtaggtctcacctcccacctggaagctgaaaacacctttcccagtctctctggaagctacagcacaggcatgttgcccaattctaaacaataggacatgataggaggtctgctgggtgggatttttgaaaatatttttttttctggttaagaaaaaagaaatgcccaaggaaaacctacaaatgccccttccattcttgcttttggacattttttgggagagggtatgatgcttagcactcctgcagccatctcggggccaacaatagaatccttgttgctacctggtgatagtgaagtagaaagctacaaagctcttgatttcttttcttttttttttttttttaaattttattattatactttaagttttagggtacatgtgcacattgtgcaggttagttacatatgtatacatgtgctatgctggtgcgctgcacccactaactcgtcgtctagcattaggtatatctcctaatgctatccctcccccctccccccaccccacaacagtccccagagtgtgatgttccccttcctgtgtccatgtgatctcattgttcaattcccacctatgagtgagaatatgcagtgtttggttttttgttcttgtgatagtttactgagaatgatgatttccaatttcatccatgtccctacaagggacatgaactcatcattttttatggctgcatagtattccatgctgtatatgtgccacattttcttaatccagtctatcattgttggacatttgggttggttccaagtctttgctattgtgaatagtgccgcaataaacatacgtgtgcatgcgtctttatagcagcatgatttatagtcctttgggtatatacccagtgatgggatggctgggtcaaatggtatttctacttctagatccctgaggaatcgccacactgacttccacaatggttgaactagttcacagtccaacagtgtaaaagtgttcctatttctccacatcctctccagcacctgttgtttcctcactttttaatgattgccattctaactggtgtgagatggtatctcattgtggttttgatttgcatttctctgatggtcagtggtgatgagcattttttcatgtgttttttgactgcataaatgtcttcttttgagaagtgtctgttcatgtcctttgcccactttttgatggggttgttttttttttcttgtaaatttgtttgagttcattgtagattctggatattagccctttgtcagatgagtaggttgcaaaaattttctcccatgctcgtgggtaggaagaatcaatatcgtgaaaatggccatactgcccaaggtaatttacagattcaatgccatccccatcaagctaccaatgactttcttcacagaattggaaaaaactactttaaaattcatatggaaccaaaaaagagcccgcatcgccaagtcaatcctaagccaaaagaacaaagcttggaggcatcacactacctgacttcaaactatactacaaggcttcagtaaccaaaacagcatggtactggtaccaaaacagagatatagatcaatggaacacagcagagccctcagaaataacgccgcatatctacaactatctgatctttgacaaacctgagaaaaacaagcaatggggaaaggattccctatttaataaatggtgctgggaaaactggttagccatatgtagaaagctgaaactggatcccttccttacaccttatacaaaaatcaattcaagatggattaaagacttaaacgttagacctaaaaccataaaaaccctagaagaaaacctaggcaataccattcaggacataggcatgggcaaggacttcatgtctaaaacacgaaaagcaatggcaacaaaagacaaaattgacaaatgggatctaattaaactaaagagcttctgtacggcaaaagaaactaccatcagagtgaacaggcaacctacaaaagctcttgatttctaatgacatcatatgggatgaaccaacccaggaacagcctgactctggacctcttttaatgtcagaaataaaatcttatttgtaaaccactcttagttgttcaggttgttgacacaggcactgaagtgcctccaaatggtgatgaataatgaggcaaaagtcaaagacagcaagtctagtgtcaaattttttgatgcctatgggtaagaagttcaagaaagtgagctattttctttctttttaaaatttatttttatttttgtgggtatatagatgtatacattagtcagctattttcaatagtgagaagggatgttgccacttagtataatgcctttttcatagctatcatagaaaccatatatacatatagtatagaaaatgaggatagatttctgacttaaactgcctatttcatttgtgtgcctggttacacctaattcaagactctacaatacagcattgctagcaattactgtgagaatatttcaagctccctatttgctggaaatacatttcatttttttgttccaagtttatgaatattagaacctatctaaaaaggagcttttaaaaacttgaggaaaggaaaagggagggcctacttttcttgcctgtgttatttcttgttactgctgattgagatgctagagatcatattgggtgagatgtgtcttagaatacagctgagcaattcacttttaacagtttccatctgagtacaaaaaactggtatgtgcagaaaacttgatattctgacttggcgggattctaggatttgttctatttttttctgtaattgttgtagggacatatggccctgtaccttttgggcagcaggagccagaatagcaggaacattctgacaaaattcccactcagcatgagagggaagcagtccccttgatacactgatgatgtgcccacttagcattacaagtgtttgagaggtggacacaactaaaactcacctcactcaaaatatatattgacacggagaaagtaaatacaatttgctgttattaacctttcttctcaccattgagacatgttaaatatctgaaattaataaaggaattaaatttaaaaagtttacttatcatgcatttaacacatttattgagcatctgttatataaatgcactgtttcaggcacaagagatagagccataaataagcagattaaatcactattctcaactgaggtactaatctgatataagagaggagacagaaataagtaaacattataaatcaactacatacttttacatggtgtaaagtgcaattaagaaaatattattgaatagaggtcaattttggaatggttgggcagggaagaccttctgaggtgacaagaagttggcctgggcaccatggggagctctaccatggtgaaaagtgttccagacagagtagacagcaacagcagaggccctaaatgagaatgcacttggcttatctggagagtagaatgaaggccagtgtggtaggacacatactaataataggagaaaactgatagaaaagagggtttgagcaggtgggcaggaattggacaacatggtgtctcatatgtcataatagaagtttggattttattctacctgcagtgagaagttcttaataaaaaaaaaattctataaactggagtttgagaaagaactatgttgatgatagcataagccctcaatcacttgtcacataaactccaaacttcagcagagactcagggagatcaaagggactaccacaggattacccactggctaaaattcagatccatggcagttggtcctgactggaattagacttccttgtctgttgccctcattgcagtgggtctgaatgtctctgtcggctgtgaatttttctccctctatctgtggcactgagaaggtggcccagacttccagagtctgtctcattggcctattacttggggatttgctgcccttcttctggaagtttgggtatttgttttcagagcatacttaaaggcctcctgaaagcaatgttaacaatagcaggatatattttacagtcttctactcagacttggatttttaagaaccagggatggagactgtgtttccagatctagtcaaatcccttccaaacataaagcaacaaagtgccttttaaactaggacctgtactgtttaatgctctggaaacaaatacccaagcttcagccaaaggagggaaagctatgttcaggaagcttcctgaaagttttttgaaagcaattttcatgcattagtattttacatatatatatatatatatatacacacacacacacacacacatatatataaacatatatatatatacacatgaatcactaatgagacaattgatcttcaggaactaacgtgaaataattggggtatcttggtattattgttatagataaatgttgaagaagttcattctttcagatattaattgagcacttactgtgtactaagaactgtgatagatactggggatttaatggtgaacaagataaattctctgccatcagggggcttatattctaacaaacttaaaatttactgagtgttctctgtatttcagtattgttactaagtacactaacttagtggggaagctagacaataaacaaagaagtatgtaataagaattaatagtaagtgctgtaaagaatactaaagcaggttatggtagagagattaatggcagcgtgaagatgtccatgtttcaatccccagaacctgtgaatatgttaccttacatagcaaaagaggctttgaaaacataattaagggttatctgggcaggcccaatgtaatcataagagtccttatctaagacgggggacaaaggtcaaagacagaggaaaagagacgatttaaggatagaagcaaagaggagagatgttagactgctggctttgaagttggaaaaagtgaacatgagccaaaacaaacaaaacagaacaaaacaaaatccacaggtgacctttagaaaaggggtccccagtctctgggccatggaccagtacctgtctgtggcctgtttggaaccaggctgcccagcaggcggtgagtggtgactggtggacaagcaagttttaccacctgagccctgtctcctgtcaggtcagtggcagcatcagattctcatagcagcctgaatcctactgtgaactgcacatgcaagggatctagtttgtgctccttatgagaatctaatgcctccaaaatgctcaccccttcaaactgcccccatccgtggaaaaactgtcttccacaaaaccagtccctggtgccaaaaaggttggggactgctgctctagaagccagaaaagaggagatatattttcctctagagcctacagaaggaatatataggcctgctggcaccttgattttagtcctgtgaaactgattttggatttctgacctccagaaatgtaaaacaatgcattggttttgtttcaagtcactaaatttgtggtaattagatacagcagcagtaagaaatgaatacacaggtttacaggatggtgaattatggagggtgctcaggaatggcctctttgaggtggtggcctttaaacagaaaaatgagcaaagtgaaagaatgaaccatctggtggggagaaaagcattccagtcagagggaacagcaaaagcgaatgctctgagaagggattattcttctcaatgtgtttgaggactggcaagaaggctttgtgtgaatgagcaaggggaaaaagttagtaggtgatctcggagacatagccagggtccagattataaaggacctctcgccttgctaagcattttgactttattccaagaataatgggaagtcaatggaaggctgtgagcagggttatatgctctcgttattttttaaaggcacaatgtaactccaaaatggaaaattggctctgggctggaggtgccagcacaggggaaaccgaaagcagagagctgggttgggagagcggagactgaagttgtccagctgaggggtgcagaagtgcagactgcaatgacagcaggcagaaaggactatatgttctagacagaatggacaggatttgctggtagattggattgaaggcatgagacaaaggagacatggatgatatcaaggattttgatactacagatttgaaacattctgagagggacaggtttgtgatggaaaatcatgagtctggttttagatatgttttagaagcttattggacagccaagtagagatgtcaggtagggagctggacataatacctaaagttcaggagagtggttggagctggtgacatcatttgcagaaccctggatggtacataaagcacgggacagtgtgtggatagatcctaaagagagccctagggcactccagccctggaagaaggcagcttatcaaaggaaaaagaaagaaagaaggaaacacaatccttattacttccatcttcaggacaattcaaagccagtgtttttgacttcctggcttgagtgaagcttgaaaaatggcaacttgcccctttgcaaagctcctaaggagtagccattggcttggcctgtttgcactggctctgggtgagcttttaaaatgccagtgagctctaattgtgttgattgcctaacagctgtgaatacaagatgctgactccagaactgcaactcattctgcgaagggcaccgtccttttccctctaatgactgctgaacagagccacctgaagcctgcatggggtttagcagcagctgcacttctgctctaagaaatagctcactgcagtcagatcaaactgaagctcttccttgcttttcctcgaagcttgggtacttattgtcggagcattaaacagtaagagtcctagcttaactggtgcacagtgctttatgtttggtagggatttggttaggcctacaaaccgtctgagctaagaaccttgagaaactcctgctatagttagctctttctgtgactctgcagtgtgaccaggaatgaggacagaattaagaatttgctgcctctatgatagaactgtttaggcactagaacactggaactagatctacaaccctatgaatttaatttccttttcaactcccctactccttcttttcaatatgatgataatgatcttgtttaaaaaaaaaaaaagccttctgctttacttcccactctgctcctcttcccagggactcactttcttcttgactgcttccccattacaagtactcagctccctgttttatcaccctgcttagagcagccattatcagccttggctgaacattggaattacctgggaacttttaaaaatccggaagtctgggtctcgcctccagagattccagcttagttgtcttgagcgtggcctggacatttgggttttcaaaagttccctatgtaactttaatgtgcaaccacaattgagaatcactagcctccagactctctgtgttatcaaaattaatgagcagctgattttagaaatctcagttatcaggagaaaagggtgaacccccccagggctcttctccttttccaggtgacacttctttatggcagtgcgtgaaagtgaagccctgctgcttgtaatctccctcaagggagtgcaagatccaggcaaagacaagactgcagaggcgctaccttgggggaaagtaggaccctaaatacttacacctggaggcacttacctttaatactgaatttgtcagatgcaaatttgtctatgcaaaccagggccttatctctagcttcccctcaggggttttgggaagtgcgctactactctgaaacagggttgtaaagcgtcacctgtgctctccagggaaccctctggaaaggaggtggaaaaacagaggcttccacccttgcaactctaagtgtgttccttggccagtgggatccatcacctagtattttcttagatatgtggtatctgggggccagtcccacacctatgcaataagaatctccatttgaacaagatgcccaagcgattatatgcaagtttaagattgaggagggctggtttaactcgagggtaacgaaaagtacgaaatcgtactttacaggagaagctaggcggagggagccacttattcttcctcttgcagctgggtctttttgtggtgagtggcgaagcggcgaggctggcaggccagggtgctggactgggtcaggcgcggccccgcctccctcctgggtccctgccctgcgcgccgttgctgtggcagcgctggacgcggctagagctggggctgccgcgccctccacctccttctccaaaggcctccccggacccctggctcgggcccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgagtgcccggccccaagcgtcttcgcctccctccgcgcttcctccctctccccggcccaaggcctacacccacgagcttttgctccaccctccccttttctcgcctcccctccccgtgctcgcctcactgcccggacaggttaccgagtccccaagtcgccgcctcctccttcccaactgggaactcacgcctctcgccccatcccagaacccccagggattctttcgctacctagccttttcccgcctccgagaccttccccgggcaaacgtcacaagcagcttttgctcagagtctcagcagaaaatcttgagccccaaaggggaggtaatttacaaatgtgagaaggtcaactactcctcccctccaagttgaaaaagttttaatccattaactttgatggtacattgaaactataaacatctcacagattatgcctacacaagagttctgaatccaactctcattttgctgacttgaaaatgtaactccagagctttgggagtgtttctgggtttttttctgcccctcaccttccttgccattgtctagaattaagacttcttcaggctcggtctagaaacttttgatttttaatattgaccctagattattggatcacagttttgcgatgcttagttacgtcaagcggtttgcttaacgtttgccttttattgacttaaaattttagttacctaaaaaagttataatgctgtagtttacaacaaatacttcgagtctattttcacgtcttagtcaaatagccttatagacttaacagatattttataaagaccattttgcaagtcttataagtagactttcatatagtcttatttctaagtccaaactcgagaaatactccccattgttgaattagcttagatgtgagcggtgaaagacagatgaaatgggggaggaactacatcaaggttactctacttgcgaggagatgacttgggggagatggaatttggtattcaacctcttttagctaaatacaaatttatgaaattaaaaaaattgccttcccctgttggaaaacaagacacagtgtggtatttatgttacagaatagactcactgtcttaaagtcttgctcaaaagtctaacaaaatgaaaccaactagccagggattcagcactggttgcgattgtgaattctgcctgtgctgcatgtgccatgctcgctcgcttcacgaaaacagtctttgaccttaaagtgttttcaggtgttttaaaaaccaaggtgtagtattttcttgaaccttttaagttaaaagctagggatatagctatggaattatttgtaagtctttcaggcaattcgagttatgcaatatagaagtttataattacagtttggattagcccaaagagccagtttaacctacagtgcagctgaaatgctatagaattaaaatgagacattgtgcaatgagaggtcatacaaaccaatgttgcagtatttgtgtacaaaaaaagcaaacaatgacatgagaaaagaaatgctgttttatattgagtggtgattaaggtaaaataggtttaattagtgcacccctggcagtagagtttaaaatacatcttgacagatttgtaactttaaaggttgcaagtactgattctttgtttaattatgccctaaaaccatttggtggtcttttccttcatacaggtgtaccctttttctttgtaattaatacctggtattcaaaccactttgggcctctaaaattgggggcacagaagcctagagccttagtaagtacttctgtttatggaagaaaccaagagatgttttatttaggtaaaatatagccaggcgtggtgtgtccctgtaatcccagctacttgggaggctgaggcaggtgaattgcttgaacctgggagttggaggttgctgtgagcggagatcacaccactgcactccagcctgggcaacaagagtgaatctccatctcaaaaagcacaacaaacaaacaaaaacaaacactgggaaataagaaggagatattaagagatgatatatttaaatgttagaaatgctctgttgttgaataagcttagatgtgagtggtaaaagattaaatggaagagggagctacatcaaagttactgtacttgggaggacatgatatggtaggatgtggtggggggagagcatgtccattgctggttggcaagtgactggctgcctcagaaaaggatgagggtgggtaggggagatcactggagattattagaacatacgtatgttttcaagattgcttagtttttaaacctcatagtactttgttttcactgatgaaataaaatactatgtgatctttttctaattttccatcttgagtaataagcaaagacattaatgtattttatgaaggctctgactgccaaaattgggacaaattgatggtcttgttggcagggtaaatgagcataaccgtagtaattgtagttctttttattgggttcagggatgacctggaataatggatgtgttattacccttccctgtagaagtgaggctttcgaaaagaggctataagtcaatttgggaggcacaaagtatcagcgctttttggggattttttttttttttaagtagagaaatattttaaatgtgtgatataaagttatgcatgtgcttcttaagcacattaactcaaccagatccaacagctggtctaataactttttaattgtttaaaaaaatttaattgacacattgtaattgtatatatttatgagatactatttgatgttttgatatttacgttgtacaattatccaatcaaagtagttagttatccttcacctcacactttcattatttccttgtgggttagaacattcaaaagactctcttctagttattttgtaatatatagtattttactgttaaccatagtcaccatactatgcaacaaaacaccagaatttattcttcctacctagttgtaactttgtgtcttttgactaacctctctccatccttccttctcccctccccttcccagtctctggtaactattctaatctctgccttatctatatcaaccttttataatagaaaaagattctacatgtgagtgacatgtggtatttgtctttctgtgtctgggttacttctcttaacacgatgtcctccaggcttagcattcacaattgacaggactttattttttaatggctgactagtattccattatgtttctgtatcacattttctttattcatccattgttgtacgcttaggttgattccatatcttggccattgtgaatagtgctgcagtaaatatgggattgcagatctcttcaacatactcattttatttcctttggatgcatacctggtagtgggattgctggatcatatgatacttctatttttaattgttttaggaacttccatgctgttttccatattgactgtactagtttacaatcataccaccggtgtgtaagtgttcccttttctccatatctgtgtcagtacttattttcttttgtctttttggcaatagccattctaactggagtgaggtgtatctaattgtggttttgatttgcatttccctgatgattagtgatgtcaagtatcttttaaatgcacctgttgatcatttatatgtcttcttttgagacctatcaattaaagtcgtttgcccatttaaaaaatcaagttggccaggcacagtggctcacgcctgtaatcccagcactttgggaggccgaggcgggcagatcacgaggtcagaagatcgagaccatcctagccaacatgatgaaaccccgtctgtactaaaaatacaaaaattagccgggtgtggtggcacatgcctgtagtcacagctacttgggaggctgaggcaggagaattgcttgaacccaggaggtggagattgcagtgagccgagatagtgccactgcactccagcctggtaacagagtgagacttcatctcaaaaaaaaaaaaaagtcattattattttatctgttgaattaattttcttatatattttggattttatccctttgtcgcatgtatagattgcaaatatttttctcccattctgcagctgttttcactttgttaatagttttcttcaaggtgcaaagttttttagtttgatgtaatcttattttgtctatgcttttgaggtcttattttaaaaatccttgctcaggtcagtgtcgagaataatttcccttttttcttgtaatttcatagttttcaagttttacattttaaatctttaatctatttttatttttgtatatggtgagagggaggggtttaatctcattcttctgcatgtgaatatctgattttcctagtaccatttgttgaagagactgtctttttcccagtgcatgttcttgacatcttaaaaattcagttggctgttgtaggtgcaaaaatttatttctgggctttccattttatttcatgggtctgtctggttttatgctagtaccatgctgtgttgatatagttttatcgtatatttcgaagtcaggtagtatgatacttccagttttgttctttttgctcagggttgctttggctatttggggttttttttgtggttctgcatgaattttcagattgtaacatttctgtaaagaatggtgttggtattctgatagcaattgcattaaatccatagatcactttgggtagtatggccattttaacaatataattatttcaatccatgaacatgtactatcttcccatttattgatgtgggaagataatttctttcatcaaagttttatacttttcagtgtagagattctttcacttccttggttgtttatttctaggtatctttttttttaaaaaagtactataaatggaattgttttcttgatttttcacatagtacaatattagtgtatagaaatgctactgatttttatatgttgattttgtgtcttgcaactttactgaattctaacagttcttttgtggagcattttgggttttctatctataagatcatatcttctgcaaacagggacagtttgacatgcttctttctaatttggatgctcgttacttctttctcttgcccagtttatctggctagaactttcagtagtatgttgaatagaaattgtgtaagtggccatcctttccttgttattgatcttagaattgatctcgttattggtcttttcccattcagtatgatgttagctgtggatttgtcatatgtggcctttgtgttgaagtacaaactttccatacctaatttgttgggtttttaatcatgaaattatgccacattttgtcaaaggcttttaatgcatctattaaaatgatcatacagtttttgtctttgttaatgtgtatcacatttactgctttgtgtatgttaaaccattcttgcatgcctctgatcccagtgatgaatcgcacttgaatgtagcaagttatctttctaatgtgctgttggatttggtttgctaatatcttgagaatttttgcacctatgttcatcagggatattgtactatagtttcctgtgttgtattgttatctgattttggaattagggtgatgcttgactcatgaaatgagtttggaagtattccctttgcttcagttttctgaaatattttgagaggaattgatattggtttgttaaatgtttggttgagttcagcagtgaagccattcgtttctgggcctttctttgatgaaagactttattactgattcaatttcctcacttattattggtctggtcagattttatgtcttcctaacttaatcttgataggttgtatgtgtcggggacttcgttttttctatgttatcaaatttgatgaaacttgttgaaaaccaactctaaattttgttcatcttttgaaattatttttagtctctatttcatttatttctcctctgagttgaattacttccttacttctaccaactttgggattagtttgttctgttcttttttttctttctttctttttttttgagatggagtttcgctcttgttgcccaggctggagtgcaatggtgtgatctcggctcaccgcaacctctgcctcctgggttcaagcaattctactgcctcagccttcctgagtagctgggattataggcatgtgccaccacacctagctaattttgtatttttagtagagacggggtttctccatgttggtcaggctggtctcgaactcccgacctcaggtgttctgcctgccgtggcctcccaaagtgctgggattacaggcatgagccacaatgcctggccgattagtttgttcttaattttgtagtgccttgaggttcatcattaggctgtttgtcagaaatctgttgtcttttttgatatgggcatttaatactataaacttacctcttaaaactgcttgtgctatgtttcgtaggttttgttatggtatattttcattctcacttgtctcaagaaaaattttaatttcctttttaatttcttcactgacccattggttgtttaggagcattttgtctccatgatttgtgaagttgtcagtttttctcattgttgatttctagtttatttcttttctttctccttccttctttccttccttccttccttccttccttccttccttccttccttccttccttcctccctccctccctccctccctccctccctcccttctgtattgctttgtctcccaggcccaagtgcagaggcacgatcttggcttactgcaatctctgcctcctgggctcaagcaatcctctcacctcagcctcccaagtagctgggactacaggtgtgtgtcactgtgcctacaggtgtgtgtcactgtgcctggttaaatttgttttttgtttttgtttgttttgttttgtatgtttagtagagatggctttcgccgttttgccatgttgcccaggctgttctcaaattgctgggctcaagcaacctgcccaccttggcttcccaaagtgctgggattacagccatgagccactgcacctggcctgatttctagtattataacgctgtggtcagtaaagatacttgatattatcttaatcttttaaaatttgttaagacttgttttgtggcctaacatgtgatctctcctcaagaatgttccatgtgcatttgagaagaatgtgtatctgcagctgttggacggaatgttctgtaagtgtctgctaggtgcatttggtctatggttcagcttaagtccaatatttcttgatctctctgtgtgtgtttgtgtatgtatgtctagataatttattcattattgaaagtgggctgttaaagtctcttactattattgtattggagtttatctctttaggttgaatatttgctgtatgtatctgggtacttaggtattaggtacatgtatgtttataattgttatatcctgttgttgaattgatccctttatcatattatgaccttctttgtctctttttacagtttttgacttaaagtctattttgtctgatatgagtattgctactcctgctcacttttggattctgattgcatggaatatctttttccatttcttcactttcagtctgtctttaacggtgaggtaagcctcttttaggcagcatgtagctgagttttttttccagtcctgcagctactttatatcttttcattagataatttatttacattcaaggtttttattgataagaacttatttctcccattttgttacttgttttctggttgtcttgtagattctcagttcttctttctctcttgtttacctctgtggtttggtcattttctgtggtcctaagctttgttttccttctatctcttgtttatgtatctgttgtaattgctttctttgtgggtaccatggggctaacataaaaagtcttgtagttataataaactattttaagctgatagcaagttaactttggtcacataaaaatactctagacttttttcctccgccatccctaatttatatttttgttgcctttatttctttagtatgtgttccctagccattgtagctgttgttgtttttgaccagttgtactttaaaccttcatctagaggatcgacaggtttacatagtaacatgatatcactggggaattctgagttggatttatacatttacctctattggtgaggtttatattctcacatgtgttcatgatagttatcattttttcatttacagctgtagcactcctgtaaacattgcttgtaaggctggtgtaggagtgaattccctcagcttttgtttgtctgggaaggcctttattctcctccaggatagttttgctggatatagtatcttttgtccttggccgagactcgtttttttttgttcttttagcatcttgaataaattatccctttctctcctggcatacatcagtaatttaatgttactgatgagaaatctactgatagtctaattaggattcccttacatgtaacttgatgcttttctcttgcagattttagaattctctgtcttcaacttttgacagtttgactataatgtgccacagagagaatctttttgggtttaatctaattgggaatctttgtggttccttcatctggatgtctatatctcccccaatatttgggaagtttttagctattatttcattaaataggttttctgtgcctttcttcaacttttctccatctgccagttctataatgcaaaaatttctttgcttagttttttttaaactttgggttatttcacaaaacctattttcagattttgaaattctttcttctgcttgatctggtctattcttgaagctctcgattgtgtcttttattcactgcattcttcagatttctgtgttttaaatgatagatcttgttttaatttctcattttataactttcctgatttcattgggttgtttgtattctcttgtagcctgctgaatttttttaagatcattatttttaattttgtttcaggcattttataaacacccttttctttggggtctgttactagagactcactgtgttcctttggcagtgtcgtgtgtccttgctttttcatgtttcttgtgacatctgcacatctagtggaatagtcacattttccagttgtatgcagtagctttcacagggagagacttttcctgtagatgggtcctagagtgttggttgggtatggtacattggctttggtttggggtggattcagtaccatggtctctgtgtagtttcgtcagctgtaatcttcacagcaatgtctgatttcctcagtggcctaggctgcaggagtttttgatggtggtatagttttgctagggacaggcatgtcatgctagttgtcaggctggacacttgcaggctcggagggctgacaagctgtcttttgggctccccagggaagagaaagtatgattttccagcttttcttctatgtttatttaaaactttgttgtctggctcacagtgttctttatctaaagtctagccagtggtggtggtcatattgcaatcattattacagcttcagactttctagaccttttccattttagtgaccttcagccttcattcgcttccattcatgaccacagaatagatgtagtcatctctattgaaggcaaacccatcccatctcttcagcttcatctagaaatttgtttcatctgttacactttctttctttggtttttagccttcattctctaccagctctttcacttaagcagagatatgttcaagactctcccattctaacagttccctgccttgatcctacaagcttttctctttagctgctaccttgctttttatttttatttttttctcacttgctctgataatctcctagaaaaattggcttactctgaccatctccattagttcacctcttaattattcttcaaccatctgagacctggctttgttctttctctactgaaactcttcaggcagagattagcagaagtcttctaattgctcaatgaagtggaaattttcagtccttattttctgtatttctccttcatttgactttgacttaactctcttggtttttgtaataccaccagcacctagtttatcagtctctcatgggaacttcattctatctgcctgccaaatggtggagtcccaaggactgtggtctgatctgctgttcctcattacatgctttctggtcagtattgcacactgtggttctcatctaccatcatctacctccagaagtgccatatatttagtaagtttacaagaaaagcaactttccttgctccgtagactaactctgatcttttgttccctatcatggttatggaactcactaattattcagcatcagctgtcagaatgtttaactttgctatttaggtttgtgtaagttatgggacaataactaggataactagaattagcttgtagcttatgtgggttagataatacaattgcatatgtaagtagtgaatattttggcttaataagtgaaggagtatttaggaagctatctggaatgttatctaagtcaggattctgaaggtaactctagcctcactgtcccttactcactatttctaaacacccaccaatcctgcctactttatttacttggtatttctccaatctgccatccttctctgtccgaccaatcactaccctagctcaggccttcaaagtctctcacttgacctactccttcacctcctttgaacctgtgcacaaatgttagcttcttagtaaggctttctctggtcacctgtataaaattcccatctgctacatacttcctggttccctgtattgccttatattcctcagtggcatttatctccttgtatactatataatttctgatctctgtcctttctattaccaccccacttcaagatggcaaggatttgtctgttatattagtgactgtcctaataggaaaaaaaatggcacatttatattagagtaacttgagaagaatttttaaaagtcagtatttataaagctgtagatatagagatagtgaagtactcttgggactagtaatcattgggcaggtgataccatttttaagcccaaaagggcatagtgaaagagcaggtgcctgaacctggattcagagagactatgtagaggaggccactaggcaggagctgtggcctttgcctcagcttggctgattacctcactaatcctcactaatcctaaattacccaagttccttcttttctggcccatttcacagtccaaagccaactttaagccagagggcaaggggagcacttgatgcagtccatgcagtatggcctcccagtgaacagggcaggtggaggatagaaactaaatctagatggaggagagggaagatattcagaatatgttttttctttactgtcagcaccttgaagagtgcctggcatatagataatatttattgaatgaatgaatttgttactggtttactggcctcatgaactttagttttgcctattctattataacttggtgactacattcctatatacttgataccaactcctcattaactacaaaggcagtattcccctctccccctttttaaacatcaaaactcttttttaaaaaaaattcttaaatgaatcgccagtatataacacataaaagtatgggtgccttgattggagtggtgggtaaatgatcctgagtctgtctgtttgggttccctctttgcctagcaggaatgtgactgtcttgtttaaagcccactgaagtagaaaacaggatgagagacacactcttcaacatggcataagatttccatgcttggctcctgcctatctctgcatcctcatttctcagtagtttcctcatattttaccatcctgtaattgaaagaattacaaaactagttctctacacaagctttcttgctgttccagctgctgggaattagcttcctttgtgcttttttttatttgaatgattcatgtttacattcattaaaattaatgaagattcattacagttgttttctctttaggcataattggatctcctatactgagacattgaatgcaactttgattgtttttttcccccattatatgttaagctccttgaggttcttttcaactttgcgttattccaggatttctatcgtaagagttaaggttcatccacttctctgatgtgaggttcatggcaggaaggttccatgttgctcagctgcagagtagaaaatactgagcagggcttaaatagattaggatgctgccattataatataaactgtgtttacgaaagagcatcatcaattcagaaaatatctttttcattgactacagtggtgcctgatgatctttctattacaatcttaaattatggtcattttaattatagaatcatacatgggtttatttatgttaaaataaggtaattatcaagctagctgtgacctatgagaaaaatcctgaagaaatgatgaagggatcaggtgactgtttttgaagtcaagtgtgaaaggtcagaccactctgggtcatgggaccctgccaaggcagagcaggtcaagtgctgtgcccagtggggccaacccccagtatggtgccagggactgggtgtgagaagtcaaaaattaagaatacacctcagaaaggggacatggacagatgccacagacttatttgcgtatttcatgatttagcccttagcttgtgctgatactggatcagatattttcagagttcagtattttcaaaagcatcgctgatcacctgttggcattgttttacatctcaaccaaggaaaaacttttgggacatctgtttaacaaggggtaagcttttatttgaaatgttcgattaaagcagaagagtcaggcatttttttgtgcctccccaaagaaagatttgtttactgtcctgtgtgaataaatataatgtcattatttcccgtaaaggaaaagctgatggggagagtaagtaatgggtaagattaggcaatgttaagctcatatattagtatgtttaagagtgatcaatttagggatctctgtgacagagatgccaaatgctcacagtgctatctcatgttggaaacatgtgtctcctccacttttcctcagtcctctgaaatgacggccctttagggattgacagatactatacagatttctgtgctgatatgtgatttgtctaaaacaaaagtttcacaaaacaattcttaccattgccatttaagagtcactctgatatgctctgtttccattgcaaacaaatgctcattatgatttgtgaaattaacttcacaatttcctaatggataacaccttgaagtatgaaaagcactacaggatcttttatagcttccctcctccagctctctataatctgctcccatctgtggtgtaggaaagatttcagcagtggccgctgaaggccctaagatcttgtctcaacagatagcaaggtgcataacagactttggacaggttgtttaacatgtctgagttactgtttattcactggcaaaatgaagggcttatattatattgtctctaagtactatcagttctgaccacctatgaactttcattttaaagaaaatacctatttctatggcctttaggcattagggaattttgtcaaattaaataaatctcagtaaggtttgatggtcaatggggcccactgtctggtgtgtgtggaggggtgttgtattttacatcaggaacttcagagccctcatgaatttctaattagaggaaccacctgggaaatataagtcaaagccctttgctcgccttactcagctttagggcacagtgactagaggtgggcaatcgctttggtgtaggtattgtcattggaaaggaagaaaccattttctggaggaaaagaattggttgaggctagctttaagcagctatttcatgatggacaaaaggactagctcatccattcttcattcgtttctctgtatcctctatcaaatttctgagtaaagattttatacaatgcttgattagcattcaaatagtatgtttcaaagattttaaaaaaaataaaactaggcctttgaatcataattatggcttataactctatttttcatatacttactatctcaagttacaaatttcatgttatgtttttttcaaaagagtattcctgccacaactcagagctcagctgaattagagcagtgactagaaaatctgagaaggctgagcttcaaaataaggtctggaaagtgtttcttattgttacaagagagtcaaaatgattttcttgagctttaagtttatgtaagtatttacttgacacttagcagtttaaaagataatgtgcaaaaatatgaaaatgagaaaaaacaatttcaaaacaagagttggtgattacgtgagacttagtagagcaaagtatattctaagtattaatctgtctaagctgtttgggaacagatgtacgtgaaatggataccgggtgttctgttgtgtacaccccaagtgagacatctgttggtagactgtgtggtcagaaataatggaagcaggggttaaaccccaatatgacctattactcatgtgaattattgaaggactaattactcagtaaaacatgatgctttgattcatcagtctacacgttaagaaaaaagcctctttagaaaaaaatttagttctgtttctaagctgtcaaatttgaggaaatttttaagatgtatgcaaagactcaaatttccatagtaactgcaaatactatctgcttataaagttttaaaatgttttgacaggtctactaatttatcataaaaatagcctcaaaagttttagctttttgttagggtaggttgggtctcacagaaaacaaatgtagagtgaattttctaaagcagggctgtccagttagacttcctgaaatgatgggagtgcactatatctgaagtgttcaatacagttaccaccagctacatgtggctattgaacagaaacatggctagtgtgactgagaaactgaatttttaattatatttaatttttattaatttgaattcaataactgcatgtagcaagtggcaactgcattgtacaacacagctctgacacatggagagttgaaaatgtttgtttactttcttcccaagttttcattttagtctttgtttctacatagaaaggaagatatagcttttgaaaaatgaacctgaatgtagaactgatatggttatgcaatttgagctgcctatttaaagataaagcaactgagtttagagatttcaaagtggcagagtcctttaacatatttcgtgggctggccacggtagctcatacctgtaatcctagtactttgggaggctgagatgggaggattgcttgagcccaggagttcgaggccagcctgggcaacatagcaagaccccatctcagggaaaaaaatatgtgtatatatatgtatatatatatatatatatatatatatatatatatatatatatgcatacacatatatacatatatacacacatatattaacatattttgtgtgtacaaaaaatatttttattatgtgtagattagttggttactagtaaagttgaagtcttgtctatagaaatcattgtatttttcatggtcattgtgatacattgtttgaactgaaatttggcaaattcaatctgtttcttactacaagaatagtacatagatttgaaatggtaactctcttagtctgtgtactctgaccctgtgaacgtctggagactaatgttattcctaaatatgctatgtccacatggcagcatctgaaggcaaacactttttaaaactgatctacttttgtggacccttcctctctctctttcctgcatcccggatggggccctctggggctggaactggcacagaactattcccctaggagtgggttcattgaagccaagggacacacaaattgagaatcagatagactggaccaaggtcattaaaccagagagggcaatccagatggggttgtccaaagtaggaagttctgaagtgaattgcagaaatccaaacatggcaaagctaaaggaatagagaaccagggcaatggatatagagaacagagcaattgggtatgcaggaagatgctattgcctagactggatgtttttgtaccctctgtaatttgagaaaatggaccgtccttgttgaaatggtcagggatgtagtagataaattcattgcagttgtgtaatctcagcactagaatactgatcataaccatatcacttgttatcccacctagcctgccacttgattgggttattagattacatttcagacattgacaagtctacaagcatcattaaaatcctaaacacagacttctgaccgtattcctacccaagttttagaagcactatgccaatgacgggggtagtatatgctgagcaggtgagttttgattgtgtgtgtctacatgtgtacgtgggtgtggtgagcaacaggaaggaactctcagccatgactctaaatgctcttgtgttggccaaaattggtataagctaggaggagaaacacaaaggagagagaggcatgaagttgaaggacattaaaccatttgcaaacttttggcatgcaaaccagaatatgaggaaacttagtgtaatgggtgactgaattcagaggtagacaggcaatcaggaaggtataggcaccaaaaatagttaccattggtgagcgtttttgtttttgtcattggcatggtgttatgaacttatgttaagcctaagggtaagtctaaaataatgtaccagctggcatcagggaattcccatgtacattcctagattttcattagaaacagtgttctggaaactaccactgctgctacacagcagtgcccagtgcttgactgaaaatagtgaacacttagatttgtttactctgccaggttctgtgctaagtatcttatcttgtttaaccttagcaaagaaactatgtagtctagatagaatttttatccctagggcccagaggtgttaaataacttgcccaaggtcataccagtaatttcagttgctggggttcaaagctaggcagtctgactccagagcctgcactgtccccatttggttatgttgcttccccagttaagcaagcaagagtctatctgacatctgagttggtggtagtaaagcatcatggtctgaaccaaaataataaaaacctttgaaacaacattatctgacttctttcaggcttttaagacagttccatcatcaacagcttattccatttctctggccacttccagtttctgaacaaatgaagaaaatgggagtgataaattggagtttttaacaagtttttttaaatctaattttttttatggaaaccaccaaacatacccaaatgtaggaataattatgtaataagtcctcatgttcaaccctaagaggggtgaagctctatgtgacccattactgagtttaaacagttttcaatttatggccagtcttatttcatctatactctacccacatcccttcttcccctggaatgattgaagtaattcctaggcatcatataatttcatctgtaagcatctcagcatgtatctctaggagataaagattttctaaaaaatcatattactactcttcaaatttaaaataatctttatagttttacatatccagttagtgtccagattttcctgatattttctctattttttaaatatgtcaaccttgaaatgaggtccatattatagctgatggctatgccttttaaattttctcatccacagattcttcttccttttttttcctttcaatttatgttttgaacaaactagtttggcctatagtttctcatgggcaagaataaccttcagactgggatggccatcactctgatacccgtaaaggggatgaggcaggttggggaagggagagcctcagaccatgatcagatgtcacaagatttttgcttacctagggtgaggacttgggaaaaagattgcccattaggagtcctgccttgggcaaaagtggccaaacttcagctgtgctgtcacaggctgtgggctgccttggaaatgtaggacctcaactcctctgaagttgaggtggagcttgagggtacgaatccctggtggccattataatgactacactcattgggatggcatggcaagttcatcctcaaagatggatcctagcatccaccatgaccaatgaggtttttttattgttatgatcactataaactcaaggatttaaacctattaaatgtttttcaattcacagcaatgattatttttactgatcttcaaattgtcacattttggatttttagaccaatgggagccccttcatcttgacttctgagttcttttgacattcactcagctgtctgatagcttccctgctttctggaatggcaagatattccaggttcatcttgaacatttcatgcttgagatatggaatcaagctcatcatcagagggtcctggttccttttactggatagtggtattagagacctcaatttgagaactaagcaacatcattgctaaaacttcccctatgtgtaccttgttacttaggtttttcaaagaacagagctagaaaatatgttgggtttttttgttttgtttttaaagaaaaaatgtatcataggattatgctgatacttccaattcaagtgcaggcctaagcttttcacattgtctcttttctcctacccttaaagtcctgattcctaactataacaacatcattactcatttgctttatcctgcattatgtagacacaatagagtaacaacaccaatgctgccaatcaaaagtataattactgaaacccacttaagatagtcctgcaatttttttttttgttcatagagtgtacactactagggaggtgtagtcaaattactatgttttaaagacacttggaataattcatatctgtgaagttatacccccaacttatttgttttttgtattattgtttcattttgcttttgatgtttaggcatttcttttttaaaaatcaattttataattacgtgaaatacttatatggttccaaaatcaaatctactaaacaaactatattctaggaagtatagcttttatgtttcccttctatgcttttccttccttcctgtaggtaggaaagcttatttgttcctcaaagctctgggttgttcttttattttatataaataaacatgtgcatatattcttttcattacccccacagtacccaccgtcttaaacacatgtacaatatatgtgtttttctaccttgatttctttcttacttagcaatatgcccagaagttcactctgtagcgctttacatcagcatcaaaatccattatgtactatcgtttattgacctctctgttggagaaatttggattgtttctagtcatttttgttatcgcaaatagtggtttaataaaaaactttactttccgttttttgtttttcaatgtgcttttaggatagatgcctagaagtgagattgttgagtcaaagaataaatgtgttaataattttgctcaatattaccaaattctttcaaaagggttgtgcaattttgctttttaaaatcattattgtataagggcatgtatttcctgaaaatttctccagaagagtttattgccaaactttaaaaaaacagcctgatacataataaatgatatctcagcatagtttaaatttgcatttttcttgttaaatcattcatgtttttactgtagtcctcctaacatttagggagcaccaattatggggtctctagaaggttccaggattctgtaatcaatttgacatgatttctgtcttcagatattcacaatcttcaggaagatatattgacaaaagaataactacatgatctattttgtgtgcaacttagtacttacagagcattataaatgcacatggaaaaataggtaaaggagaaaatcattctctgttgggcgggctgagggggaagtcaggaaaagctacagagaggttcgagggtaaactttaatgtgggccttgaagtatgatttggagttagcaagacagacaaaggagcaaggaaaccattctagaaaaagaaaattttgaaaaatctccagaaaaggatgctttggcctatttggaaaataacattgtcttatttatgggggagatgacagtgctttgtttttagtcagtagtttatacaggactttgaatagcatgcaaggaagttggcgtctcaacctgaaaattgaggaaggtgtgacaaaggctgggcattaggtgagatcaagtatttctgtttttttttttggtaaattaggtagcaggatagattataaatgggctccacactgaggagcccagtgtgatggctgatccagcagatcagggggcagtggctgcaaagctgggagaatggcaaggtaagcctggatgcaagggatattgtcaaagacaaaatttgggggatgtgaggcttaaaagggaaataaataatggtgatggtgagatttctagcttgggcagtgggatagatagtagacgctgcgcaaattcgtttttaaatcagcagaatgagaagcatcttatttgaaatatattctaccaaatcttagcatcaaatgtgctagtgactagcaaaatatgtaaacagaagggaagtagcttgaaaagtacacaaactggagaaattgctcctgaaggactgtaagttgaacccttttaagcctaagatctgtatttcctatgagccctaggctctttccttgtgtatcctgtttcttattagagtagaggctacttaaaaataatcatagtttaaagcgctctattttcagaaaacattattcattagatgttagtaaataatgtaatctttatacattcataatatttctgcattattggagtgtaaaaagtcagtgaaatagtcatttgtaaagatgtcagtttttatctgtggaaaatagctgttcataccattttaagcttaaaagttcttcatttacttcttaaaatatccatgttggtattattttgtctaatacaagtaattaatatttaccccaaattaagcttttaagtttactaaatgttacaaacataattcaaagcactgtttagtgtccatctgtgcaggaaaaataagatcaatacaattgagcagctgttagcatgtattggtttccttatattttaagtatgttttcatgttttgaaggtgtaaagggatgacagtatgttttgttgtggttttcatcatacagataaaaacttattacagttgaaatcttggtgaacataatacattttaaaatttccattcctcacccatttatctagatatttagacacagtaaaataaataacatggatacatttttgtcatgtgatttatgttttttaaaaagtagaaataaatttctctaaaagttatttttattttttaaatttagcatttttcatatttgaggaaaaaacaatatgtcttggtaccctagcttctgaactaataacacacctgtcattttacaggttattttaatgtttttcattgggatcaaacctactctggaaatatctcatgggtgagctttatttttatgaaatgttcttggcacttgaagacctttgtaggtacatgccagactcatcttacatccagttcttctgcatggaaaatatgtgcattgaaattctaagtgccttttcaaatttgaccttcttagagaataatatgagtcccaacaattaggaaaactatggaatgccttttggcctttacttttcaaagattttcagtcagtaatgtttaattagcattcattgtgtacattgtccttttttgtgtgatatggctagttccaaaggaatattctagaagatctcagccttctgctattgaaggtgataatacactactaagttatgtgttgctttacattaaaataatgttgcagcagttacttattgcttaactagcgggtataggacatcaggttgaaataactgattttgaagtgaagagttcttgtttatatcttaaactaaccaagtatgttcattaactttgagaataacaatgatctttttcattattcttgagtagactggataaatcagaaaacccatgttagaggtccctgtaaaaacttcagtcttatttggtaagtccctttataagagtttcaataaaatcaggtaaatttaaactctgaaaattctacgtactgtctatcatgttcaatttactgttaaccagtactatgcactggaaaaaatttttttcaccttaatgagaccactggtcattactgctgctactgatgctcttttgtctgcacatactgttgcaacataatgtgttgtgcatttgatacggatattatcatattgccataaggagctgctattattttagacaccaactgattccatgatagtgtcagatttctttaacatatgcttatgtttttgtacaaatgaccccaagaaacatctgctagttttgtggtggtatctactgtttcttttttagaatttgacctgtcagtcactttttaacgtgaatctacaatatttgagttgtattcctttctcgtttttatgctattgatattaacaaaattgagtcagttttatggcataattcagagagaaaccgaagctgtctatggatgttattttaaaaatacctttttcatgatgattgtgcctttaaatttttgtcattgattgacactttaaaattgaaaagtgcccttttaatggatcctttaggttccaaaatcttaagttgaaaatttctgtctattggtcctgaaagtactctctgaatttgataagtatgtagtagttgtggtgtatccttggtcagtttatatcctgtgctaattgctaatcttacttagtttctttgatgcgtgtgtgaagacaggcaaagaaaaaggaagtggaatttctacaaaactgtgaaatctttactttatggagactagagaaatttctaagtaaaagaagacactcattctattgtagttaggatcccttcttttacttgcttttcatgatcttgactgaaaagcaacaattgagatttccattgcccgacgctttctcttctgcttttctttttgtttctcttgcatttttaaagacagctatttattcaaaaacaatatgaacttttatttattggacttaaacctggaacatcaacaaaacaaagaacaaacaaaactacctttccaaatttattttattagaggatgctatcaatacaattttgtattatgttcacacttgataccaaacctaaacccaagaaagtgtgtcctgtgttacagcctatccctctgtttaagataataactagaacaatttacttttattttctactcatctgctttctgtgtatcagctgttgtcctccctcagcctcgaagcatgtcatcatttccatctccgtgctcattcagtcatccttgctgctcttagtcccctttttgtcccttgggtgacttatgtcattaggacaaccttctgtccccacttggctgaaactgagctgaggcccttgccagttgcattaggtgtggcacctttcatggctcagtttgggcctctgtgatatctgtgtgccttctactccaaactccattctgccagaggtggcagggtgactggaagctttagtttcagtgacaaaacccaagcgtggctatgctgagtgtctaagtagctttcatttaggcctgaaataggagagtcaggcgcctctgtgtcccctgagaaagagagatttccctcagctctctgggcccagcactcaaccatttaagtcagctggttagtataatttccctaaattgtggtttagtttccctatgagtaggactggagtaggaccaagtaaggaaagtccctagtgacctttctgcctcctgaggagcaggccatttactttgagttgtagcttcccatctgtctgtccccactaccctatccaaggccctggaggagccacaggatgagggaggagattcatggaaaagcgccttcaggtactgggtatgtctggagtaacatttaaagtttaaaagactctttaacaattttcctctgatacttactactgcctatacttgtttggttttagtacagtaagttttgcctatcgtgggggtgaagaaaatagaaatattcccattaactttgtatggtgcttggtatgacaccctgaacaggtgcacccgtaattgtttacttgatgttctttttaataagtcaattatatcatcggaaattgaagaatagcaaagttaatttgtttaatcattctatgggaactcttgcatgctcgttcactagaggaacattgcgtttctcccttaaaggacaaggctttgttttgtttttaataagacacactctttataattaaaacaaaatcccagtgttaagggatttctgttttaaataattggatttctttcctttgttcctctaatccctctatatgagaaaaaaatctaatggtgtcttaggataaatatttttagattaaaaagttctcttaaccactgaaatttaataatacttctcaaagtttatggatgatatagaatgtaatgtaaggttgagaattttagatttggcaaaggcaaagatacaaaaactagtgaaaaacaacaaactggaaacacttttaaaatactgatgtatttatctttgcaataaattattcagaaatataaataaactcactatttacatagttttatttaaatttgtcctcaaaatactaaatttagtactatatattttcttctttcagataaatgctttcctgaaaatggtattttaatatctacagatggtttagtttaacaatggttggggtaaaaatgacatagggaaaagcaaaatgtgacagcccagcttggttacctttagagaaactcagaataaactctattcccatttccttctctttcccctttccatactcgagagcccttttctgagactcttaagtcatgtttgggccttggagaggataaatagcagggtgggtggtaaaaggggagagtgctttgcttgaggcaaagttttcctccatatgggaccttcctcaagccctcccttcaaaccctttaaatgagagcatgagctcctaggacagaggtcatgtggaaagcagcattagcatgaaggggggtgctgtggaggggtgtaaggtgcaaaaagcagcattagcatgggggaaggtggggtggaggggtgtaaagggaatgagatgtgaagtggttaaagggccatttttctagttggcctctgggctttgatgaaccttttccagtgtgcctgtttctccacttagccctgggctaatcttgactcttaactttccaggtgtgtatctatgctgatttctcctgggtttggaagctctgagaagctctggttctagttcaatcacaagacttttaaagaaccagaaaaataaaacaattttttaaaaagtaatgaagaaaagacttttaaagaaccagtgaaaacctgggagtaaaaatatagaagacttgagaaatttcatctttacctttcaagtgggcagcatgagaaattcttgtaaatggtgctttcaaatcttacacaaggttctcagttacctttatttgtactccctagactgtattgcatcccttgctatgttgactaattcccacctaaaataattcaatggcctcccaatataatctggcattctaattaataagctaagaaattatttggtttttcactcattggcgttaaatattcttcagtgcccacatttggaaatattggaacacagaaatgaaaaaagatacaatcagtttctctgcttgccatgttttccttgatatggcaatacgacaacaggtcaccctttgaagaaaattcagagatgctaaagtagaaattaaaactgaagataagtcaaggcaggatagtataggagtctgctacagctgccatagcaaaatactacagcctgggaggcttgaacagaaatttatcttctcacagttcttgaggctagaagtccaaaatcaaggtgccattggggttggtttctgaagagggttctcttcctggctttcaggtggccaccttcatacagcatcctcacgtggccttttctttttgcctgcatggatagagatctctggtgtcttccttgtaagaacaccagtcctattggattaggaccctatgctatgacctcatttaacctaattaccctatttaaggccctgtctctaaatacagtcacactgggggttagggcttaaacatattttaggggaacacaagtcagtccataacacgtgatttgctatagttttcctttacctaaatcttttccaaccttgagagtggattttggccaggtgtggtggctcacacctgtaatcccagcactttgggaggccagggaaggtagattgcttaagcccagaagttcaagatcagcctgggaaacatggcaaaaccccgactctgggggggcagggggagtgggggaattagctgggcttggtggcgttcacctctagtcccacctactcaagagggtgaggctgaggctggaggattgctacagcccaggaggcagaggtcacagtgagcagagatcacaccacttcacttcagccctgggttacagagtgagaacttgtctcaaagaaaaaaaaaagtgggttttattcttccccttaaattcctattaatagtgaggtgaggcttcttgtgttttttttttttttttccaagacaatggttaatgtgtgattacttaaaaatgatatataacactaagaaataaagaattgttaagtgagaaggaacatattaaaatggcttggaaagatgggtaattttttacattttaagtaggttttctcaactctaactctgtggaacttggtcaatctaatcagtctaaatatagcacaaataataatagttatatggacaggagaaatagtagccctcaaagatagtgaaatacatctgaatatcactaacaatgtcatgaatttgcttgttctaaagttttctgaaagtatgaattcataactgagtttttttttttttgcctatgactactaatgtttgaggagagagtagtgtcagaaccacccccccatttattacatgtttatttcatattttggtactgaaatcagtgtttattttgtgtcttcctgataaatcttgccaataagtaattaccttccatactgaaaagttcttaggattaccaggttgctgggggcaaccttaaaaggccatgcagaacattgacttaggtggctattaccctgctttattcaggtctgagcatttactttcctactacaatcagaatactgacctacatttaaaagtgcaacactgccctgttatctaaatccactgtgttcctgagaggaaataccagaaaagagggcaccaatattatttttctgctgttcttgatcataagtgattacctttttttttggttaggcattctgcttctgaaagataactgaggttgaagttaatagaactaagattcttatataaaatcataggaaagataattttcaggattattgaatcatattgaaaaatgatataattgtgttaaaagataaggactaaaatgagttaattcaatttggaaatagttaaattagaatttgcttctgtttttgatgaatactgctttttgaaaaatcttctgagtatttaagcttttactactctagtcattctctctaaagtagacatagaagcgtgttcttatcttgatttggtaaggctctgaaaatgcaaagcaacagatgttgtacccagcataattatatgtatcctggaaacacatctttattgagtgggatttgttcttggggaaacaaaaatttggcaaacaaaggacattaacttgctgatctcagcagtaattacttgggttagattataataatcttgtgtaggtggtaactgcatgcatatattacaaaatctaattctaaaatacgtacattaaaaggaaaatgaacttgcgcaaactttagatcatgtatccccttgaagagcagaaaagatctcaatttcattatttgaaagttgtttgaacagctttttggaagaggtttccaggattccaaatcctaatatgtgtattgatactgaggctttggactaatctttgggggttactgccttttttatgcccactgaaaatagagcatttcaaacaaatgaactgatctctgatctttaagcatgccagtaactctttggaacaaatccatagttatttttaccaatgactgtattaaaacagtactttctgtattatctcttccattccaaggccattttaaaacaccctctttctcttctcccaataggtaaagtacgacagagctccttaggactgggttatggagaattatctggaggtcaatttgagaaccactgtgcaaaccatttcttaaataagtagctacaaggttgtccttacaaaaatttctgaagttgatggtgttgcgttttggagtctgaagcttaaataagagtttgtcagtggtcatggtctaaatagctgattactaccaaggtcatctaatttttttttaacacaaaaaaatgttctgagcacaaatgaaaccttcaggacaagacatttatgttttgagaatgttcttaaatgattcctgtcgtgtatcttattttacatatcttaatgatcagcatgtattttttgttgttgatgatgattttataaatgtgctatcacctagtttctaattcctaacagctccttcatcagtagaatattgctgtagcacagttttgccatctgttaagaaaagatggtgactaataagagtggcacatttcagggctggtgtgctatcgcaacatctagtgttttagtactgaggacagtgatgtatgcagtgttccttacagccatggggtgtgggaatgttttcctcttcggcaaagtctgtgtatttctatagctgaactctcaggatccagaggaaaaccacaagatgatgaaaccagatgattgtcatcaaatttctattccccactacatgattattagttttcgtcaaaagaaatactcatcctatcctgggttggaattggtaaagaattttgcattgtgactaggacacctaaaagtttttaggatgagtacaaatggaatttgatagatttccccaaaatgtttgggaaaagatttattcctccctaggaacagcaagagtagcagcatcacatgaggcaactcctggtaattttttcttcttgctcttatttcaatgatatcttttcattcttttctgtatctctcaatttctatgtttctcctcttaatgtatcctgtaaatttcttagtagaacctttttactaatgagggtttcctagtttgctttaggaggcactcaggatgcccccttttgtaaggcagtaaattgaaaataagaacttggtgaaggtccacgtgacggttagtttccattctccattgtaccaaactgctacagggaaagaaccatatttaatcaacctcaaatcctcaatatttaggtcagaaaacacttggcatagaagagacactcaaattttgcagctaaatagattattgatagaaaatatgtttcttgcctctacaagcaatatgaaaccaatacaatctctaaatatcttcagactactaggggcaaatactgtattataagaataattcttcagaaaggaaaatccagctactctcatatcacctctctatgttgaaagctagggaagataaactggcttccagccagtgagagtccatgtggacctagtgctggctggagatccctaatccaaaggcaagagccagatactggttgtctgctgaaaatcagaagatgacctctctggtagtaaggccagtgactcatccctgcatcttttatcctcttctgatttgtataaggatctctcctttttccccagtacccactctcaagaattgctttcctttttaacatgatcataccaaaatgtatctaacagtaccttgatttcctttctgaggaatttagggagcatatttactttgtcagactcattagaggtttggcttcttggtcgggttcttaaatggacaacttgtttgggtgatttggcagagaataggagaagccagtcccctctgatagagcaaacctggggagctgtggttgacccacctgctaactgtcctgtacaattaggcatgtggcatcagtgggtgactgaccagagccaccatctcaatggcggctgttctttccttcctgtgccttctcagatctcttttttgttcttgttactccactatattggtttttcttgagtttttttcaagcaaatatcattattcacttctactgcagttcctctgttgttcgctttttctcttagtcttcattgttttccattttgaacattcagagatccatcaaaaaaagtaaaataacaggaagggagaggtaaacaccagtcaaatgaagtattataatagtgtattactatactctttaaagtaattgaagggtggttttttggggtcagaatatctgttagaatttggaatttgccactcttgagactggggcaagctatttaaactctaagcttatctgtccttcctcacaatctgtaaaatgggatcataataatggcacccagtttatggtgtagtgagcattcactgacacaattaatctaaacttatttgcactacatagaacagaatttttgtctattaaacaatatagcgttttaggcatgaaagaaactttagattaaattaaatatcatttttcttaccacagggtaagtttctgttttgtttgcccctgtttctctaactcctagaatagtttccagcacatagagattaaacaaatattcgttgaatgaatgaatgcatctattctaatcctcttgttttaggaatgacccgtcaggctcaaaagtgaaagcatttccctcaagattggtgacagagttggggactaaatctaaggctttctcttcctacaccagtgtcctttctgagaacacgatgccattttctcaatatttgtttatttatatggtaaattggtaggaagctgtgtggtactataagaggataaactttgataatgaggtatacttgctatcaaattctaacattctcatttaaaacatggcataccatttgtcttctacattttcatatgtaaagtgaggtgatttctaccttatagaactattgtgaggattaactgaactaatctttgtagagcacctggtcccatttattttttttttttgctcaccccaccccccaactttctagctagataacttatacattcactctgtttttcattccttcttgaatctcctgtggccagacttgacccctgtcactctacagcttactcgtcaaggtcagtcctcatctgacttgacctactaagagtctgacaagtagtcacactatgctccttgatacagctttcttcacctaccttcttggatgtcattcttttggttctcctcctaccccattgggctgctttttcccagtctccattcttgggtattctcattttcccatgtctgtcctctgacttcttattgtctctgtttctgttttctctggttggaccttctctagtttctggcttcaaatactatctaaatgctcatgtctttcaaatttgtaactctagtctagacctctcctctgaattccagttttataaatcttctacttaaatattagaggtctaataaacttctcaaacttatgttctacaacaaactccacattttctcctgcagcctctaaatatgtacctcctatagattttcccatttcagtaagtgggaacttcattattctgattgtccaaaccaaaaacacttggagacttgctacattccaccctttgtctttcattctacatccaacctatcaacaaatcctgttgcctcttccttggaaatatatccacgcttgagcagcatcattgtcaccacttggtgttatacactctcatttctcacctggagtattgtatttctcatctggagtagtgtctgtccaacgatgtcccccatcagtctgttctccatgtagcaatttcgtttttgtttgttttaagattgggtcttactttcgccttggctggaatgcactggtgatcatagctcgctgtagcctttaattcctgggctcaagtgatcctcctgccttagcttctccagtagctaggactacaggcacacaaccacacttgactaatttttttttttttttaacttttactagagatggggtctccctttgctgcccagtctagtcttgaactcctggcctgaagtaatccttctgtgccagcctcccaaagtgttgggattataggcatgagccaccatgtctggcccagatgttaattttaaagtgtacattagagcacatcgttcttctgcatgttcagcataaaatccaatgtccttaatgtagtctatattaccctacatgggctacttgtgcctgatccctctactcttatgtcttatccctctcctgctttctcactagcaccagccacatcttaccgttccttgaacacaccaagtatgcatttgccacaggaccttgatgcttactgttccctttgcccagaaacccttggaaccagctatgtgttaaaattcagatatttactgattttagagagctaaaatggggtatatataatatattacataacactcacagctggtttgtggtagcatttcataattaaataatatttctgaatgaaacattaagaatgcccatgctaagagggatgagtaaagactcaactctcattgtcagttcagctgcagaatgaggtcagctcaagatttgctgccaaatgacttaagaaaaaaatgtttttggagctttggggatttcagaattgcagatgagagattctagacccgtacctacacagcatgctcccttattttgttccaatctttgttcaacgattatttattgggtagtcaaggaagatctctgtctaaaaggcttctctgtgtggaacaagactggcatgtggaaggtttccaattaacgatattgaaagagtgaagctcaaatcatttttcactcaaatacatactatttagaagacagtggccagtttaagaataatcattattggaaacaaagtactatttgattagggatagttaacacaaacacttattagtattagggatatgtgaaatacttaatggatgagtcatgtgctgacataaaacccattatccattttagttcctggtagcctaactggttgaactctgttttattgatctattattgatttggcctgtaacttcaagttacattttaatgtaatttcatccttttctgatcaccttgtgtcttcaagcatttttaagcagttgatagatagttgaaagatattatcactatttcaatctaaaagatattatcactattttaatctacttaaaatttttactacattcattttaagtatgacttatggaacgaatcgaaaatacaagatagtgaaaaacttgtgaggatcacctgaaattttagcattcactttccttacatagaggaacttagtctctctaaagaattatgagtaataaagtatcataatgatatttgtcttagttttggttaagtgtactccacaggagaaagttaggcatgagcaggaattattgtagtcccacattctcaaacagttctccagtaagaaagattttatgtgtttccagaaatcattttcctcctcttcagagctttgggaccataattgtatttaaattgctaatctgttttaaggaatcataataaattgtttaacatttatattcaatcaactttgtaatttgtataaatttttcagggtgacatttgaacaatttttaagaaaatgggaaatacagaagtattcttagttttaatatattttaaaaagatgacatgtgatctactgactgaaatccttcaatcatttttgtttttctccccaagattagatagaatggatgtgattttatttttaatttgcattatggagagtacttttggggggttttatgaaaaagacttcatttattttgttagtggtacttcagttgcataagaaaatgttcttttaaatatagtggtcatttgtgtgcagccttcaagttagcaaacatgcctttgagtagtcactatttttgaaggtctttatatctgattgcaatggcttatattcaatagtcctcctactaaatgaaataaaaatggatgcctcttctgccacagaggcacaggtggacatgttggtagcaagccccatgcggtgtgacacatggcacagcccaacatgggggcaaagagcatgcggcttgagctaggagtcactttatggctactttagtgtagatttgtgtttttctgtggaacagccattattgaagacatttatatagtatgatgtttgtttttcattaaatgctgattgtgatttcttaaaaatagttaagacttgattagcagaacctatttagaagccagagttcccctgcttcacctcttgctatctatataaatgatatttttgactctgtcctttataatgttggcaccctgtgcatattagatgtaatcagggctgaaaggaaacttgaatccatctggaagcaataaacttttctaaaagactgcacagtgttatttaatcctgtgacttcttactgtgagtgaaattaaggtttgatgcagttgtgtcacatcgtattgatatcaaatttatctttctaaaaaaaaactgacagtattacagcacagaggagaagatggcttgctgtaatcctgtaagctattttacattgattacatgctacataatgtacctaagtatataaaatacttgatctagaatgtttatgttttctccaaaattttctcatcaggtaatactttctcaacttcacctttagttttggcttcttatcatagtactaactatgcggtagtaattgtgttatgatgaaaggcatggagaagaaattataattttaaaactattataaagtggagacacacttgtataattaccatctatgtagactgccaaggtataaacatttagcttattttagtatcagactctttgaatcaatttaaggctttttcaataaaattggcttcctctaatttctactccaaaatggttaaaattttgttttacttcaaatacgttgtagggtatcatatttcatgtgactaggagcctaaactatatcagctgactggcataatttgtgaattatatgtgtgtttattaaaatttaaagtttttattaagacttacaattttattaagacttaatttttttccttacattttgagtaagtccaactgaaaataacttagagacttaggaaatttgactacattttataagtaatttccttgtaatttttctttcttgtggaaacaattcttactgatttacttaactcttttttcaatggcaaaaatgaaaaccaaatatatttgtcaactatattcttttaattgtggaaatgaaaggttcatatcccccatttgcctagcatattaaaaataaacatgacctttgtcttgaatgttgttaacttggattttaaaaatcaaaccaattataagctatattaaaattgcttatcaccttccctttgtcttcagtaagtctgggcctaaaaatactcatcatatgaataaataaagttttacaaatactttttagaacatcttgaattatatgtgtgtttgaagcttacttttggatgttcggtcaacaaggcttctgacagtttctttttatcttccctctattccctgccactgtgcaccccaaagtgatccctgaccacagtggtcccattgctggcatcaggaaggtagactgaggagttcaggtatcctagaggctgttaggtgaatctcttctacctctttcctggtcctaggaccactggacacttcaagtaaaaataacaattactttaatctctcaggtaaagtttcttctcccttccagcaacacagatctgcctgtgccgagttcaaatactctgaactttcaacagttgttctgaatacttttttgtcatcttatgatcaaatattgagagcattgaggggataactgaatgggcatggtataaaagtcagacttttagtgtttctaagtagcagaaccctttggacaatttagagggctgtgcgatatcctcaccgtgactgctgggaagtaatgggatctgacctgcagaggtactaccttggctgacaataatgacaaaagtgagagcaaagtacatatgactatccttgaggtcctcaggaaaaaaagagtattagtgagttgaactgtatgtaagggtctttaccaataaggaagcccatgcccagacataatccttacaccctggcaatagaaaccatcattgtggtttacatctcatcctgttcctacagtccagcaagttcaggccacaaaaggtttaagcactttttcctttgttctcatagcaacagttgcccatggaggttcagttacactaatattaacattttaatatacacaaagaagtgcctcgaatgtagtaggtattcaaacttgttaaatgaaagaagtaaactttcagacttaccttgaactactacagttttattctttctctaacctctcccactactaccatcttaaaaccaccatttaattagtattttataacaagttattaaaggctttcaaagacctttgaaccttcaccctctggtaagttaataacttctgatatgcgattaaatgtcaactgagtagtagtgggccctaagagctcagagggactgagaaatgaaggttattgtttagaagagtggctcaatgtgcttcgacagttggttaatatttgaaaagactagagtcaagaaagccttccatgtgctaggaaatgaaggagcaaaggtccagaggtggaaatgtatacagtgtgattaagggattttctgattgatagtaaatacagtcaataaaaaacttttattggaagcctagcctgtgtttgaagcattaagctaggtgctgggatacagagattagagatgaagataatgatgaagatattgttgaagtgaattgctgagaagctggagaaagggccaattaccataatctgaggctcaggaggaattggtgcaaagatcatctggtatgatatatatgaactgtatatacaaactgatctgtgtagctgaactgataatgccaaaaaaaaaaagactaggtttttgattaagatgaatccattaaggtcatgttttctgttggtgccattcttggagacctcccccaaccctatacatttataaatgtttttcctgagggactgagatggaagtggacatataaaaggaaaggtctgggcaaatacataagtaggtagtaaaatcaaggaacaaatgatctcaacaaaattgcccttcttgaaatgaatgaaaatgatgaaagccaatcacattgcatgatgaacttggggtatagaatatgaaatatttaaaattgctttatttcatgatgtttcagatgtagtaggaacttgttgcatagatggtgtaaaaacaatctagtaataaaatcttaggtatttaatacaaggtgaagaaagatgcaatgcataaatcatgccattttaggcttaattttcataaggctatgcctgtctttataagactatataccaggagttctcaagctttttggtcttggaacccttttatactcttaaatcgttgaaaaccacaaagaccatttatttaagttataaccattgatatttgttgtattagaaattaaatagacattaaaaatatttactatttaaaaataaccaaaaagatgggcatggtggcccacacctgtaatctcaacactatgcgaggccgaggcgggtggatcacttgaggtcaggagttcgagaccagccaacatggtgaaaccctgtctctactaaaatacaaaaattagccaggtgtggtggtgggcgcctgtaatcccagctactcaggaggctgaggcacgagaatcacttgaacccagggagatggaggttgccgtgagccgagattgcgccactggactctagcctgggcaacagagtgagactctgtctcaaaaaaataaaaaaaataaaaataaaaataacagtaagttcattgcatattaacataaataacatatttgtattaaaaataactattttccaaaacaatcaaaaaagcagtaccactcttctattttaaattttttcaaatctcccttttctaaaaaaaaaaaaaaaatattgtgtaagtttaaggggtacaagtgcaattttgttgcacggatatattgcttagtggtgaagtctgagaatttagtgtatcttcacccaaataacatacgttgcacccattaaataatttttcaacacccacccccttctcactctcttgagtctcctttgtctatcattccacactctgttcctatgtacacattatttagtacccacttaaagtgagaacatgtggtatttgactttctgagttttttcaactctggcttaatagaagacagctgaaatctcagaatgcttcttcatccagtctgttgtgaatatgttgctttgattcaagtatctaaggaaaatacagttttacacagatgtgcagctgaaaaggaaacatcttttaatatgttcagataattgtggatattgtcctttgatactatagcaaaacttatcaagtgctaatttcttaaaggctggttataatttgaaatctgaaaacatatctatttaattgtagtttgctatttgaaaatttattggtctgtcttgtactttgaatggatattttgcccacgtatgattttataacatcctgtattggccttttggaaaatttggtttactattatacagtttctaaatgttgataatttttattataatatattttaaaaagtctaatgtcactgccagtctcatcagaaaattctttgagattagaaagctgttaagatcatcatcacacttacaagttttacaaaattttaattttactcaaaactttatattttatcattgacaaagctctcagttgctttgcttagtgactgactcactttgttcattttccagaaagtgtttaccaaatgctgctgcctcaataccagagtctgtattgtcagttgatctttcaagtaaaaagtggtgttctatgaaaaacagctagttcagctgcgactgaaatgatataagtgtttctcctggagcaaaccaccacttcgatttgtagcagaaatgctgtatgtatactttccattgttattactcataacatttttaaaaatatactcaagggtggagatttttttaaaaataagtgttattgcttcatcaagaacagttaaatgaaactggattttttaaactgagtttgagttaatgaagaatgcagcaattattagtaaaatttggtgctccaccttgattcatactgacactccaggagttttacccactatttcttttgtacctttagtgcaaatgttaatatggtaggaatggtaaatgacatctttagtattattataaaaatcgtttttaccctgtatactctttgagactacacattgagaattgctgatgaaggtgttttaatttatcataagcactgaaaagatttacttaattcaccaatttctcctgaatatttgtttatataaaacaagactatgtgtatacacctacctttttattaatggtagagatctaggaaaattaatttctaagaactagccaggatatttggaatgtgaataaatcatatatccagaaaaaagctttagaagattgtctatgattgaaagtcaaacagctctcatttctattatactgttctttttcaaagaatttaccaattttatgtggtatttatgattaaacatacaccatgtaatttaacatttttaatgtcacttttacatcataggtattaaagattagcatttttattgtctgtattttaaagctcaaagaataacatttaggctgggtgcggtggctcacacctgtaatcccaacactttgggaggccgaggcaggcggatcacgaggtcaggagattgagaccgtcctggctaacacagtgaaacaccgtctctactaaaaatacaaaaattagccgggcatggtggcgagcgcctgtggtcctagctacttgggaggctgaagcaagagaatggtgtgaacctgggaggcggagcttgcagtgagccaagatcgcaccactgcacttcagcctgggtgacagagtgagactctgtcttaaaaaaaaaaaaaaaaaaaaaaaaatttagatttttgactgtttcattgattcatcttagacttcacatgaaaatatctgtatatcctcaaatgcttacattcttaagaagtatctcagccatttacacatgatagaaacaactaaatggaaaaaaattgcagttggaaattcactattttttatttgatccgataacaatgtgacatttgcgattggactgtaattttctgtctttctctctgaaaataagttcaaaaatttccctctaattcttttactagataagaagcctacttcgttgtaactcttgatatatgtatgtatttaggaacttaagcttttctgctaataaatgttatgtcataattcttgaggatagtattatattgtgatgggttttcagtaaactacaggagcagccctatttgtttaaaccctagtttaacctgattattaacaattaaattgtgttttcttctaacaattaaagtgtgtttaaatttattggtcccttgcttcacagatttatctcagtatgtggtgtattcaaacagaattttgtatttttaattaggggattagataaccaattctgaagagccaaaaaaattgttagacatcacattgcttaaccatctaatataccataagtgtgtgtatacactatgttgtgggagccatctatcaggcaggcctgtttttcaggcagtattttaaaaagtggacatgtgcagaaactgtgagcacaattagcgccaagcagataaatccagctctaatcctgtttacggtctacatcagacagatgtgccaagattgatttagacaagcccgaggcttacagtaatatttttaaaagtgccattcgctgttctatttttgttaaacctttgctaaatattcttaagtcttgttggttttgctcttcttattaaccaccgtaagtaacctactttaagcaggtcccgctttgctctcatggtgacaaggtaacctgccaggagaggttatctttattccctgtaattaagttgacttttccccccaaaaaaatacaacaataggaagtgggtgctgaattaaataaatagcatgatacccagtagatgtatacttaagttccttgcaagaacagatggtccccagtatctctgtaagtaatgtgagaggacagttaatgttctgaaacaactagctataaccagtatgatactaatgaaccagtagatttcaaataataaaccacatgccgccaagcaaaattatatgtcattcataaggatttaattatcataacttgcaaaaaagtgtcaatagatgatttctatatttttatctactgatatcaaatatcaatttatgaatagagtttcacttcatattttttaccaataaaggtatgttttaacattaaggtagaattaaagttatatttaaaatacatgccccaaagtatgtggtgatttttttttaactcctcttttactatactgtctgtatgtattgggctgtatatggaaatgtagcttttacatacaattaggaaaacaattgcttttatttctagcagaaacttgtactataacagaagtggctagcatgggaatcagagtagttatcttgtagatgacaactgaagcagacataaaagatgtaatattttttcagcactcaaaaatttataagtaaaattttataaacaaaaagcagtatttttgtgattcatatggaaaataaaatgagtctgagtcattcttaaggtgataccgtaaaggtgtatagataagaagtccatttttaaatatacccaagacaacagttttttctctcagtatggtttgttttcccttttttctctttaattatgtttcccataagtatttgtatattctaagaatgtccaaaaaataaatgttttgcagtgggggttgaaaagaaagaaagacctttttagatttcagctgatcttatcagatgatctctagaaccttgaaccttcaaccttcactgaagttagctggagggcttttcacctggaaacctgagaaacctcagaagccttctgctttagctctctctcaagtctaggaagccagtggcctgcgaccccacagagccagctggtccactcctcatataagaacttcggtaacaatacaaagacatagcaaagcaccatctaatctgataactcattaaacaatatttagatggctcaagactttaaataaaaacattttaagcttgtttatagaatactaacaagttttattcccaaagactatattcagagtgagaaaacaattttccttaaaactaatattatatacatgttcatatatgttaggaactagttatatgcaaaatcaagtgactcttgtgattagaactggtcacatttattcatgtagcataaatggttaatattgccaaaatgagtaatagatcagattttctatgtgagatattgacacctgagagatttacagtgtttcactgttgtgaaaaatggagtgctgaagaacatttgtctattgttatacatttgtaaaagaattcacaaattactaatttcaaataagaactaaatatttcttctaagcctatagtttttctttttaatttcttctaagcctacagtttttctttttaatttcttcttgtaacattggcaaaaagaccattcgtgtgaaaacctcagattttgatctgtacacaaatgcaggagtagagattggaagcttgagctggaaaagcaggaaatactgctcagagccttacaaggattttcagaattttcactgttgggtcctcctggttgctgcagtctaacctcgcatctccttgaaggcagccccagtttctgatgaaatactcttcagttaatttatacatatgctgtcttgctgttttcctaaggactgcaggcagaactgtggttcacctactgttttaaatttggctagatttaaaaacagatgatctcacttatatgtggaatccaaaaaagtcaaacttatagaagcagagagtacaattgcggttgtcaagagctgggggaggggaagcaaggggatgatggttaaaggtataaaatttcagttagacagaatgaataagttctggatctattgtatagcattgtgactatggctaataatgtatacttgaaaattgctaatacctgaaaatcactaagagactacgtcttaaatgttcttacaacacaccaaaaaaaggtgtgaggtaatgaatatgttacttagcttgattttaatcatttcacattgtaaacgtgtatggtactgatcttgtacctcatttcattttccatatgaatcagaaaaatactgctttttctttataatatcttatacagcatagatacaatttttagtggtcaattatattgtaatatatacataaatatatatgattttcattggtcaattatactgtaataaaacagcaaaaaataaagttgtaattaaaaaataatttggaagaaaaaattagcaagtggttggagattgaggaagatgggaccaataagtcctccaaggagagtcatacattagttttttttaaaagtccattattaatcttataatatttaatatgtttaatttcttgacacttattaatccaattaagtatgagaacactgtggataaatctaaaaaccttaaagttgagtaaaataaaccagatacaaagaagcacatactttatggttacatttatatgaagttctagaaaaggcaaaacttagctatagtaaaaaaatcatggtcctgagggaataactagagagtggtatgagggagctttctataatagtgggaaaattctgtatctttattgggatagtggttatgtgagtgcatatacttaaaaaaactcatggaattatgcccttacaaatctgtaatttttgttggtaatttataccttaataaaaaacaaaacagatgacagggttagtgattgtttccttgaagaaggtctttacatgggtctgttgttaacgagttgtagtaaaaatcatccaaaatgcttggattcaaatcttagatctgttcctaccagatgtgtgaccacagacaagttacttacattccgtcttcagtttcttctcttttaggaaaaagcatctagtttttgttgtagagattaaattagataatacaaatgaagtacagagaacagcgtttggtgtgtaacacatgttcattattagctacccttattttttagagaatggaaatttttaaatttaaactaatcaaactattttaggataagcaagtgaaacaatctttttttcaatcgatcacagaaatattttcactgaagacaaattagacatttatataagcaaactacagtgtcattaccattcaaattttcatatgcatattcatgcttacatgcatatgaaagcattacacatatgtattctataaatatatacaaaacagtaatggaaatgtgctgtactattttgaacatctttctagtcagcccggcattttatttacttttgagacagggtctcactctgttgcccaggcttgagtgcagtagtgtgatctcagctcactggaggctggaggtcctgggctaaaggaatcctcctacctcagcctcctgagtagctgggaccacaggaaagcaccaccatgcccagcttatttggtttattttgtttgtttgtttattttttatttttttgtagagatgaggtctcactatgttgcccaggctggtctcaaactcctgggctcaagttatcctcctgcctcagcctcccaaaacactgcaatcacaggcattagccactacactgacctctacattttaatagctgagtagccttctgttatatgaatatacttttttttaacaaaaccaatactccattattgtacatttaggttgtttccaagtttcactcaaataatgcttgggtaagtaagtatttttatttattattattatttttttgagatggagtttcactctgttgcccaggctgaagtgcaatggtgtgatcttggctcactgcaacctccgcctcctgggttcaagcgattctcctgcctccacctcctgagtagctggggttacaggtgcacaccatcatgcctggctcatttttgtatttttagtagagatgggatttcagcatgttggtcaggctggtctcaaactcctgaccctgtgatccgcccacctcagcctcccaaagtgctgggattacaggccgtgagccaccacgtctggcctggataagtattattttagctaaattgtgcatatttattcccttagagtaaattcctggaagtaaattgctggatcaaaaccaggtatattttaaagaattttccttttctacattaaaaataattataattctgattacaagaaaggaaaattatggagcttcataagaaaaaattagtctcatatttcatacctcatattgcatatttaataggtaaccagtgttaaatttgttgtgtgttttccactgggatttctttttatctcctttaataaaagcaggatcagatccctcagattactttgtaacttgcttttattctactttttcatacctcttagcatgaatgtctttccagaccagaatacagagatttcacttactcatttatgagctgcagaagatgactatgatttattcaaccattctcctattgaagagcatgaatattgcttcagatacttttgttattataaatattagtgcaattaacattttaaagtcttttgatacatattcccaacttgttctccagcaattaccatttttgcattcccaccagcactggggctacttccctttagttgcaccatcatttagcattatttttgatcttgtgccaatctaaaaggcaaaaagtggtatcttgttgttttaatttgcatttctttgattactaattagattgaactttttcatttgttcattggtcaatttgcatttcttcttttgtgaaatgcctgcttgggtcttttatgtactttaccattaaagtgtttttcttgattaaatagattatgtaactgtcatatgttgcaaatatttctgtccatttggcctttgcttatgactttttatgagtctttaggacttttgaggtctttattaggtattcaataattttaatgttaaatatattgatgtctgtcttcctttgtgtcttacggcttttctatttaaggttacgtaaatttctaatatacaaatattggtgtatattatgaaatagggccctatttttctttacaaaagattagtcagttctaaatcatcctttgctatttctagcggcgcttagatgccaccattatcacatcagtgaatttttaaatgtgtaattgtttcctgatctattcatttctctattcctagatacttctattgtaatagctttaccaaatatatctgatagggtgtgtactccccctcattacttcatttatttatttatttatttagagacagagtttcagtcacccaggctggagtgcagtggcatgaacttggctcactgcaacctccgcctcctgggttcaagggattctcctgcctcaacctcttgagtagctgggattacaggtgtgtgccactacacctggcaaatttttttttttttttttttttttagtagagacagggtttcaccatggtggccaggctggtctcgaacttctgatctcaggtgatctgcccttctcggcctcccaaagtgctgggattacaggtgtgagccactgtgcctggccccctcattgcttttaaaacattttcttactgtaatatatttattccaagagaattttcaaatattttatgagattccttgtccattccttacatcaaaaaataccacggagattttgattgaagttctattataagtagttacttggggtggggggaggggggagggatagcattgggagatatacctaatgctagatgacgagttagtgggtgcagcacaccagcgtggcacatgtatacatatgtaactcagctgcacaatgtgcacatgtaccctgaaacttaaagtataataataaaagaaaataaagagaatactggcatggaaaatatgtaatcttggaacttgttgtatctccacttattcaatcctttgtctctcagtagattttgaatggctctttatcccacacgagtctagaatcattttgctaagtttattcctagatataatatgctaattgatatgggaattttttttatctccattataccttcttcttgggtgtagacatatttgtagccagcttcctcactgcatattttttattaggcctaatggcattaagtttattattttggattttacaaaaaaaattatgataacatctttaaatagttagtttcaactcctcctttccccttaaatccatcaattactgtcttttatttcactttccttatgtactgactagaatgcctagaataattgaatgctatgagtaataataggtattcttgccctgtttttggaaatccttctggatttcagtaagtgtgatgttggcttttggtttagtatctttaaatttgcaatttacaagatattttacattggaatagtcattgagttgttaagtaaagcacaaacatgttaaattcagactgaagtacaggacttcaatgaaaagttaaaagagtttatttcatcactttcattttttctttccctcagtggctgtttgtcccctccccccaccccgctccatcccccagcttccttcctttgtgctcttattgttctaggtttgactacataaaaagagactctcaatttatatgtgatacaagaccataactaatattataaaattagtctagaagaagttatttgcaacctatataataagggactaatttcaagattatttgaaggactttaaagattggtaagaaaaaaatagacaaccgtttagaataaggcaaagcatgtgtagaggcaactcttaaaaaaaaaaaagtgagctgggtgtgatgatgcacacctgtggtcccagttactagggaggctgaggcaggaggatcacttgagcccaggagttcagggctgtagtgcaccacagtcacacctgtgaataaccactccattctagactgggcaaacataagaagactctgtgtcttaaagaaaaagaaatgaaaagatattcagtttcattaattgtttgactagctgatttttggaaaatacccacaaatataaccaagcctacaagttattttaaggtgggtaagagatacatcttatctatatgcattcacctatgtgaagcggacacccagtaacacccccgtgtggaagacaagcttccttaaacttcacaggacagtatttcccatgtagtccatcatagggtgaggatttttcaggacctttggtaagcctgcttgctttcattcttgagggtagaggaagggtgcaagacttccctggtctctcccaagcattttggggaccctggccataagcctacttgctcaacaggtgcaaatgactggtaatatgctgaccagatgcaagtgtaccaccaatgatttgctgtgactgagtttggtttcctttgcatatactatccagctttttgtttctaatatattcttccttaagggaaccaggacttcttggggaatccagatgagcttgaaacactgtttttataagagaagggctgttttcaaaaacatctatagttcgtaacaaaggagttagattgaagggactctcactgttcagtctgtgacaagcatgagtgttaaaatggagacaagaattttagttaattgtaatgttgaatttgtaaaaggctataacttcataatatgatcaaggggaacaagcaatctaaaatgtgttaaagtagcattttcaaagtgcggtccagggactctcagggttggtgaggtcacaactgtttttataatattgctaagaatgtatatcactctccttctctccaaggatacggtggagttttccagaagctatgggatatgtggcgatagccttgccctaatggagtgtgtgctttgtgctttgcatttttgtcctttaaaaatgcttggttttaattttgaatacaataattatagatagatataacctacataaaccaaagttatttgcggccctcagtctttaagggtgcacagtggggcctgagactaaagagtttgggaattgatgttctagagaaaagtcagtcttactgatgagggttaatcaattagtatttactgaccgggacaggacaaaccattcattttataaagacacacagagcatttcactaaaatacttttactctgattaagtggtgattttagtaatagtaatgattgtttgattttctgatacctgaaggaaaaagagcctgttgaattgatactttgagggtgttgagttttaggtcactgggtgactgtagaaatggaccaggagaagaactgaaacttgagccttctaagaaatagaagaccaaaaaatgtttagtgttaccctatcccatgaccacaataattgagaaaaaggcctttccgttccctcttccctaccctcccccttctcccctaccctctcctcccccctcccctccccctcctctcccctaccctctcctcccccctcccctccccctcgtctcccctaccctctcctctcccctaccctcccctccccctcctctcccctcccctctcctcccccctcccctccccctcctctcccctcccctccccctcctctcccctcccctccccctcctctccctccccctcttctccctccccctcctctccctaacccctcccaacctttcccctccttctctgtccccctccccctccctccctgtcttcctcccaccccccactccctgtcttcctccttgtcttccatcctcccttccttcctttccttcctgtctttcttttcctttctttcctttttcttctttccttcctgtcttccctcctctccgtctgtctccttctccttgtccccttctctctgtcttgcctttcctttccttctgtctttttctttctttctctttctttttcactcttcctttttttaatttcccttttacttgccttctctctttcattccttccatgctttcttttttttagtggtatgtatactttgtgagcaatcagactatagcttgcagaatagttgggagaggccaaaaatgcccctgagaatgcaagcaaggaacttcttagtgagcatatgaacatcctcactccaatcggaggataacattgttcatacttcaaggactaaaaagctgagagagggtctctgctttctgttacttttagcactcgagtcatttctgcatgtatttctactgattactttttctcctattttggttcatatgttttctgcttctttgcttgtctagtgattttggattagatgagtgacattgtgaattttactgtgcaggatggctgaattttttttctattcctgtaaatatttttttggcattgttctaggatgtagttaagttacctggaaaaagtgacatccttttgagaggcttgcttttaagttttgttaggtggaatcacagcagtctttagccagctcactaaggaccaatactcttctaaatacttaccataatgtcatatgaatttccatgtttttccacttcagctggtaggaacacctgtgtcatctctaagcattgtactgttaattcttctagtagttcttatctggctttgtacatctgctgatcaatactttcagctaaagtctcaaggggacctctgcaaatctacagtgttcactgttcagctttctcttctgtagtaaattgcacagtgaactctagtccccttagccttcctgaacccccagttctccttaactcagggagatcaccaggccccaccaggattcctgtatctgccctgtgacctggagattctctgcaggcaataggttggggcggtcgtagggtccactttgttttcctcctcttcggcttcactgtcctgtgttacctgatgtccaatgtctgaaaactactgtttcacgtatcttgtgtgcttttgtagttttaggtgaaaggtaaaactagtttcttattattccacattggccaaagcagaagttttggaagtctttttttaaggtctaaaacacttctactttgagagtcaattgaaatggtcttttccacaataattattttctgacctatggtttaaagataagtcatgaaaattttatgccactatttttttttaagtctgattatggttaaattcagggggctatttcctcctagattgacagagtttataatgtttcctactcacaataattgtacttctgcttcctctttgcatgtgttactttaatgggaatgtatatttccttttcgttaaggctgccttcaacaatttgtcataaagtcacttctgttagtgaattctattttttctgttactttactctatccttagtaccaaagagctccttatgtgacaccaatttattactaaaatgtcgctttgtttatgttcttggaattcttcatacattgactatcctcagatgtcgaatgttgtaggcctgtgtggcagggactctcttccatttattctatttttaatctaattcttgacaaaataaacccaatttttcttttcttcccctttccatctcacgtagggactggcataaagggcaatccataaaattacaaatgatgaatttttttggttttaactattattcatacatttaagatatggtcacaatttttatttcttactagtaattcattttattttttaacttttaggttctggggtacacgtgcaggtttgttatataggtacatttgtgtcatgggggtttgttgtacagattatttcatcacccaggtattaagcccagtacccattagttatttttcttgatcctctccctttgctcactttctaccctctggtaagccccagtgtctgttgttcctttctatgaaacacaatggttttaattggaaaatttatttttttttcaggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggtaagtactcctcatgggaaattttaatcagcccagtttccttgatatacatgattaatctagacatgttttgagtaaaaacaactttagtgatgttgagatagtttccttctgttcctagtttttgtcgtgagaaagtgttgaaatttgctaaatactttttctacattaattgagataatcatatttttccctacatcctgttaatgtggtatcttatattaattgattttcatatgtttaacatccttgcattccaggaataactccccaatggccatggtgtataatcttttaaagatgctattgaatttggtttgttaatattttgttgagtatgtttgcatcaatattcataaaacatattgttctgtagtttttctgtactgtttgtctgactttggcatcagggtaatactggcctcatagaatgagttaggaagtaactcttgaatgactattttcatgaagaagcttcaataatctgaaataaaatacttaaataatttagttcacctgagagttgtttttagaagcgtatttatttttctattaatgtcttttttgaactatataagaatgtattctccttccactcacacattgatggcaagtgtgtatttgtactctgtggcctgaaaataagatttttttgaataatcttaagaggccatgctttatactctggtaattgagaattacctatttcacagtagctttttctaaaggttaatttccagagaaaagagaacatgtttattaggatatatctcttaatgaattcagtgtatctgaaatttctaaatgacattttcatattttgcatactaaataaaattcataagtacaaatataatgcaattcataagtacaaatataatgcaatttggatttctagaagttatctagttaaaatatgatcttaggatttattttttttgtcttagatttatgaatcttgcttgtttttctgttaattcatttcttcttgtttgctgcatcagtcagatcagagtagaggcagcttgtatagttgatggcacagtttagggttagatggcacaggatagaaatgggtgctagacaaagagcagtcacagaggcatgttagaaatttccagttccagcatcattgatgaagaaaaccatgaggacccaagttgatcaaaggcagccagccaataaagctatgctcatgcgagatgagctgaagtgacattacattaaaattggaagaccctcttactaagtggctccatgcttccctgctagcccctttgggacttccaagaagacttggttatttcaagaagacaagaacccacagaggctgtagtttagtttatctctctggaaacatagagaatatgtataattaaataaaagcactttaatagtgaatcctttacagtgttatttgaaatttatgtcaagtgatttaaaaagtaaaaatgaaaattaataatttcagtggaagtaaattgattaacatgaccaggaatacataaaacttgcatggtcttgtctataaaataaggatatgtcatttaattaggagagtcaaagctcattcttgcgcttaaggtctgaggaactcttctcccatggggcttatgaagggctacactgaggcaacttcctcaatatatctcagccataaaaccaagagaaagtaagaagcagaggacatcacaacaaagctcaattcagtaaaagcaattttataggagtagagggacttgtcaaaaacaaaaacaacaacaaaaaacaatgtccaaatatttattcagcttaatgagtgatgtttttgtttgatctagggttaaaatctagacaaattacagagatgaataaactacatatcctttagtctaccatcctctgaaaatgttactttttgaaactttgattttgataagagctggaggcactcagggagtcattctctggcatggtctttgagtacagagtgattttgctgattaaaagcaaatagattgacttttaaaatcaactcatacaaacaaactgttaaaatcctctaatgagagtgaagaaacctaaccaagactgactgatacattactgctccatctctgcaccaaagtggactcagggaggcctgtaggagatgccaactccttatcctactccccacaaagacagttcttggctatcttcatcagacacaaatgaatggttgaggctccaaagctctctaccaattcttgtgttacactggcacttttaaaaaattttgtttattttttatttttaaatggagtctcactctgtcaccctggctggagtacagtggcgtgatcttggctcactgcaccctttgcctcccgggtttgagcaattctccctgcctcagcctcccgagtagctgggattacaggcacccgccactacgcctggctaatttttgtattacttagtagagatggggtttcgccatgttggccaggctggtcttgaactcctgagctcaggcaatctgcccaccttggcctcccaaagtgctgggattacaggtgttagccaccgcacctggctggcacttctcttaaaactaatatctcaagaagttttttctttaagaatcttctttcaattgcaggtccatgtagttctggtattcattaaagtgcctatcccaggggttttggtatgttgtgtttcaattttcatgtttcaatttttttgatttatgcattaattttgttttttcagaattcaggtgcaggttgtttagtttccatgtatttgtgtcgttttgagaattcctcttgttcttcatttctaattttatttcattgtgacctcagaagacacttgcattgattttgattttttttatcttattgagatgtgacttacgactatgtggtcaattttagagaatgttccatgtacagatgtgaaaaatgtatattttgtgttgttgggtggaatattctgcagatgtctgtcaggtccatttggtcaagagtctgatttaagtccagtgtatacctttgttagttttctgccatggtgatctgtctggtgctgtgagtggggtgttgaagtcccccactattattgtatagctttttttccccataggtctagtagtatttgttttatgaacctgggtgctccaacattgagtgcatatttatttaggatagttaaatcttctggttgaattgaaccctttatataatgccctcctttgtctctttttgatgttgttggtttaatgtctgtttcttctcatacaagtatagcaacatctgttcttttttaattttctatttgcatgctagatctttctccatcccttcactttgagcccatggttgtcattacatgtgagatgggtctcttgaattcagcagaaggttaggtcatttaaaaaatctaatttgccactttatgtcctttaagtggagcatttaggccatttatgttctaagttaatattgatatttgaggttttgttcctatacatttgatatttgtgtattgttaagtagttgctttctagtttgaattgtgtaattgctctataagatctctgagccttgtacttttgtgtgcttatatggtagcaagtattgttcttttgtttccatgtttagaactccttggagtatttcttgtatggcaggtgtggtggtaacaaattcccttagtgttttcttgcctgggaaagactttatttctccttcatttatgaagcttaatttggcagattatgaaattcttggctggcattttcttttttctttaaggaggctaaaagtaggcccctgatctcttcttgcttgtaaggtttctgctgagaagtcctctattagtctgattggatttcctttataggtaatttggcccttttctctagatgcctttcatattttttctttggtgttgaccttgcatagtctgatggactatattccttggggatggtcatcttgtatcttgcaggtgttttctgaatttcttgtatctggatgttaacctctctggcaagattagggaaattttcctgaattattgcctcaaatatgttttccaatttgcttacttcttcctcttctccatcaagaatgccagtaagtcataggtttggttgctttacataatcccatatttatcaaaggctttgttcatttttcagattctttatgtttgtctaactgggttaatttgaaaaggtggtcttcaagctctgaaatcttgtcttctgcttggtgtagtctgttgttaaaacttccaagtgttgttttgttttgttttgttttgttttgagatggagtctcactctgttgcctaggctggagtgcagtggcatgatcttgactcactgcaacctctgcctcctgggttcaagcgattctcctgcctcaccttctggagtagctgggattacgggcgagtgccaccacccccgactaatttttgtattttttagtagagacaaggttttgccatgttggctgagctggtctcgaactcctgaactcaggtgatttacccatcttggcctcccaaagtgctgtgattacaggtgtgagccaccatgcctggcctgcttccaagtgtattttgatgttccctttagtgaatttttcaattccaaaagttctatttggttttatcttaatatggctatctcatgtttcatatcctgcattgtgtttctggtttatttgaaatggattttaaatttctcttggctctcactgagtttccttgcaatacatattttgtttttttagtctgtcatttcaaagttttcaacttggttaggatccattgctatagagctagtgcaattctttggaggtatgaagacactctttttgtagtgttggagttcttgggcagattccttcttatctgagggagctgttgattcttatttttgaatttcctattggttgggcgggacttaaactttttttttttttccccttgagggtatgactatggtgtatgttgtgtgtgatcattcaactttgtttctgggtgctttcagggggccaaggctctttatggattccttgggcgtggtagctttcttaaatgctgcttattgtagcaatgtattggatttgtgagctgacactctatctcatgtggggctgagggtgcagaagtctcaggaagcttattttgtggagtagtgctaagcctttctggtagtgggctttttatttgatagtacagttcaggctgcaatccagtagatggcacttaaaaaataagaaccagcttgccctcagttaggctgatgtccagtagaagcacctgtcctgacaggggagtgacaggaagagattctgttggtgtgtgccgaggcctttggggtcgctggttggggggagatagggggaggtgcactagctcctcatgcaggaatgtgatctgcttttctatcataccccatcagagggctcatgaccttcagttcataaagattttttccttgggttcccagccatagtctgtctgtaggttatgcatatgcccctctgaaggcaaccaccaaaatggtcttggggcagagcctcttcccccagtctagggcagacaactccatgacttgtatgtcctccattgctgggacactgctgctctgtgtagggatggggagttgggccccaccctttatgtaagcctaagtggcattctcactttcagcaggggtggagccatcttgaaaaccatgaaaaactctttcttcgagtacctgtgctggcccccagtgggaagaaccactgctgcgtcttcaacagcgtgtggggtgggagggtattgccacagatgaccccctctccatatccgttccttgacatggtgttgccccctttagcgattggcactgtgcccacctttcctttgtcccaaaggggttttggcaagttgtgtccctctcccttataggtggcctacactaggggggttagatctctagaggttccatagctccctgggaacttgctggccccctgggcttttcaaagtcagaacaggttatgaggtatgtttgctggggatctggtgctacagagactcaagggtagagaatccctgggcagagcagaggcccaccactggtgcacaagcaatatggtgaccaccatctcagtttgtgtctgaggggagtatgggaacccctgcaggagctggccacccagttctctatccctgggaaattcctaaattaccaccaataacattgccctgggtcacaagggtggggccttgaattctttgggggttgatctctgccagactctagctacttttcctttctgcaccccagcttcttcccatgggcactccaaaaggtcctggctctctttccccagttttccattagaaacttgtccatttgacagtaactttgatcttctttctaagaagagctggcatccaaggtctgtggtcagctatgttggaaaaaagaaggagaaaaaaactagtttgtattaaattctgaaagactagtggcactggttaagtctttaaaggattgttaacaaaagaaaatctttttaaaccaaactcctaattttatcagaattgtaactgaaaatataaatgtatgaaaacataggtattatgtaaaatttgctcaataaaagaataggaaaaactactatttatcttggactgatagcatgttagtttgagatttgaaccctttctactctagtaagtagtggtgggaaaaattcactgtaggagtctgcagacataacaaactatcattagactgccaagacctccacataataaagcaagcagagaatgtcaaataagtatgtgaaaaatgatcaaaaaagagaaattgaaaatataaatagggtgctattaaaaaaggatagcatttatgttatgacatatgtacacatgaatatcactttttagaatttcatccttcttaggacttattcctgagtccgaggattgagaggttctgataaaataagtctcagtgggttccaggcatgggctttctttaaaagtctctccagggattctaatgtgttgccaggaccaagtaccatggacagccaagatctcatcagcacagtttgattgaatgaacttatgtagaaccctgaatgccacacttaaccaaagaaacctttccagggattaattataggtgacagaacatgctatattcttattaaatattattaaaagttaagcaatacccattcctgattcatgtaaaattctcacttattttccaagagttttactgtatgactggtttatgggatgcttggaaaaggttgacagacatggcaaaggttcctgcagtgtttctctttgtccatcaacagccctagctcataacctctaccctttcagctaaaagcaattagctcttcagaagtgattcattctatttatacttgggataagtaacatcaggcagtcttccctagggcttctcacgggccctggtggcatttttattctaagagagggttatatttttacatgtaattggtcataattatactaaaaacaagtaattggtgtcttatacaagaaaattatatttctgctttagtcattgacagagtatcctgagaataagagttaagaagtatattcattgtcatcttatttctgatatatttcaaattcttttgctaggaagaagcccttttgactgtgctttgtgtaacaaaacttcttcggagaaacaatttagataaactttgtcagatcttatgtgattatattcaaaatgctaattgaagattctctaaacattttcagtaaaatgttgaattgttttcatgctgttaaataagttaacatgtcttcctttactaaagtcattattataaaaatgtaaatcctaatgataatagctgatgtttattaagcatttagtaggttccattttttgatagcaacttttatgaattatctcattaaatcttcataataatagcatcaagaactacaaatatgttttcatgtaagaagggaaataaaattatgagttttgctgtgaggtttgaagaatgaaaacaatgcatgacttagaaaatagtataattaagtgaattttattatcattatcatctcttagtttataaatgaaaaaactaaggcttacataatgtaaaaatcagttaacaaggttaaacaaccggtagatggtagaggaggagctgggaataaatctgtacatgtctgaatctggagcaggaacccttaactgatgtgtcattctagcaggtcatcagttactctacaatacctattaagtatactttatttactgtgtttagatttatagtagatttagactctactgtaaaaacaaggacttcatacacctgctagaaagtatccatatcatcttgtttgaaagttgtcccgctctagtgttcttttctaatcatgatgattcagaactccaaactcttgaagcagggcaacccgtagggtcagcattcataatttctcaatacttaaaaaagtttcctcatgactgttgctattattgagatttctcaaatgtcttggcctgaattgggtgtgcactatgaaaaaaaaaatggcagacatttctttttgttaaaggaattttaaaaacacatataaacacactgatttgtgacagattaccaggctttatgtttagcagggtttcctaagcaaaacacaaattctgtaaatctacagaattagataaaacattgactcaatccttagatgagagtataatggattatcacttaataacttctgtcactgaaaataaatgatgtaaaaagtaataaagttctactctcacagtatgaataaataggaaatacataatactttaaattaggcaacaaatcattaagcccccagcattcattagactatcattaatgataataaaattgtgtggtatttatacagatattatatgtaactccaggaattttgttataattgtgtatgaatatatttgttgtttgaggcaggtagatggatatttgcagcagctatgtgctgaagcattctggtaatagttttcaaatcaaccatttttttctccttgtcgatcatctttaaagcaaaagcaccgttttttactatattttttgaaaaaaatacattaggtgtaaaattatatattttgaagaagttcactttctgtttttactagtttcacacctttgttattttttcagtggaaggagcagagataggcaaaggcgaagcctgtgtgtgtggtcaggttcctgggcccttcatagcatctgatgccaagctgtgttctcttttgtgtcattgccttcccacttgctaattacgtgacagagctagggacttccctctgtctagaatgccccccatctcttgtttgcctagtgaaatctggtttgaagttcaaggtctgatacaaaccaggtgatcctctgcaaaactaactgtacctgagcaaaccaggcacttactcttttatatgttcctggcactgctgatactctgatagaaaacatcatcacttaatgctaactgtgggctcacaaaggggatacttctactgtaagaagactgtaactcttcttagcacagagattagtaagtacttgaaacagagtttcacatataataagtgttcaataaattttattttttatttctaacacttggcacactgcatagctcagtaaatgttggtgaagtgaactgagtattctccttatctattatgtggtaggcattattctagttgcttctgttataaaccaactcatttaatccttatcacagcacttttattgtggtcaatattttttaatcctcacagatggctaaggaatcagcactctgagagattggttgacttgctttgggtaaggtgcttataaagtggtagaacaagattcctatccaggccttctgattcaaaaatacattctttttttttttttttttagtagtgttttctggaaaggcagggtataactgactatgctgtgtatttgggactaagtatattattgtcaagtatattaaaaatgtcgcaacactggaaaggagtccatcaatgggctatgcaggttgagggatttgtagatgagaaactgataaatttggttagcaaggaaagccatcaagctgtgaaccctttatattggcaaaagagagggtcctttgaaatctaagggaacagaactttcctgttctccaagtttggagcagaataggtaagctctaggcagtctaatgcccaacttttaccagtggtgttttagttttttttttttttccaaaaggaaatgatggaattctttatatacttctgaattgtctatcttttcaaaaataaaaattttcattttgcagtacatacagaatcaaaagactttcaagtcctaactccacaaatgtttattttgaagctctttaaactgtttaccacggatattagtaaatctgtcagaaatgaggtgacttacttatccttgtcccaccagatatgtgggaaggatgatcacgctagatagcatggatgggtcctctatttatctctttttacttgaatggaaaacacatcattcagattaatcaattagtcattgtgactgatagaatttttatatggataatctgggtttggtccctagctttaccacttacttggggtctttatgtcttctatggtctcctatctgtaaagggaagttgataatgccaatctagctaggttactgagatgcttaaatgtgtaatgtatgcaaagcagcaggtactcaataaagggtaactcttactattattgtatagctctccaggtatgtattgagcttctatagaatccatagccccaaactctttagccctttgagaccaagattaagcattgtctttccagaggagagggtgagagagattgccattatactaatagaattcatcattatcaccgtcatcatcatcatcatgatttcttggtgtgtcatggaatgtactgtgtttcacattaccaacagatgttaattttcacaacatccctgagacaagaaactatgattacattttacagataaggtcatgcagctataaagttgtgaaattgggattcaaactcaggcagtctgtccccacagtccatgttcttaacccaccatgctctcctgacacttgaaaagttaggaggcgtactccatagcctgtaatgttgctgcagagagaatctaattttaaatccagtgaagcatattagttgctgtctttgatatgccattcagattgtgctatccttatgatgcctaccttggttgtatatgtaactgggcgtcaaatatataaatactcaaaaagtgataggtgccaataaaatattttatagttaatacttatgtaatctgtgttctctgtgtttgagggctggttctaaaatactgctctatatttgacttctggttaaaacaataaactttgctcatattagttatatagttgataccattctcatgttgctaacatgtctgtaagtaacagttgaaattgatctggcaattttagagctgtcagacccaggagatgagagaaacatttaaaatgtttataacattaaatcagctgagtcaagagagagaaagagaaagatgattcagatttcttgtactggtggatgtaagtgcttggaactgaaataaaggagaaggtgtagggagggagaaagataaagaagtcttccctttatacaagttgaaattgagttttctttgagatatagaggtgaagacattttaagaaacttcttaaaactctctaatgtggcttttcaacctgtttccatcaatttggcacatctcacttttcggcacaacagaatattctaggtttatctcacaccttccttgccccagcccaggaatcagccatttctctaagaaactcttgtttattttggtggggaacagtattgggaaaccaacatctgggagctaaatatactcctagtggttaggaggtcataccttgtagactcttgtagctgacggagttaggacatatttattagaaatcataagtttatattgatcttgctaggatctatccaatcctacaagattcttccctgtgtctctcctttgtatttgtgtatcctttcttccatattaagaactgtggctcccaacaacaaggcatgtgcccatttgcccaatcgtatgatgtataaaaactactttgagaaaagtggcagccaaaccactaagaaaaataaacttgctgaaatgagttcaagatttattggcagctctttttttggcccctagactgaaagtatatatttcaagtattgtgttcaaaaattatttgggttagctttttccacctttcataatagtaatattatttacttgaaatacagttggctttgtttctatattcagtttttttctctctatcttcattaatttcattatatatatttaatatgtaggacattaacatgtttccaaaagaagaaaacactccttcctgtatcatttccacctcatctctcttaccccttataggtaaccaattgcactggtttctagtttatcttacttatattcctatttgaaaagttacctcatatatgtatgttttttaaatttttatacttttttacacagaaagtaacgttcagtatgtactttgccactttccttttaaacttaacagcgtatactggaaatcactccatatcgtgtcacagagagcttccttatattttttaatagctgtataagacttcattgtgttgtctgtaccatattttattcacttccccatgtgtggacattttgactgtttctagtatctgcaattactaataatgctgcagtaaactttgtgcatatcgtaccttggtaaatttctagacatagatttctgggttaaaggttaagcacatgtgtagttttgttagatattgataaattcctttccatggggtttatatcatttttaaaatatttaccagcaacgtataacagcgtccattacttcaaagcctcaccaacagattgtatgttttaagtacttttatgttttagaatttttccaatgcgataggtaaacaatggtatatcaatatagttttaatacattaaagttcagcatcttttcaagttcggctagtctcagggctattcttaatatcttgtgaattatcttcatattattttcccatattccataatacttttggttttttttcctcctcaattctgacaagttctttatatttcaggaatattagccattttatttgatatgttacaaatatttttctcccaatatataacttttctcttataacgatttttttttcatgaaaagtttttaattaaaaccttttatgggcccaggtgcagtggctcacacctgtaattccagcactttggaaggctgaggtgggcagctcatttaaggccaggagttccagaccagcctgaccaacacagtgaaaccctgtctctactaaaaatagaagaacattagctgggcttggtggcacatgcttgtgatcccagctactcaggaggctgaggcatgagaatcacttgaacccagcaggtggaggttgcagtgagtcaagatcgtgccactgcactccagagtgggcaacagagtgagactctgtctcaaaattaaataaatatataaacaaaaccattatgggccaggtgcagtggctcattcctgtaatctcagcactatgggaggtcaaggtggttgaatcatttgcgccaaggaactggacagaccagcctgggcaacatgggaaaaacctctctctaccaaaaaagaaaaaaaaaaaaattagctgggtgtggtagcatgcaccagtagtcccagttactcgggctggtcacatgagcctggggaggtcaaggctgcagtgagcagtgattgtgccattgcactccagcctaggcaacagagtgagaccatttctctaaatacatacatacatacataccttttgtggagttaaatttacacactttttctttattggctctggcttttgcattgtagtaagactttctttacactcaacttatagataaattcacccatgttttcttctagtacttgcatagttgaattttagatctctagtccatttggagtttattttttgtatggtagaaggtattgatcctattttttcccaaatagttgttacccagttgtcccaaaacaagttattgaaaagtccatctttgtcccagatagactggaacaaaatgaattaaagacttaaatatgaagatttttacttgtgtatcctttcttcctagaaagaaaacataggcgtaaagcttcatgacgttgaatacttcatgccattggtctggcaataatattactattatgaaaggtggaaaaagctaacccaagtaacttttgaacacagtacttgaaatatatactttcagtctaggggccaaaaaaagagctgccaataaatcttgaactcatttcagcaagtttacttttcttagtggtttggctgccacttttctgaaagtagtttttatacatcatacaattgggcaaatgggcagatgccttgttgttgggagccacagttcttaatatggtagaaaggatacaccaatagaaatatttatatttaagtctggcaatcatttttaagatgtgaacttgaacaggcaacaaaagcaaaaataggtacgttggattacatcaaacccaaaagctcttcacagcaaagggaacagtcagttgagtgaagagacaacctatggaatgggagaaaatatttctaagccacacatctgacagagggttaatatccaaggtatataaagaactgcaacaactcaatagcaagaaaacaaataacatgaataaaaaatgagcaaaggatctgaatagacatttctcgaaagaagacataccaatggacaacatgaaaaaatactcagcatcactaacaatcagggaaatgcaaattaaaaccacagtgagatatcgcctcacacttgttagaatggctgttatcagaaagataaaagataagtattggtggggtgtggagaaaaaggaactctagcccactgttagtgacagtgtaaattagtatagctgtgatggaaaagagaatggaggttcctcaaacagtttaaagtagaactaccatatgatccagcaattccacgactgggaatatatccaaaggaaatcagtatattgaagagaactgtattttagtgattattgcagcattgttcccaatagccaagataagggatcaatctgagtatctatcaatggacaagtgataaagaaaatatggtgtgtatacacaatgggataccattcagcctttgaagagaaggaaatcctgtcatttgccacaacgtggttgaacctggaggacattagctgagtgtaataagccagccaccaaaagaaaaataccacatgatctttcctatatgtggaattttaaaagttgaactcaaggaagtagaatagaatggtagtgaccaggggtatgcgataggctgagggatcaaggagatgttggtcacgggatacaggatttcagttagataggaggaagaagttcaagaggtctattgtataccatggtgagtatagttaattataaagtatacttgaaaattgttaagagtagattttctgttcataccacaaaatgataagtatgtgagataatgcatatgtaaattggctcaatttagccatttcacaatgtatatatatttcaaaacaacatgatgtacatgataaatatacagtttatttttaattaaaaattttaaactctctaattggtcttcaacatatagtacacaagtcttttcacgactctttataatggaacatatgttcttggaatgctaaaaattattttttttggaggccctgcaaataactaaaaatttatcttaaaagccacacctaattacttacatatgatccagaaaggatactttgaaaaagctttttaattgataaaatcattaaggtaaaacatattcataaaagtgttctctaataattttataattttctagttcatgaaggattaaatatacaactatcatttgaattggattttttatgaggttaattgtatttaaatgctaattattttaactaattttgtggttgacttctatgtagagtagggaaaaagaatttcctaaagccagttacgtatatctctttttagtctggatttttaattaggaaaagtgatatagttaaataggtctactctatagcatcttctaaaatgagtaaaaattcattatatcaggataaaaaatgataaagatatatggatgacacatttggctgaatttttcttcttcgctgttctcttgctctctatttaaatagtcttagctcttttatcatttaaattctgaagtattgaggtgattattccggcagcaggtgattctgctaattactgttcagtcagttttagctattagaaacagagatatgtttacattgctgggctgcatgtaaatttagaagttacatggctttgtttttactttgacttacggcattaaaattattttcatctgtgtatgtaaagatctgcatctataagcttttgtggataataaggtgaaattgatgcattttaatataaattgccaatataaaatatctctaactcagacctctactggaaagttgtcaaatcttatgtaggaaaggcttttaccatcactgttacacattaactgggcatagtttaatattaatagctcctgagacttgtggttaactgaggtttctatttcctgtgtttgggttttatctttgcaacaacttggttgcttttctgtgtaaaatagtggtgaatatacacaagagtatgacaaggttctgggctcttaactttgatgaacaccatgccatttccatcatgctgcactcaaaacagcacagatgtgagtctgggagtggcgtccctgccgctctcatgagcctttgtttggagaacaccctgattaacccccacccttcacggttcattgactcactgatagatcaagtttaaactagtatatattagcacatttgttaccaacagaggaacagttggccattctgttttacattgctggttcattgcaaactggcgtgctaaaaaggtctgtactctagagtatgaattgggaagttaccaaaggactgagaaccaagtcagttgcatattaatgttgaattatacctatattttaatcttggattgtctacttgggggatgcttacactgttgtcaagttatgaataagtgataattaccactttgaaattcatctttttttttcaaggagtttaggggatttaggtgtctcaatatagctttcatattaaacagtttgtcataattggatgagagcagagcaaggtcatgactacctgatgccttgtgttggagcattttaaaaatgttttccagagagttatttgtacctaatgactttacataagtccttacattatactttatttctaggtcacctaaaaatgttaattgtttagtcaagagggttaggatgtgtgtctgttttctcatgaaaaaaattaagctgttccctttttatcaattttcttgcaatctaaaggcttttttttcttaccttcctaacctagtgactaaggtcatcttattgttacagttcctttcatgggagataggtttactgcatcatttggcagtttcatagggtgaattttgtcttggcttcatctttccttactggttgtcatcccctgggccacctgcttttttgcattttcctttctcttgtgagatgatgaagctctgtgccccgatggggatgagagacagcactctgagttcaagtctaggataaggcaatgggcttgcttttcaaaacaaactagtgtcatacgggctgctgctttcaggtccactgtctgattttatcactgatgacttgtttctggaaggcaaactgatttaagttctgagcaaaagggtcggtgtttattttcaatgctactattaatttagagttttaatttagaaaagattttttaccagttctcaaatatgatttttctattgactttaagtttgtagatataaggagtagacatgagatagagactgaattgcttttttgtttttaaaacttggcagtaataaggggttgcttgttttttcatgctaaatattttttctaagggatctagatacctatcagaaaacttaactttgataactctggttctttattaagtatttttgtcttattttaggaattaatagaaatagttgtaattttagacttcctttataaaataccaatttaaagagaagctttttgcttaaatgattgttttgcagtgttgtgcttttgttttctttaatgcagttgaaatcgcagctttataacttattttttaatttggggtttttaaaagaatattagttatttatttatatttattgggcacctactgtgtgccagacactattctaggaactagtaaacatagcagagagcagaatcatgaagttcttgacctcaaggagcttaaatcctagtggtagagggggaattcaaaaaaatcaaataaatgtatttctattatgtcaagtgatggtatgtactaccaggcaatcagatgaaaatatttcctcttctatacacagtgggcaaggaaggcttcattgactgtggagttttagaagaaagctgaaagtaatggggaaagagagccatatcgatatatgaaggaaaacatggtccaagcagaggaaacgaaaagtgcaaagaattgagcaagaaagtcatgttcaagtggagtcagcaggggaaagagtaggtcacaaatgcggctgagggtgggtcatgaagggccttacaagctttgtatgagtttttacttttattctgaaaaaaacaaaaacaaaaacaaaaaaaaccggggagctatttggggattttaatagaaaagtaacataatttccttttaaaatggatatgtggccactaagtggagagagtggtgtatatatgagtggatggaataattgatacaggcaagcaggagacaggttaaatgaaaaatggattaatccaggcaaaagatggtgacttaaattaagctgggagtgggagagatggtgagacatgcttagactttggattcatttttccagatagaactggctgacagagacatgtcatttaccaacatagacatggcagattttttttttcttttctgagacaaggtcttgctctgttgtccaggctggagtgcaatggtgtgaccatagctcatggaagcctcagactcttgatatcaagtgatcctcccacctcaacctccctagtagttgagattacaggcatatgccactgtatccagccaactttttttttttctgtagagacaatatctctctgtgttgcctagggtagcctttaactcctggcctcaagcattcctcctacctcagcctctcaaagtgctgggattataggagtgagccaccatgcctggccaatatggcggttattaagaggataagtcaaagattacatgaatattctgttatgaaaagtgtcaaacatatagaaaatataaacagtattccagtgggcacccatatttttatcaccttgattctacagatcttaacatttttctgtatctgcttcaaacattttattctgccaatgtgttctaaagtaaattgttgatattgtgatagttctctccaaaatgctgcagtgtgtagctctaaaaatagatatttttcagataaccaaatatcattaacctgccaaatcaatgaatgataattgcttattaacatttaatacttggtccatagtcaaattctccatattttccataatgtcttttatagttaacttttaccaactagtgtctgatcaagaatcattcatttaactaattacatttaaactgtaacattacaacatgttttttcgtatgttttattctctctgacattgacttatggaagagactagattatttgtcctgtagacattttatcatacataagagttactaggagagctctgattactagtccccactctcagaaattttgattcagttgctctttccagtgagctgctggtgatgctggactttcattctgaagaccatactttgagcactactgctgtaccactatccgatggcttctttgtgatatcgtttaacttgttgttctgttgcctgtatttcctctaaactgaattttcaatctaaaggcttactgagattcatgtttgatactttgggcaagaatacttcataagttctagtgcttaatgttaggtagcacttaattctgactatttcactattcatgaggctaagctaaggaggtgacagcctgatccttctattgtaatgtttcatgtgaaactactagataatttgttgagttggggggtgggtagggaagagatatctagttttcaataaatatttcacctaatggttttaacacacattgatcatccttgcctgaactaattatttaattagggatggcaacatggagactttctaattcaatctttttttttttttctaaatgaatggccttgtttttatttttaaatggatgttacttcgcaactggggttatttgattacccagaaatatagcgcatattaaaaaggtaggataaatgcttagttaactaattaagcaatttttaattaccagttttcacagtaaggcactaaagtttctgacttgagcaaagataaagtggaaagataaagtggtcgtttagtgagatgggcaagactgtggataggtagactaggtttggtgggaaagtcagaatatcagttttgaatatgttaagtttgagatgtctattagaaacatatgttgacgaggccaggtgcaatggctcatgcctgtaatctcagtactttaggaggctgaggtgggcggatcacctgaagtcaggagttcaagacgagcctggccaacatgtgaaaccctgtgtttactaaaaatacaaaaattagctgggcttggtggcatgcacctgtaatcccagtaatcccagctacttgggaggctgaggcgggagaatcacttgaacccagggggcggaggttggagtgagccaagatcccgccagccactgcacttcagcctgggtgacagagcgagactccatctcaaaaaaaaaaaacatatatatatatatatatatgttgacaatatttcagttgaataaaataaaatattctagctattttaggtagaaaggcattttataccgatactactactaaagggtaagaagatatgactgtagtacattaaatatgctgatggcctacaactgttgctgtgttgctttttcctcttcaccacacatatgcagcctcatgaaacattttccatgaccagcacactgaaggaaataaaaggaacctagtttagagatggttctgcatgatacaacaaaaatgagctgctaaagcattacaatcccactcaagagtattcccccatcaaatagtggggctggtattttaatcagttgatactaattgtcaaggtgtgatggccaagggattgatgtttatcagtgtatggacagtggttcagagtttggtgaattagtcgagttgaaagagaaagattggtgacaaagatgtatgaggtggaaagtatactttcacagaataagaacagaaaatgagatttatgtttttttgtaaacgttcaacaaagaaaattcattcagaggaggaaataggtaggcaagatgccctattctacagatgttagtcagcatcactgcaaagcaacctcagggcttatgcagtggacacttaaaatagcactggtgcagggatgggagaaataaatggatttaataagcactgctgcttaccaaggttgattgaattgccactattgccaagtgttctacctgcaaacagatcaaccttgagccctggatatggcaccatgtcccagagcaaccagccagccacctggtggcaggttgattgcattggatttgctccattatggaaggtcagtggtttgtcactgctgcgatgaatgcttactgtacgtttggatttgcattccctgcccaccatgtttctgtcagcaataacatggccttattaaagccttattcaataatatgacatcctatataatattgcttttgatcaggagactcattcacatcaaaataagtgaggcaattggctgtcaactacaggattcactggtcttaccatgttcctgttgtagcatattgtattctacctggaagatgaaaccttgtgacattaaagtagtttttagttccataaacataatacaggggtctatgaatcaagaagtggaggtagaagtgttgtcttttacttcacatctaatcacatgttcaaaatattttttcatcttgcctctgcaactttgaactttgctgacacactgaggttttagtgtgaggaaacaatactttcacatgggaacatgatagtcgttcaattgaactggacatttagaataacctggccacattactgaactgtataactgaaacaacaaatgaaaaaaatgaagatgctacgctggcaaagatgattaattttgattattgggagaaatagtattgctactgttaggaggaagactatatgtctagaaactaggaggaaacctgggttgcctccttgtagcagggtaaaatgagtgagtaccttgtctaagaaagggaacatgaccaaactgaacccagaagacataggaaatctaaacagatcaattaacaccaaagaaacgggcattttttggtacttctaaaaaagtaccagactgatattttcacagagatgttcgttatacccttaaggaacaggaacagaaaacttctatactatttaaactattttagaggatagaaaaggaaagaaaactccagattttatttatagaacttgcatgaaattgataccaaattctgacaatgcaagttcaaaaaggaaaactagagatcagtgttacttatgtcaaacagctcttaatagaatagatggatatggttatcaacatgataaatatgtttatcacattttaaagcctacatggagaaacatttgaggttttcttattctagaactgacaggaatgtcctttattatgagcactattagtcaaatttttctggtggaactaatgtaagtagactgctgaagaaaatgaatggtatgaacattggaaaggggaaattaaatgattattatttacagataaaataattgttaagctggaaaatccaagtgaataaagggaaggcctacaattaagcagttaaggaaagggctaggtatagaaatcaatagttttgatatatgcaggctatagccagttaggagatcagttaggggaaaaacacgttgacagcagcaacgaaaagctgataaacctagaattgttcaccacttatcttaaaatgtttaacatggtactgagggacacaggagattatttatgtggaaaaacataccatgtttctatacagaaaaattgaacatcacaaaagtattatttgatcttaagataatttatatttaatgcaatctcagtgaaataccaggagaatgtttttaagctagacaaacttatttcaaagatcatatgtaaaaataagcaaaaatagatgtgaaaaattctttaaagtaatgagagaccagtcttattgactattaagtcattataaaactataatgtttaaaagatggtactgacatatgaatagatcagtggatctcagatgggcagtgcagaaagagatccaaacacatacaaaaatttagtacctctaaaggtggcatttaaaatctgtggggaaagatggattttccaatgaataatgttgggataggtagatagccatctggaaaaaatgaaagtcaaatcccaactttttaccttttatcaaaatgaacttcagatacaattgaaaatataaaattgagaccataaaagtattagaagaaaaatgcagtttttaagtctcaaaaggggactcttaaatatcatacaaagcccagaggccataaaagagatgattgataaattcaaatataggtccgtgtaagcgaaaactttcagtatggagaaaacataagttattaaggcaaatgacacactaggaaaagcatttgtaactcataacaagcctagttttcttactgtgtaaagtactgccataattgacaaagaaaatatgaagaattggcaagtgacatacatagaaagttcatggaaaaaataactcttaaacatttacaaaattttacaacctctcatgaaaagagaaatggaaattgaaattagagtcacatacagtatttcacttttcatttgtcaaagatcaaaaagtttgaacatactgtgggtttatgtttataaggatgtaagaaaacaggcaatctaaattccttgtagagtgtaaattggtagtaataagagaaaaatttactgaatactttgtgccaggtgcttttctaagcactttacatttaattatctcaattaacttatccagaaagtaccattatttctgtattacacgtgaggaatttgaagaaaagttagacaagtaattcaaagtcacacagttaataaatgacagagtgaagatttgagaccatttcctttttctcaagtgtccacttttggtcgcaactctgctgtttctgtagtgagtgatttaacactatatgataaaaccttaagagtacgtactctttgatccagtgattctacttccagaagtttgtccattttgcatcaaatagatggagaatagcattcattgcattgttatttgcagtaaaggaagattggaaacaacctgaacatttatcctcaaggactcatccatacaaaagaattgaagtaaattcatccagatgaatatgaggcagctttagatagagtgagatggcatcctatgtagtgatatggagtcatctttaaaatacagtaaaaggaaaaagcaagatacagaatagcatgtagggaagctgctgtctatgtgaaaagctgtagaatatacgtgcatttttgtatatgcatagaatattcctagacaaggacaaacatggtggttcatacctgtaatcctagcactttgggagactgaggcaggtgattcacttgactccaagttcaggatgagcctggccaacatggcaaaaccccatctctagaaaaaatataaaaattagctgggtctggtggtgtatgcctgtggtcccagctacttgggaggctgaggcaagaggattgcttgagcctgggaggcaaaggttgtagtgagccaagatcatgccactgcactccagcttgggtgacagagcaagacaccattcatctctctatctcttttctctctctctctttctctgtctacacacatacacatacccccccacacacatatatatacacacatatatgtgtgtgtgtatatatatgtgtgtatatatatacgtgtgtgtatatatatgcgtgtatatagatacatttctagaaggattctcaaagtgatatcagtgattgttgtgcaagaaggaaactagatatcagtgaatgcgctaaataaggtgattttgaattctgtagcatgtgtatgatttacctatagagaaagcagtctagcatgagcgtgggtttctcaaatatagaatgtttgcagtgaggtcacttggtgaaaagtatagccatgtcagacagatgtaggttcagattccaggacttccaggactgctgaaagggaaaggggctttggatctccttcagctccaggcagcattgctcctttcccagctttgacattagctggagggaagacaagttcttagagctctatgtgcttgggacaagaccccttccccctactgccttactcgccaaccataactgctgcaaacaattcttacctcttccaccccatgtcactgcctaaaacccttcatcacctggcctcccatgcctctaagtctctgtacatcccctagcctgatactgtccccaaccctcctcaactccagacaccattttactctaccctctggaattgtccattattagcaaaatctcctttattttcaacctcctttctaagtatttcccccacattcttgttgtaatagagacacagctttcccaggactgtatagctttccttgcagtcctctaaagtggtaactggtttctctgccatacatttcataccactggtcctggagatattgtcaatatcttaatgtcttccttccatctcacttaaattttgagaccataattcctttttcctctcttaaaagttctcagtgttgaagctcaatccattagatacctctagctggcactactagttgcagtcctgtgcagactactgagtcattttctttactccctgaagacttaaactctatcttactctcactctctctgacattactcctattaaaatgttatgtttctttagctattctttcagtttttggtctcctctccttcaacgaggatgatttctagaatgttggttctcaaaatgtggcccctttgcagacatcgtcagcacctgggaacctgttataaatatgaatctgcagaccacaccccagactactaagcccaaaattctgggggctggagcccagaatctatgttttaagaagcacgtcaggtaattctgatgaatatgccagttccttagatcttgttattgtcattactgacaactttctctgagaccacaatttgaatctaccaatttttcactagtactcacccatcttaagtccttactttccccttaccagccagacatttgaatattccttgactcttctctttcacatactatatccaaagagtcaacaaatgctgtcagctataccttcaaaatacatgtagaatctaacttttaacctccactgcagtcacttcagtccaagcacaaccatttcccacctggagtattgcaactgttcttgtttggtggcccttggccctactttatctactttccgcaaagcagccagagtgtttctttcaacacctaaggttatatggcttcattgattgaaattcaccgtgcttcacctctttctctacaaaagccaaagtccttgtaaatgcctgtaaggctcgagggtgatctgaccttccctggcctgtcgtgtttcggtaaaagtaagctgagtctttcatagttaaaggacagcaatattgtcctgcatgatattttaaaaacccaatcaagaatcacacattgcatttaattttcatgcctttagtctccattaaaagtgtgccctttgtattaataattggagtgatgagggacagagtttaagaatatataaatattttgtccccaactgactgtcactggatggctttggcacccattggtgattcttacctgaatcagtaattattgtgatgactgaaaatagtgatttttctcactgtataattcttctatatttattaattaccttaatattatcctatagaacagaatgttcccttctcatcttttgtttgtttagtgtcagtattactcatgaagttgggtgtttagaaaattcaatgttgtataatactgttattattcaatattgtattttctcagtttgagtcttccatctgcgtcctttcatgtaaatagtataaagatcagtaatagaggaacatagagtaaagtgtgagcagagaagccttactctgagacaaacttcagagaggtgaactctgttgctgattaagaaaggcttcactgaggaagtgttgtttgaagtgagctttgaaaagtcataaaattttgacaaaagtggggatggggtggagcttaaaggaaaaactgtctgaacaaaggaaggcccggcagactaggaatttggcaataatacagtggttttggaccttgatgaggaagttgaaatggaacataaaaaccctctgcatttagctccatttatttgctcaggcagctctcactgcctaaaattttcacccctgctgttttgctcaggggtgggatgaggggtaatgagggaggaaattttagggggtgaaaacagcacaagccaaaaaccctgctcagatactcccttctcttgaagccttttccagatccctaataagaattaaccaccctctctcacacactctgttgtactttgtccttctctgttaaccagcctctgtgttttgtgctgtctgtatttgtggatacatcttcctcctttaaagcacgaatcatatcttaatcccttggcccttcttcccagtacttagcacaagtgctcaatacatgtttctttaacgcgtgtaacagaggaaggcgaggagagtgagtgggattgggagcaggaggattctgaatgtcattttaaggggtttgggctcgctcttcaggcagcaatgagccatagccgcctttgaactgtgcagcactgaccagagctgtgatgccaaaggatgcagtggaaggggaggacagccagcatgcctgggcatggtccccaagtcagaggacatcagtgggagaagggagaaggcatggaagcaagtggctaccatcttatgaatctgagcactcattcaaaggtggcaaggaaaaaggaaggcattgagcacggttttgaggtttccagcctgggtgattggaggctgatgcaggcttcttaccaaaaagggccctaggcagtttcaccaggaatgtttaaggagtttatcatgaccctatctcttcctcgtctaaaactctccctaaaatcaaaacagtatgtcctgttgaaatactttattgtatcaaatataatgagaagtaaaatattctctctacttgatgtatgaaacactgacttcttgtagtggacaattttcacttgtctttttagtaatggtttttattaaaaatagatgttaataactgcttgtttaatctttaaacgtggccctctgagagcagcttaccgtaaaagaaacggttgtcagctttctttttgctcctcagtccctcctgccccttcctaacaacagaaaatttgctttgcacctgctccaactgggttcgaagagataagcatcttgcaagcccagaaaattgtagtatcaaatctcagccccaactgtgaggcagcactatcattgaatccctgctgagaggcgttgctttcccaattcccaaaagagttctttctcccctggccccttttcaggcttgaactctgaccgaaaccctctttttaactcccagcatgcactgcacttggtactgacactgacccatccctgcttcctctgttctgcactggactcatcagtaggtcaggcgttggtagccctggggtcactggggtgcccaattccaataatgagcacatttagctaaggagaggaaatgtacccttctatttgttacagtccattgctttttttccagaaacaaatgctaaaagaacatttgatatattgtggtttggtaaatacacatagcactgcctaatattcacaaagttgcctcttttttttgcatcttccttcataaattaaatatattgttctaactcatgatttattttaagagggatatacctatttcacagctaggaaaatgttttcaaataaagttatattcagaatactcttgcaagaatttcaaataaaaatagcaaatactatttaaatgcatataacattctaacagacttgtgtgtcattttaaagggaaagaaaaaaaatgatgacaaggactttacaactttgtctttaaaatttcttcttaggctttccaaacagaccgaagtcattaaaaatactccttaacccccaaagtcacaaaaaagaagctacccaggtttattatgagaaggttgaacctctgttgaagcttgcaggaataaaaactgatgtaacaagtaagtaattttcagaatataatttcaccatctacaaaaacatacaaaagcaaaataatctgaatttgtccttaatgcaaacttgggaaactacttgtaatatctatagcatttttacgtcttcataacctactgcagccagctcgagggttataatttaattatttttgttatttttattagaatattaatattttctctttagaattttttcagatattttttcagacttaaacaattgttagatataattacaaaggaagctgtatacttgtttacatcttcatggagatgtttgctacttacacgttaattttgcagttaggcaagaaattgattttttgctcacttatatagttgatgtctttccatggaattcttccttgggttgttttcgttctgactctgacccctggtggttaggtcaaaactaagcactgaactgctggttttattaatagatgaatttagagatgctagaagcttaaatttgttgtctaaactaagaaatgtacttaggtttgtgccaaggaaaatagaaacttgttaatgctaaacttaatagatgattagtaatatcctttttgatttttttaatttggtagtcacatttctttgtttctttgagacttattttcgtatggtggggaactgagtagaagagtcgatgctatggagaatcgcaaccttcctagctttatttctatgtggcttcgctaacagtggaaatttgcaataaattttaattgatgaaaagtattataaaataagcctactcaggggacaagcccagagtgcaattggaacttcctagtcccagttatagattcctagggaagggattcacagtgatgtggctttactcagctgtaaacaaaggagataagtttcaagatgttaataatatcattgaaacctacacctagtgatctgatggattgaggtagaagaaagttcaaaaaaaaaaaaaaagcaagttttgtaggaaggtcagcccccatgaaatgtgcctataactatagaggttcgagagaaactaccatgaaaaactcaagaggaatttttgaattaaaataaagttatagtgaagaagttaacctttatgtttgtgaccttcggcttatttagaggtgatttacaagtaaaagagaaaattcagatttatgttttctttctactgaagatttccaaagattggctgaaggaaaagtttgagatttgtattagggtgagacaattaaaagttgaataaacatattggcatactcaatgactattttgttcattgcttttacatgtgaatactacaaagcagcttaacatggatattgctatatagcattcacttcaggaatctcattgtatgcttgctctgtgttcaacatagtgcaggatgcgagatgaataagctatcatacttggatgactttctacattattagagattcaaaaaaatgcttaaaaccattataactggggtatacataaaagaactttgatgtctcagaggtgatattttgatcggaagattcaagaaaagcatttgaactaggcagtttttaagaggcagacaaaaaatgagggaaggaagtcaggctaacaggcatgtactgtaaaagttgggagggggggcggagagagagagtgtgtgtatgtgagagagtccatgtgtgttacacccatacatctggagagtttgtgccataactttgctctactttcctcagtttttacattatctgaaatcttactctatcatcataaaatagctgccagtgaatttcatcctttcttattaatatccagtgggatggggagaggtgtgcatatgtgtgcaagagagacccaacatgctttaatcctgaagatgaattaaaatttccttttttaagtttgggcacagatactgtattagcgcagtcaatctggaataatcatttatttaaccatcaagactcttcccaggggctgaggacagatccccttttcctgatgactgaaatgcctcagctgaatctggattctgttagggagaagaaagggcaaaatgacttctaggaaggctctcaacaatgtatactacaggaggtataattccaggttatggatggatccttaagctgcactcagcagtttactcatcgtgtattgatccacagttggtgtaaatttttttttatcatactgttgcaatctggtttggcaaagatgactccaccagcagaattaaaattaaaaaggaagagagaaaaagagattggagacaagaaaactgatatacaaggcctgaactaaggcagaggaaatcatctaaatgtgctttccttcttaattgtattggagacaaaactattatgttctaggatttttttctctaaatttgtaaatattactaagtaccatatttaaacataaaacaatagaatattccgtaaagcaaatttagaatttacttacatttgtgcagaatggctaattattagctgcctaacactcctcctacaggcaaatttataaaattacatcatttgcttataaaaccattttagtatgcatattggctcaatatttatgaaaaatatttcttgaataaacctgtgaatatttgaaaagttttagtcttcctgcctatcttacagtgttatttttgtagttgaaataatatatttgaaactttgtatattatactacagaaaggtggtcataatactgttagtttcagtttcaaaaattatgtcatagtaagatcgaattcgtactttatttgaaagtatatggaagagtaaagcagaaagaggacatatcttctgcatgtccagtgggacattgttttaatgtatccttgtgtgaatgggtgagtccaaatggaattggaattacaaaataaaccctatatgatgagttaattaggaaatagtgctatataaatatgaagtataatatgaagaattacagctagatatatacactataaggtactgtaattttttcataaatttattttaaaaatggatcttaccacattaataaaaacacacttctttcattttgggttgtgctgaaatcctaactacttctgaatatagatcagcatcttttgaaatatttgtgctaaagttgcatccccactctgctaccaccaccaaggtagtatcttatctaatagcatcagaaaaacttccgggagaacctggaaagaattattttttcctaattacctattcgtacacaaatcaaagaagagtatgaacgataagcccatgctggcatatgatatcatttctcttgcttctgaaacaaagcaagttttagagattgtaccattaaaggtgtgacagatattttgaggatcagagatccataggataattcatagtacaatagagtgaaaaagttaaggcagcagagaaatcagactgaaaagaactttcgaggccatatggttcaatttttctccttgtgggtggagcacaggtgtgtggcactcaactttggcttggccacctacactagaggcagagtacgttgttactggacaatactgtttgacattcttatgaatgttcagagttactgtacctttgggcagattagaaaaggcacctcctctgtgctgacttacaaaaaggtgccctttcttccagactaattcatcctttgcttataaaaccatttcagtatgcatattggctcaatatttatgaaaaaaatatttcatactttcaaaatattcatatttcaaaaatattcagcccaaggtcactagattcagcctaaagtcatttgttagattgcaaatccgtcattcccgttagccaagtacctttgtgctaggcataaactgtacaaaatgagaacttgtcagctgacattcgcctctttgtaatttttatgtactagagttaatgttatctcttgtagtaatatgaaataaatgtgccccatctattgtataggagtcattgagatatttgaagagagatatcctgtctgcccctcatctcttgttcacgataggtacttccatcgccttcagttactttttgcattaacagagctgctagaccttatcatggtcattatcattatcatactcaaagacatttatctgaaggaaaccttgatctctgccagctcagggctcttgggagtgcctagtcaccagataattttacctcctgggcagagttgtcaagaaagtggtgtttgttatcattttccccttctttctcctaaaatcacgcttctaacatggctgttaacaagcctcttcatagtgtttctctggttgtttatggctctacttgaagccttccatttcttggaaatgcctcttgcctttctaaatctcacccagcagaaagctaggccatctaatgaaactgtgtcacaaaagattccagtagcctgaggcatcactccttccaattttacctgcattttaatacaaaatctgaaaagtaaatgttcatgcatcatatctagctagagagaaagataattctgtgtaaaagattctttttgttacctcttaaataattgtgggtgtatatggccagtcctgttcccagcattcagatgtgagttaggaagttggaactttatacctggggacgatgaagactcactaatggggtatatacaaaaaagtgatatgattaaatatgtatctgaaaatggttattctggctagagtgggggagaggtttgagggagacaagataaaaggctattgtagtacaggtggagtatcccttatctgaaaggcttgggaccagaactgttacagatttaggatgtttttagcttttggaatatttgcattatacttaaccacttcagcatctctctaatttgaaaatcatggacacaggaaggggaatatcacactctggggacagttgtggggtggtgggaggggggagggatagcatcgggagatatacctaatgctagatgacgagttagtgggtgcagcgcaccagcatggcacatgtatacatatgtaactaacctgcacaatgtgcacatgtaccctaaaacttaaaagtataataaaaaaaaattaaaaaaaaaaaaaaagaaaatactccaatgagcatttactttgaacgccatgtcattgctccaaaatttttagatgttgaagcgttttggattttagatattctggttacagatacttaacttgtctacacatgaaagatatttagtgatcagatcaatcagctaatttagggaattagctgggagaaatggaggaatgctatggcataatttaaagacagaaacaactggccttggccatggagtggttctggagagtggaggaaagggacactctagaaagaagtcattttcctgtcttggggtagatgatggaacacaaaaagaacaatatatttgagagagaatatatttgaaggtatacataatggattctgttttgagcttactaactttaaagtacctacaggacaggaaagaaaatgacatttcagtatcatatcccacactagaattttatcaccaaaccaagaaatgtttccttatgtccaaatcaaatctcacctgattttatttcaggtgattttctcatcaacattgaatatcaaccttaagactttcttgtcttcctgaggaagttgcatttgcaccaaagaggggagggggaaattcccagcagtgagaattgtgttcaaagacctgtaaactgtgaaggcttcacatctcctatttagaaagagcacaggttggcaatctcataggaaaaggcaaatagatgaaagaagaggctgggttacattttttgaaattacatttatctagcaatcctttctttgtttgtttgtagggggatgatttgaatctggctgtcactgattccagggcccacaatagcctgtctaaatacatatttggtcctttctactatatttaaatagtaatccagatcactctttatccttttgcctaacattgttttgtataaccacctattacttcatattataattcattatttcattagcatatattgtctatctccagaatgcaaattcctgaggccaaagactaattcattttgttcattttgctaatatattttatagatgtagatagtcaggttcttttcattttgtttctttgttctagatctttgattttattggacttttgcaatgttacttaaaaaattgctattttcaggcaggttgcattagtgtataatcaaattccacccacaatatcaaaaaaagactattacaaattaaaaaaataaaaatagcattcaataataacacagttctaaagctcattattggatctgaaaaactttaccaatgtaagctttggtataaaagtaaggcttggtgaactgattcttagcataaatattttttcatgatattcttatttttaatgtgtatatgtaagatgttttattttgcattttaaggttgtaagtacttgctgtagttataaatgaatgatcagcacacatcttctttgataacctttcaactttattaatattaatgtttcatatgtagttttattatggctttcttctgattggaatttaatatagagaggttttattcatgtgagtgttaatggcattttgaataagctatgggagaattacaatgtaacactgctggatacagaatgattcttttagacaccaagactaataatttttaacaatatcgaaaaacattgtaggaaaagcttgaaccatgctggcaccagggacagacaagcatgaaagattaatgtaatcttgcatataatgacacacattcttacacaaaaaatccatctgcaatgtcatgtcagtcagcagaaatctttgatgggtggatacagctgggctgtctcttctggcagagctgccctggaaaatgctaaatgtggttgtgatgcttggtgccatctgcagtgtgcccgtttatcctgtcttcactggcatttacgatactgcatagggcatcagtgactgtggagacagcgatacagagtgacagattcatttcctcggagggtctgagctctggtgggcctgtgtgccaccctccttcttgggtctgggtctcttataattggtgttggctttactttgtattttcacatccaactcttcctctttttagtctaacagttccagtacacattcttctggtttgtaaatcttacactaaccttttgactaatttattcatgtaaggttgccaaaccgatttaagattgactgttcaatgccagctaatatgccttatttccaaaatactgctcctcctaagcctctgatttaaaggacatgtgtcttatttagggaatactaaacaggcaccaggacaaattgggtaaccactatgcgtgggatattcccaaatgactttatgtagttgaaacaaatatatgaccttctcttacataaagctataaaacatcaggccagtaacacttagtcctcttgcccatgattaaaatataaatattcaagaataaatgctgttttatgacttgaccatatgtttatcatattattttgccagaacaagttaaaaagtgtgatcattgtttaaaactgtcactttgtgtatgtgtgtgtgtttttttaatagtaatggaatatgaagggcacgctctgtcactgcttaaggaatgtgaactccagggatttgatgggtaggttatattattaatcaatatatgttatatcatttatgtattaaatgccttcactagttttagctacatatttggaacctaacatttaaaaatatttgtagtgtatgtactttggctctatcttgttcatatctatgtaataataattaatgataatatgacatggtcatctatctctcaggatctggcataggaaagcaaaaagaggaatctaattattaaaatactgggaaatgacagtgtactactctatacttactaatgtgcatacatttgcatctataattatttgcttttaccatatatctagagaagcactaatggaagatgttatactggtcacatggcataactatatgatgatcttcttttgcaaattaattgataggtttaatagctacccattggttaacttgtctgtgatagattgagggaagatattttataaatacaagtaaataaatacattatttccagaaacaataagaaataattttaattatctcataatgtagtgactacaatttaggtatgttattcacagtgggcatcggaaaccattgttcgcaatacattggagtgtacagagattgttcactggcatgcaaacgttagaaccaaggcaagtgatataaatttcattgccattttttaaaattaggtgaaccaatttgctaaagtgttggactgatgtgtaagactaaaacatattatattcctttagggaagttctttttacgtgagtagatatttgagaatttaaaaagttgacaagtgtgtgaattatttgtgttacatggtgatgggcagggggcaaagacccataaggtcaggaaagggagttaggtctgtactttcaccaaagtgaaaggcattaaccttcccaaagactgatttgaatgtgctggggagggaagtgatgcaatcaaaatggagtattggcagggctgtttttcagaaatgcttatttatttatttattttttggatgaggagaaaacaatagctgttgagaaagaaaatgtggtaagtaaaacatgatttttccaaaaggaatctaattgagggaagtaaatctagatagcaatattatataaacattgggaatcaaaaatatggggtaggagattacttcagaactttatacttagaggtagacaaaaacattaataggcttcatttagaaaattgtcttacaagtatacaatttaagaaaagtccttgtgggaatcatgcataccaactacctatttgaatatgctgcatagtccctcactagacctcatgagtacatgaaggtagctgcattgcaaatgagtacctgcttcaaaacttgattaaagaatgagaataaagatatcacagatattaaacttgttcttacacagcagcattacagaatgttctgctgaatgcagtatctatcaatatgttttactggtatttgtactgggtaaagggatgaaaagaactttgcagaatgaagaaagacgattgctgaagtgtagtacaataatatttttctctttacctgaacatatttaatccttatttatttttcatggcaggtgttgttatttttcagtgtagagctaaaagatgtatagatttttcagttattatattttataaaccaaatagtttggcctaaccattatatgaattgagttatgtaagtgtttctaaactctatggcatgctgatttatttcagacttacaataatttcaaatttctactgaaagtcatcttccgtgttctaagactctttaaatcaggggtccccaactccgagactgcagatgaatatcagtcagtggccttttaggaactgggaggcacagtaggaggtgagtggcaggagagggatcatttccgcctgagctccacctcctgtcaggtcagcagcagcattagattctcacaggagtgcgaaccctattgtgaactgggcacgcgagggatataactggtcatgcgagggatctaggttgcgtgctcttgatgagaatctaatgcttgatgatctgaggtggaacagtttcatcctgaaaccatccgtctcccaccccaccctgcagtccatggaaaaattatcttcccacaaaaaagtccttggtaccaaaaaggttggggaccactttaaatagcttatttatttttgtggggtcagttttcccagtagaagctgatatggtagttggagtaattatcttaataaactggcaattttaagtcactgtacttagaattacatagagagatatatgaggagaataatagaaacatagtttcttcaggtacttcaaaggaacaattctcttgcaagtaaaattgtttgaaaatggaatattctacattggtgagttttctattcctgaacctgttctaaagagtggctaaaggaaaattttgggggaaatttatagaaaaggtgcagagatgagagaaggttaaccccaaaatgctatggcattttgatgagagacagactcaaatttctttaagaactttggcctgaagcacctccgtctgacactagtggaactattaatagggagtgattaggaaatcacctaacagtttggtttctagatacaggctgaagaagttaagagccaagaaagattctatgtatagtatttagtaaagcaaaacaatttggtaagtaatgtttaagaaatgctatttcctaagattttggagttgtatttattttttttaatgaattacatatgtttctatgagacatcttgtgacatttctaaacccaacagaaacagtgtatcagcacttatgacagctagttctccactgcagtgtgtcctaggaaacactctaagatccactgttaaaccttatgagagcttcagattctatattgctccctattttactgggcatgagtaggaagttttaggaaggaaaataaaagaatatcagctgcatagacttgaagcagtaacacttgcatttataagtgtgagtatagttttaaaaatctatagattttatgcaattgtaaatatatgaattcctcgctattaatatttgtttcagaatttttaaaaaaattgttgagttacttttcttttgttcatttcaccattaattagacccataatgttgtagacattatttggattatattgacattttatcagattgaacatatctgtattacttagtaaggtaaaaagcaaaaacaaaaacaaacttttccagaaagaaaaaaaactgtgaatcaaaactacaacaatatattgaacatttcatagatgatgggttcatagataagtataaaaacattcattaaaaaaatctttatcactctttgaaaaaggatatattatcacccagtgtttcttttctagacagaataattctgtttggagccatggcaaggagtttacttattttaaaaacaagatttgtcacatgcaaaggattagttactctaaggtttatgttttagagtgacacaagtgtgattaactcactataaatgattgaatactttgctttttgcctttcttgtatatttagactcttgtgatatttttgtaagaagctgttgatgaaaaaaaccaaactgtaaaatatttaaagaggtttattttgagccaaatatgagtgctcatggcctatgataaccccaggggggtcctgagaacatgtgcccacagtagttgggttacaacttggttttatacattttggggatacagaagttatagccaaagacataaatcgataaatgtagggtattcattggtttggcccagagaggcgggatatcatggagctggtgggaaggggagctcacagatgaattcaatgattttctgattgtcagttggttgataagctttgctgaaagattagaagtcagcagaaagaaatgcttgagttaagataaatggggtggtgtaggctgggtgcagtggcttagcagtggctcacacctgtaatcccagctctttagaaggctgaagaggggagatcacctgaggtcaggagtttgagatcagcctggccaacatggcaaaaccccatctctagtaaaaatgcaaaaattagccgggtgtgatggtgtgtgcctgtagtctcagctacttgggaggctgaagcaggagaatcacttgaacccaggagggagaggttgcagtgagctgagatcacaccattgttctccagcctgggcaacagagcgagactctgtctcaaaaataaaataaaataaaataaaaaattataaaaataaagataaatgaagttgtggaagcacaggttcttgttatgtagatgaagcctccagatatcaggcttcagagagaatagatggtcaatatctcttatcagaccttaaaaggtatcaaactcttagttaaatctctcctggatcaggaaaagacctggaaagggaaggagattctctatagaatgcaaatttctcctgcaaatgatagctttgcagggccatttcaaaatatgtcaacaaaatacattttgggataaaatactttgatttcctctagggcctgctatttgttatttaatgctataccagagtcaggttggagttggggatcttattgctaccaagtctgttttgtcagtcttatgatctattttttttttttttttgagataaattctcaccctgtcacccaggctggagtgcagtggtgcaatctcagctcagtgcaacctctgtctcccaggttcaagcaattctcctgccccagcctcctgagtagctgggattacaggcatgcaccaccatgctcagctaattttttgtttctttaatagagatggggtttcaccatgttggccaggatgatcttgaactcctgacctcgtgatccacccttggcctcccaaagtgctggaattgcatgcatgagcctggccaatgatttacatcttaatgccagtgctggccatttgcgcctaaactccaaaagacaagagggtataaggaggcatatccaacctcccttcctgttatgacctgaatagtttttcagattttctttgtgaccttcatggccaaaaggggaggatccattcagttagttggcgacttagaattttatttttgttttacaaaacttatttcctaggttgagtcactttacctgaacatgatcttaatgattgaatagttgttaacataaataaatacatattttttctaactcacttaatttcacactggttctactggtaaactgtttttcaaaataataagattctcataaggctatttttattaggtttcatatatagaaaaggtatctaatatattgaataatattgtagcttctaagaccaaaatgtcttatttcaaatccctgttctattacttactagtggtacaatcttgaaaaagttactttatctttctatgttttagtttcctaatctgcaaattgaaggtaatattacctattgcatacagttatttctccacttaaatgagttaatacatggagagtgcttaggaaaatgtctgatatatatatatagtaattattcactaaatatttctttattgttataattgtcatttgtattagtttcaaaagatttaacacagaatgtattatgacaaaatttcagatgtttcagaacatgctcatagggaggccacctctaataactctagcaatatgttaacatatgcatgacgctataattgtatgcaacattctaggagttaagtgttcgcatcctatgtatgtaagggtcaagttatttggtgctaaattagatttttttgggtatgactccacatagtctttttggtcacacccatatgtcagcatttagacagccatggattgagggttacgtttaagttcacagattagaaatctcatagagatttttgaaatcaggtaagtttcaagtcaaaccttggtttttttcattcataaagatgggactgtggcctattttgcagacttctgaggatttaatagaaattagtaaacacattacctgatatatagtttgtccttagtaaacatcattccttttctctgaataggtggtcatattgcgaacctctggaatcagtttagacataagaataaaacacacctaatcaaacatgacctgggtcatatcttgagtcttctaaccagagtagccttggattgcccaggctatgtggagctagtgggatgaggaagatggggactagagggaatagatggccgagagaaagatggtgggaactgactggaaagacactttcagcctttggtcaccaccctccagagcttcctaaacttagagaaccagtaactactgctgactgtggcccatagacagttttgtttgaaatagtgtttttaaatatattgaatgctagttgcttagtatttacaaattaggagactcagccttaaatcagaatctctggcttctgtagaaaaaccagatctgggtccattaggcctcacacgtgatgtgagtgggccacagcaaagaagtggctgcgcctttagattgagcctactcttccattcctgctgggcccttgtagcccttgagttgtgacacctgctttcactgaggcaaaatccactttccattgggttaactggtgacattttgatacgtaagaatattttgcttcttttgaacataaatgattatgaaatgaatttctggtacttctgtgttattttaatggattctgcccccatagtctacttgatataaagtcttaaaaaatatactagtagtactatctaggatcaaaggctaatagtattacatctagaagcaccgtatagcaataatgtcaaggagatgaaattcaggtcaggtttgtaattactacattcatatagtaatgataattagcagtttcttaaagcttcatattttatatgatttttattgctatctgtcttttcagagctttattgagaattagcaggattttatgactttggttggtgttagttaaatgaattgcagatgacagtattattaacaagaaatgagaatgatatgcttttggatgttaacagagcaaaacgctggtcagatgtgaattaacatgttcaaaagttttcatatctcttaacacacttaaagctattttgtctatggggaattatctagttattatatttgtgaagtaaacttacctgtgttgtgtttgtgttgtcttacccattgacacatattaacatgtttaaaggtacatgtgagcagttatgcacatagactacaaattagtaaactattttgaagtctagatttcatgacttattaccaatcattctgaagttttgccttctttgcttgatttgtatttttctagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggcaagggagtggctacagattcattaaactgacccttctccctcttttcctttcttacttgctaatctagacagcacaacacagaattaatgaacagactttgaaagatccagacttctggcatccccactagcaaatgtgagacttttgacaagtcatttaatctctttgagccttatttttctaatctatagaatagggatcacagatatattattcactttattacaaggttattgtagtactaacgtttggtttagtaaagggtttaatatatagttaaaccatcagtatatggaatggttattattctcccttcgcataaaaaatctgttgattacacagtaccaggtaagaagtttcaaaacagggccactccagtctagctgcttacaattccatatgaggtgaatatggtaacttgcataattgatgtataaccagataaccttgagaatgccaaaattacttgtgactggaagggaggataaggtttggaagggtgagattcttaagggcaaggctttttaatctttctactcactgccatttttcagcatctagaatagactatgccacagtgatgctcagtgaagcctattaagtgaatgcatgtaaagaagactttatatagtaaatgacacttggattaggtcttaaaatgggttggagctggcctgaaaaggtgagaatgagttattttcttggctgcaaaagtaataaagcaaaggcaaaacccaggagtgtttgaggaatagtgaaaaggccattcagtggaagataatggtatcaaaataggcccaaccatggaggctcctacatgccacagtaaggtctctgaattgtatttgataagcagtagggaataatgggatgtttcagagcaagggggcaacctgattggagcttgttccaggaggattcattttgcctcaccgtgtggaatgattagaggttgggagcaggagaaagtagaggtcagagacacggagaaccgttagagcaacactgtgatccagaaaagagggaaacatcattcaaaagctgattgtattacacaatcactcatccctatttaacgaacggtgctgggaaaactggctagccatatgcagaaagctgaaacaggatcccttccttacaccttacacaaaaattaattcaagatggattaaagacttaaacattagacttaaaaccataaaaaccctagaagaaaacctaggcaataccattcaggacataggcatgggcaaggacttcgtgtctaaaacaccaaaagcaatggcaacaaaagccaaaattgacaaatgggatctaattaaactcaagagcttctgcacagcaaaagaaactaccatcagagtgaacaggcaacctacagaaagggagaaaatttttgcaatctactcatctaacaaagggctaatatcctgaatctacaaagaactcaaaagaatttacaagaaaaaaacaaccccatcaacaagtgggcgaaggatatgaacagacacttctcaaaagaagacatttatgcagccaaaagacacatgaaaaaatgctcatcatcactggccatcagagaaatgcaaatcaaaaccacaatgagatatcatctcaccccaggtagaatggtgatcattaaaaagtcaggaaacaacaggtgctggagaggatgtggagaaataggaacacttttacactattggtgggactgtaaactagttcaaccattgtggaagacagtgtggcaattcctcagggatctagaactagaaataccatttgatccagccatcccattactgggtatatacccaaaggaatataaatcatactgctataaaggcacatacacacatatgtttattgtggcactactcacaatagcaaagacttggaaccaacctaaatgtccaacaatgatagactggattaagaaaatgtggcatatatacaccatggaatactatgcagccataaaaaatgatgagttcatatcctttgtagggacatggatgaagctggaaaccatcattctcagcaaaccatcacaaggacaaaaaacgaaacaccgcatgttctcactcataggtgggaaatgaacaatgagaacacttggacacaggaaggggaacatcacacactggggcctgttgtggggtgggggaaggtggggagggataacattaggagaaatacctaatgtaaatgacgagttaatgggtgcagcacaccaacatggcacatgtatacatatgtaacaaacctgcacattgtgcacatgtaccctagaatttaaagtattatatatatatataatatacagccttatgaacatatatatatataaaggaaaattaggcaaaatagcattacttgaggtactcaatagcctggcagagcagacattaagggtaagagagactggacttgaatttcagtttggtacttgactttgggtgggtaattagcctttattagtcttgattacacatttaaaaggtttaataaggccgggtgcagtggcttatacctgtaatcccagcactttgggaggccgaggtagtggatcacctgaggtcaggagttgaagaccagcctggccaacatggtgaaaccctatctctactaaaaatacaaaaatgagctgggcatggtggtgtgcgcctgtgatcccagctactggggaagctggggcagaagaataacttgaacctgggaggcagaggttgcagtgagctgagattgtgccactgtactccagcctgggcgacagagcgaggctgtctcaaaaaaaaaaaaaaaaaaaagtttaataatgtccatccccatagggccattacaagaatcaacttttaaaaagtcacacattatcactaaaaaagcaaaatatttttccctatgattatagaaaataatgcacattgttgaaaaaaattcatattttgataaccctattcatttagtatggattttagaatacttagtattgttgataagttgacagagcataagatattcaaatgcccttttagagtgtaaagtctttcagaaagtcagaatttaaaaggagagagatattcagatataatctgataattctagagtatataggaaaacctaaaatggtttctaagtagaagacaccaagatgattttgactcaaagagaaaaatgatgcattttgggccatcttttcatggcattttatttcttgacctttttgctttactttagtagttctgactataatggtggaaactttccaacatttccttccatgcaaagtggatgtgcttaggacacttcattagtacttaaattcctgaggtcattcattgactgccatacatcagaaatagaaagatgggtgtccctacaggtatgcctttgacataaatttggtggttggctataaaaactggtggttattcttatgttttagtatgtaattcagattttataaagaaatagcatttagttttatcactattataattttgaagagtatttctgatttggggagcattttatgtattctttggatatttgtagtaatgccattttaacctgtcttgtttagaagacacagtatgctgccaaaattctggtcattgcataggagttctagcattctaattccatctaataggaggggaaagtcatgtgtggggtatatttaatatgatgactgtatgcctagtcagggcttttgatagagaatgggaactagaactaggcaggaagttttcaagctgaacatgaggagacagtgtgcctttgaagccatttgcctcctggagagagacacccagagggagagtgtttagtaaattaatccactgagccaacagactaagctgctgaattatggtcagactcaaatggatcagatgtggagaagcctgtatttgaactgctggccattaggaatggtgtttgttgctatgggaactggtgctaaggaactatactgagagactctgattaaaagggggagggggaatggagaaaaaagcctgagaggacataaaaataaaaaagcaatccagttgttgtaaaacaaggctcaagccacatactgatggctgtgaaccatatattcctatagagtttgcataaataaattcatgctttccaattaatttgaggagaataaaatattgccgagggactgttaatttctatgatatttcaggcaaagaaccaaagtgtaggtgccgttttcatgagaattttagatatgcttgactaggaagtcattacatcacatttatctgtttggatgtgggagacattaacagccttatgaatattcatggtatctggttaattaagttaattgttctgcagaagtgcttgcacttccaaggacattttttttttttttttttttttgcctccatagtttctccctggtatttcatcagtaattctttacatgaactgctacttctgtccttacttttttgtatttggaacattttagcagctctcaggaggaagtggtaggcaaagtttctggtagtgttaagaaaaataactttcaggctaattaaaatgtttaccttgaggtagaacatttatagcttttgtgagaacattaaaattacgccattgttatttatgtgagcagcatgttcttttggcatgtagacatcttttcaaatagagtacagtttcctgaaacaaaatgtaatccatctttcagattatcccaacaaaatatagaacaagctatcgttttgcaattttacatatactttctcataaactttccttttttcttcagagtgtcaaaaaccacatttaaagactaagatacagattaatgagtagtcaatgactaaaataattttctgacttctagtcatgtctgttatcactgccaacttctacagaattagagaaaagttgcaaagcctgagaagacataaacaatttttaaagccatctctagcattctaaaaaaattttgtacttgggcatacccaccgtacttcaaactcacagggaataaatggtctttattttcttaagtcatgatatgtgtcattctctattgcacatgacattacattatgttttttaatagcctttctagaggaatgcttttacggtctactcataattaaccatggtaatggaggaaatgtgtttcatggagtactgtaatccatcgataatcctaaatatctgactctaattatgtggcctcctccaaaatctttaccacaaatctgattgggaagcacaatggattgacttgtttcttccttttctcctgatccattccagatttattagcaattagatggtcaaagggcaggctgtagagggccacaagatcattggaaagaccttgataaagatccactgagtaacaggtttctacactacttgttctcaaaacttagggtccatagactcaccttgtgaacttgctaaaacagagatacctgggtcctccctcctccaaacacattctgagtccatgagttggaggtagaacccaggaatgtacgtttttaacaagctcccaggtaatgatgctgcttggaccatgcattccagaggagtttctcaccaagtcactgtgcatacaaaccacctggggatctaataaattgcagactctgaatcagtgtgtctggaatggggcctgagaggcaacattttaaaaataatatattttttacttccattaatactgctattactgttttaatacctattatccttatttttaaatggacaaaaattgtatgtatttattgtgtacaatgtgatgttttgaaacatgtatacattgtgaaatggctaaataaagataaacatgcataaaattgacataatgatcacatactgattttacattgagaacacttaaaatctcccttagaaatttccaagtatataatgcattgttactaactattgttttagcctgttctcatgctgcaataaggaaatacccaagactgggtaatttataaaggaaagaggtttaattgacttgcagttcagcatggctggggaggcctcaggaaacttacaaccatggtggaaggcaaaggagaagcaaggcacattcttcacaaggtggcaggaaggagaaatgctgagtgaagtggggaagagtcccttataaaaccatcagatctcatgagaactcactcactatcacaagaacagcatgggggaaaccacccccgtgattcaattactcctacctggtctctcccttgacatgtggggattatggggattaaaattcaagatgagatttcggtagggacacaaagcctaaccgtatcaactgtagtcactaggttgtataacagatctcttgaatttattccttttacctgaaattttatatcctggaccagtatctccccagtccttcccacccattagccccagtaaccactattttactcttcgcttttatgagtttaagtttttcagattctacataaaagtaagtatttgcctttctgtgcctgtcttatttcacctagcataatgtcctccaggtttatccacgtgttgtaaatgacaggacctctttaatgccaaatagtattccattgtgtatataaacaggctgattgtccctaatctgaagacttaaaatccaaaatgctacaaaattagaaatgtttgagtgccagcatgatgccacaactggaaaattccacacctcatgtgacaggtagcagtcaaagtgcagtcaaacctttgtttcatatagaaaaatattttaaatattatataaaattatcttcaggctatgtgtataagatgtataaaacttttatgtttagacttgggtcccaccccccagatatctcattacaccaacagtgtaaaagtattcccatttctccacagccttaccagcatctattgtttattgactttttaataatcgccattctgactggtgtgagtgtggttttgatttgcatttctctgatgatcagtgatatttagctttttttttatatgtttgttggccacataaatgtcttcttttgagaagtgtctgttcgtatcctttgcccactttttgatggaatttttttttcttataaatatgtttaagttccttgtagattctggatgttagacctttgtcagatgggtacattgcaaaaattttctcccattctgtaggttgcctgttcactctgatgatggtttattttgctgtgcagggattgttttcttgatttctttttcagatagttgtaagtgtacagaaatgctactgatttttgtgtgttgattttgtgtcctgcaacttaactgagtttgtttattagctctgacaattcattcatggagcctttagggtttcctaaataaataagatcatgcctacaaacaaaggcaatttagcttccgtatttatgatttgcaagccttttatttctttctcttgcctaattgctctggctagaacttccagtactattttaatgacagtggtgagaatgggtattattgtcttcttgaggaacaagacattgtttctcaactcatgagagtaattttaataagcactcaagtattgtcattcctgtttgacagtaggccgtattttgagtaacaagggtcacagcataacttgccttttggtgaatcagttggaaccagtttgccatttagttaaaataaacttttctttgcactggtattactagaagtaattgtgcttatttataattaataataattaaatatgcttattcttagttacctaaaaaattatgatattaatgacctcttggttgataatggctaagctgcctcagcttctccaatttagcaacccaagtacatatcagttcaaagtaacacaaattgaagcaattatgtatgatcacataggaatgcttctgattaacaaaatccagaggactggtctttgccttcataaccggaacacaccacatgcatggtttcacagctcttggctattattggacttacttattatattctttaattcaagaaaaattgtagcttcattcattctgttcttaataattttaaattctctttagcctcctgggaatgggaagggctagctggtatagtcccctgtatctcagatttcagttacacataaacattaaaggggcctgacttagggcgctctttgcctctgtggactggtggggaaaatccaggtgtgtcttaaattctaataatcatgaaaatcagaaatcataatgtttcaaatacaaatcttcatacatgggaaatacaattgaattaaacattttcttcaatgtaggagacatttgtcagataacagaggggattctcatttggctaagagcttacctctaagattcattaaatgtgtttagagcatattttttgtagtttgtagttattttatttttctgagttattatttggattattttctcttttatttatgtatgcatttgtcactgctccccagaggcacctcattttggcattgaagctaaaaacccattcattaaggttgggatggagtgggctttgatatagctagcatttgggaggtagaaaatagacattcgtgatcaaaaaagctgtaagcggttactataaactatttttaaatttctaagtattttaaatattgaacaaatgtgtagacatttgatgtgcatctatactgtgaataagaacttaaacttctaatattcacattaactttcctgattttataaattctcgtttatttttcatctgaacattgaagaatgacatctacataaagtaaaagcaaatgttagtttgaacacattctaccctaatagtgcatgttttaaaattgctttggcaggatctaccaatgtattggcacattctcttcatggagttcctcatgtgataactgcaacattgcacattataatgggtaagaattcttccaaagcagttcatattttataaggaaatgttgatttatataaggaaggccatcttatttccatcagactttaagaaaaggcaggttctttgtctcttagagtagagaaatgtttgactaaaaaaccaaaaggcaatgctttactatgtggattgcctgtcttttcaaaatacttgctttgtaaagagcagtaaatgaagttttattgtaatctgtacagaaaaaaaatattgtagtgtgctcaaaattataattttataaccagatgaagaacattaatgaatactccttaagtatatccaacactgatgtaggactgtaccaagactctaggactaggattatgttattaatgaaaaaacataaccagaaaaaaatttcagccagtagatgtctatagatattttattatccctattggtaaaaagcatataagctcaggtatatgtaacactaaactactgttaaatctgtgtttaccttgcctatctactttaacttcgtttctttgaccatgttttataggaaatagcaataagctgaaaaatttagtactctgtgtttcttcactagtacctgaacaagttaaaaatggtaattattgtagttataggtaaagggaactgaagagaaagtgaggatgttcatggtctacagtacctttagatattctcctataagccaataaatatgctctcttatgtttgctgttttgatacaagtcctactgtactcactgattaatatttaatgtaatattcaagggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaagtaagtctttttcttaaaccaaaaattgtatcccaggttcaatgactgttaataacaaatttcattacattttagggcagaagactgtgaaatatcatttttaccatttaacagctctgatgatgtgcaagaaaggtaggtaaaaactcaatgtaatacagataacctgtatctttaaagcataaaacattctgacaaacaattgatcagacttaggatctttggttatttttctaacatagtagtaaagaatatagaatcacagactcttacaggtcctagtaagcaaacaactactcactcagcctttttctctttttccttccttctttcctcccttccttccccctgtctctccctccctccttccgttctctttttcccttcccttcccctttctttcctttcctttgtttttttccctttctttccttttccctttcccttttcttttgagtgcctactatatgccaggcactttgaatacaacaatgcaccaaaaaatgaacaaaacacacagttttgtccctcgtgataattttggtctagtgtgtaatacaaatattaaagccatattaaagaagggttatagtctttaaagaaatagtacattattattccttataatactagtttacctttaaatgaatcaacacattatgttggcagcaacaaaattgtacgtttttacttactatctaattgaagaaagtatttaacatatataatgatgagttctctaattttctcatatttaatagatttgtgtgtgtctgtgtgtctgtgcgcgcgttatctgttttatgtctttgttttgttttctttcttttaggagggcacagggatctcccaaatctggtgagtcgaaaagtatctccttgagaactgtgccaggttctgttgacattttgttctggtgagggaaaataaccaatcactttcattacctttagactgtaatgatcaatggcaaatgatccagggtcagttcttgaatgtcagcattatggcaattccttgcctgtgttcagtggcacctagaggcttggcacctaataccaggttagtaagcatttttattgaattgttgatacatttcttatagaccattttttttccagggtatccaattaactgttggttagctagaaacttaacaggtagtttatctttgtatattagagattctaagggatttgtcatcacagtaggttgagaacaactgttgaactggaataattatcagataatcattgactatttaacgtcactgaggctaaaataatatttcctaagttttattgatagaattttatgcctactttacttgatttattcatttagttgtggagaacattatattaaatactgatatttcttgtgaatgtctttgctttccaactttaatgcaaacataaatatccttagcatgaaaatcacacatatgtatatttgatactgtattagtctgttttcatgctgctgataaagacatacccgagactgggtaatttacaaaagaaagaggtttaatggacttacagttccacgttgctggggaggctccacaatcatggtggaagatgaaagtcacatctcacatggcggcagacaagagagcttgtgcagggaaactcctatttttaaaaccattagatctcatgagacttattcattaccatgagagcagcacaggaaagacccacccccatgattcagttatctcccaccaggtctctcccacaacacatgggaattatgagagctacaagatgagatttgagtgggaacacaaagccaaaccatatcagatacttttagtcaaaagaaacatttcagttctatttaatgtgaatagtagtgcatatcaatctcctgcccacattttcaattgaataaaatatgagacatcttatatatatctttttatccatgggatatagacattccttctcttgcacattcttcttaatcagctgtccattatggggctgaaaatatttctttcctgaatccaatcctgtagagtgtaggagaaaggatcgtgagtgttgtgaaatataggcaataaacggggaaatattcaaagttagagaagaaaaaagagaaactgcaaacttcgatattgaaaacccagatggcaaggtcctcattaattacatctagtgctaaaacttcaaaggagtattttgaaccttgtgtgatttagaaattgagcctggtggttttccccgacaccttcagaaatcctagatagctgtgtgctttcataatgtagtttccctgactaaacttgaagacgtggctagctgaccaaggagctatgtttggcaggacttgagacaatgtttatctaaccctgtttgtttaaggaccttcttgggagggtagacctgctcttctgggaacaatcgattcatagctccttcaaagccactccataaatgttctgcttgactagaattccactgttgactctgcaggcttaatcagtattaatgaatttttcagagaaggatgactaattagagatttcttctgtggtttataatcacaacatgccatctttgcaaagaccttttgatcaagactcatttgaccggagatttttcagagatgtagcttctgatgattcaggatgattgaacaggagatttcactttcttctttttcccccaccatgataaataataatttatgttagaatatctcagtgcaaattgccagtaggaactaatattcttatattctaagtattctaagattaaatgtgttcatatatgtgagacatttaaagcagtgccagccatgtaagttgtgtttctatttcaagtaaatattgcaaagcaggcataggatagtgcttttaatgtttataaattatgcaattaaagatgcacagtaacactaccatgaacgttttggtgctgtttatttttaattgggaagaagaagcatgatggaaagcatactgagcacctggagtattggtgctgatgaccattttttctctgtgtgcctttgaacaaatcacttaaacttggagttgtcttttccctctacatgaaatgagcgaatgatgagataatctctaaggtcccttacagctctgacttgagctttcataagatactaagagctctttttttattttgttgttattcttaaattaacttcatgtttgcactgaaatcaagctagaagtcatttgtatgtatttctgcaaactgcattctatagcttgatgcatttgtgagtggctgttttggcactaaatcacacctctgaattttcactctcttatattggatggaacagttatgcaagattaaaatgttcagtcatttaactgaacatgtgtggcagcatttgttcactccatttcatccatccaaaggccactttgatttatttcatttcctatgtcacttagaccttctgtctataaataaatatttaaatcacactttagattttagaaaatgttgagctatttgttacacaacttgtgcatattaactcttctataatacatcttttaacaacatagtttcacatttagaatttctaattacattgtattttaaattatgtcttgatatgtgagtaggacgcttgatggtttgctttgtaaaatgctctaatgtaagagcttattgagaaggaagccagtgatttaataaaactcatttgaaagcctgcatcatttaaaaaatagcaagatacggtttatgaattttaggtaaacgtaacatggtgatttatctatcttgtccaatactttcagtaaacagtatacttgttataaggaacagtatgtcataatttttggtataatctcttagtaaatttcttgatgtctaatagaaatatttaatttcagattaaataatggaagtatggctcttataattgcccgaaacacttctcggccagaatttataaaacacctgaaaagatatgccagtgtaaaaaatcaggtatagtaaattctttttgttacttatttgcaaagctattaatcatgtagaaaaagatgctgcaagaattgacatcgaatcctgcctcataagaaggttttattttcttctgaatatattaatcttctttttcccaatctatttcatccaaattttgaaaagcatccgccaggattaatatagattggccttttttgaatgatgaattagtggttatgtatctgtaaccacaaagataaaataggaaatgtagtgttatattgcaatgtgaaataaattaaggataaaattccatactcaggctgttcttcagaatgaaaagaagtgaaatttgagagtttagccttcttgatattatggcagcagactttctaaagttatgatctttagatcttcctgacatttgtttgcatatctgcattgattgaaatagatctgtagatatgtatttaaaaatatgacagttttatacaaatattcattcaaaatgagaatatgtgaagatatacatttccacttaagtgatttgctttaaagagaaacagtaactattacaagccatattattttggcagctgttttgacctgattattaggaaaatgatccttgaactatgtgaatttctgaaattgtgagtctttgaagtacataggtatggttgtaaaaccctatagtttcacactttttctttttctttctttttttttttttttttgagttagagccttgctgtgtcacccaggctggagtgcagtggcgtgatgtctgctcactgcaacctccacctcccacgttcaagcgattctcctgcctcagcctcccgagtaggtgggattacaggctcacacctccatgcccagctaatttttatatttttggtagagacagggtttcaccatgttggtcaggctggtctcgaaactcctgacctcgtgatgtgtccacctcggcctcccaaagtgctgggattacaggcgtgagccaccacgtccggcccacacattcttaaaggtataaaatggtgcttggatagagttgggagataacagacgggaggaggaggagagtaaacccagccaatgactggcagctgaaccttgcttatgtaccttagccatagcaagtctctccatttttgcctcattatattttaaaactttcttaggccatcttcatgaagtttgatctgtcagtaacattatttgatcctcatgtattgaacaactaactgggctgcttaggaacttaaatcataaaaaattacagtcccactttctttatatgtcaaagtagatcagcaggtataatgtaggttgtgagcctacataacagttttatgtatgtgtttgggtggaatatggagatttattgattttcaaaggaatatatgccctttcacattttaataaatttctaaacattaaaaccaatttttaaaaaacccaaagcactatatattcattgctgtttttaagtcagaaaatagaaacaagaaaatgattttaaagcactcaaaattccatgttcctcaagattagtgtcattaccttggtagaattttttccgaatccttttttattaaataaatgagaagtaaagtaagtattaacctcattcatgtacctctatttgagaacttaaatagtattaacctattaatgtacccctgagaagttctgtatttattttggggaggtgtatgttgcacaaattgtttatggaaggtctcttttgaaattgcctatggggcaagtctctcaggcaatttttgtaaacattcttcttcttcatttttttaaatcaatatacctttcttctgattttaaaagcaatggttaccttacacataaagacagacatacagaaaataataaaaatctgtatcgataggaagacgttttctaagagataatattatgcaggatttatcatattttctcatgtactctacgaggcatatcttgcttttgacacaagaaacagttgcctgtgtgtgattcactggccttaactctgatttatttatcaactttcaaaaattaaaatccatgctattttttttttttttgcaaagaattctaaaatattttgcatagtgtatatagtaagaaagattgattcccagggtgactgctttcaagcaatgttaatttgatttgttaattatccacacaggtgtgtttatttaggctctttccttcatggtgacattaaaaatgtgaatttatataaattttgtaagattatgaaaatcagatctatgtaaaaatcatgtctactgcataattcatagcagtgctggtattcaggaaggaaaatgtggcaattcagtttaaggagagtaacatctgcttctctgaaccatttttaccaggttgaataagcgaatgttactgtataacactgtaaaatagattgaaaccaccatgtgcggagtggctcctgttccttccccatctctgtgtaaaattagatagaggctgaacactacccttcaaagtccttgcagctccatcctattgctttgccccccttctcactgtccacacttttctctttcattgtgaccatttttggtagggagtttaaaaccttaaatgtgagtgcttcccccaggatttctttgcagccctctcatcttctcaggatgccgtctcctggatggcctcattgcccctcacttttgaactgtctgaacatcatgcactcccaagggttctgtcatctcgtcttatctgcaggacctctgtcttcttgtatgctgaagaggttctgaaattcaccggcatctggaggccaacatgtctacagccgaccttatcttttcccctaaagttgttccttctgcgttgctctgtgcgggtcaatggcaccactttctacccatccaggttaccctgaactgttccttcttcctcattcctcactaccagtcccctaacttgttctgttggtctcctcttaaatgtttctaaaatttctccctcaccttaattcaaactttaatcctttcttgcttacagtagcctccttttggccttcaggttctctggtcttgtcttccatacctctttttagagaaacttttttctaagacacacattggatttctctcctgcttaattcttcagtgcctttctcttgttgtcagaataatatggaatatcctcagtctggaacacgtggcctttgtatccaggtccctgcctgtgttgcaaccccacctcttattaccaccctccaccacattcccagtgttttggcattttattcgttggctaaggttgccataacaaataccacagaaaagatggcttaaacaaacagaaatgtatttctttcatggttctggaggctagagctgcaagacaatgtcagcaggtttggtttgtcctgagtcttctctctctggctggcacatggctgctttctcacagcacccacaagtgagtggtctttcctctgttcatccccgatgccttttcctatgtccaaatttcctcttcttataaggacaccagtcgtattggatgagggcctaaagacatcattttagcttaatcgtctctttaaagatcttatctccaaatatagttatgttctgaggtatacagagcgaggatttcaatacaggaatttgagggccaaggggcatgatgttgagcacctaggagtcacactgaattctgtgtagttgcttgaccatggtttgcctctagttttgtaaatgcttcctctctccagactttcttctccaggctaaatcttatatgttctttaaggctcaattcaaatgggaagctttcccaacatccatagcctgtttgcctcctcttgtttcctctgttgaactccacacttgcaccatcatggcactcccctgtatcaaaattgtaactgtttacttctcctccccgtgccccaaacataccctcacacaggatactaagctcttggctcccgaaagtcccacttaacagcgtctgtggcttcacagttaaagcatttgaaggatggctagatcttcattttgtgaggagtgcacatgacaactgctgatttaagataatagacttactggtggtggctgtcaattcttgacattccttggcttacagctgcatccctccagtctctgactctgccatccttggcattcttctctcataaggacatcagtcatattggattaggtcccgccctaatgacttcatcttaagttgattctacctgcaaagaccctatttctaaacaggggacattcacaggtaccaggggttaggacttgaacatagttggggtggtggagggaaatataatttagatcataacaggcagttgtgtgttttaaatgaattatcaactaacatgaatgattatgtagataattctacaaggatgaggcatgtagccaaggctttatacccgaggtaggaggtctaacgcagttactgtcaaacagttttgcttggggccctctaattctgtacctcagtcacaacagctgatgccatcatatcatctactgtttaactgtgtttacagtataaactggaaagttggctggaccttggtatctacatatgtaaaatatgggtgttggggaaaatattagttttctgtcaacttttaaaactgtttcattgaggtttacatgtggaaaaggggaaaaactatgtagatgatgtttaattaggaatgtatctcatgtcatttttctgaaaactgaaatgagtagttatacatttctgctcaagttatttggctatattttcttaattatgtcagaaaatacatagtgctttttcagtatagtttccttaggcaaacaagaaaaaacgcaagttgaagtttaccttgcaccattctatagtggtaagtaaacagtgatcttgcagcttgtgtccattgttaaagtgggaatggggcaggcaaacaccttttaaaatccatatttgattggctttctcttttaaaagaagacatacatcccattttatcttcagaagtttagacttgcgttcttccaaattaaattccaagtgtgaaacttgtactagtttgctttatgtcagctaaactaattgacaagttgataatggattatatgtcttctgtatctacaggccagtattaaagattatctttaattgaaaaatctacagtatcactattktatgtaacttctcacagatatgtactatttgtcataaaacaagatttctaggtgctagatctaaaagaacccaaaaggctttggataagagattccttcttccaaaaaaacttggagatccctgttcatagtctcaaagctattaaaatgtcagcatacatgctgatatttacttgtgagagagggctcagtgaactttgattcgcgttagtagctagagataaaccaagtataatgattatttgtatttatttttagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattaggtaagtctatttatttcaccgcttattgtcaaccagtaaacataaatctaatattacaacgaaagctctcttctctgaactatcaaagcaggcagttggttagtttttaaaaaatcagtaaatcagggaagcataaagagacatgcacaaatttcaataaataaaaagcaactttacatttattcaactgttatgtagacccaaggcattttctttggttatgcgtgtctacattggctttctaatttattgttgtgcataaactacagataatgtctacaacttccattttggatttttaaaaatggatcaagatcttaaatcttttagtggagccatctgaatagtaaagtgttagatttttatccttccatcttagtttcctctcactcataattactgtaacatgttttgttcagtaatttgcttttattaggcctttacagagcattcaacttcccttgggaacaattttacatagcaactggtataaacaggtttaggaacctgcaaacgcattcttggtaggcattgtgacactcagtggttagaagaagcatgcaggggtgcccactagacatgggtgttctagaggcataactgactgttttacagaggtaatggagagcattggacaatcaaggaagtcagttaaggaggttttagagcaattattgttgttgatgatttatcaatcagaccttctcagttttctagattacagctctgttgggaatgctgtgtttgttatcaatttgtatttggcattggcattgtgtaccatacttattaggtgtatgtgaaaaacaacaaaataagttgatgaaataatgtattttctttacagattgcatccaagacttatcagtctttatggaggaagcatggaagaaatgattccaaagtaacatgtaattgtttctaaaagaaatgtacaaactagaattttaatataaagaaatgtggccatgctttaaacctgtggtccccaccctttttgggaccagtttcatggaagacaatttttccgtggatgggggaatggtttcaggatgaactgttccacctcagatcatcaggcattagattctcttgaggaacatggcactctagatccctcacataccagttcaccatatggttcgcacttctatgagaatctaatgctgctgctgatctgacagggggaggaactcagtaatgctccattgctctaacctcctgctgtgtggccaaacggatatcctaatagaaattgatgttactaacaattagcctctagggctttaaaagtcaagatgaaatatcaattcaaattctgtttttagatatcaattcaaattcttttttttacaatgtgtttattggacacacaaaaaaactttgcaaccatcataatacatcaatatttaacctagataattctgaaataatttggattctttcatttttcaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttcttaaagtggtagggttttaaaattcatgatacaagtaacaaagtaagttgataacaaatactattttgaactgggcaaaatctagcccaatatgtaattgtgttccccttgtatctgagaggcctgtgttggacaaccatagtactctgctttcactgtgctcagataacctgaaatatatagttgtttctgagtagttctgagtaggaaagaaccaaatgtaaatttccttagagaccatcctggagaagacagttctaaatcggggcttgatttttcatctatgatcctagatgttctcctgaaagaatgactagcctttttataacgatacaaagttttttaaaaatacataaatgtcataaagtttattcctgtgtatacacactctgggttcaggaggttttgtgcttacatttcactactcaaatgccttcgcaaatctcagaacattcctcaccatcactgcaggcctgtgaacagataactttcatcaattaggatggctggctagtggcagggacttcatataaagaaatctttcccagaattgtttttccacattgccttctaatttgatcactccctataacagatgttcaaaattcggccacagctctcttatgaaggcagagtcagataaaatgatattctgcaattatctagatcataagcataaaataaatattacaaaaatgattgtatttaaagaaattttttaaaatccagaaagtcatttaaaatagaacctcatatagtatgaacaaactataaaaatattttacatttca

SEQ ID NO: 3 - DNA, 145347 bp, Homo sapiens
  mutation 141189: c/t SNP in forward strand
attgctatttgggcaacaatatggctccttcagaactggtcgagaatttctgtggtctttgcttgaccttcaagttgggagtttcaaatcagaggctttgaagtctggaggagttcgcagccattaatccttccggggttgtgctaaaggcgtttctagaaagagatcggaaagacccgttcagcacaggcccattgcatcttctctttgaaaacgcttgtctgaatcaagtatcttatacagacccgagactgaggggagcaagagcgcaggtccggctgtggcgaggtgtccaccaccgtacttgtggtcaatgcctggactagagagccgaggccgtccagggcgggctggccagggaaccagaagcgtccctggactggctgagtgagggtgccctttccagcaacccagtggccatggttaaaaggcagaatacaaccgtcaaagaagtccccagctcccacataagagagcgcaaaggccaatggaaccaaggcctcctcgcgagaactagctcgctttgaggacaagatcctggggatggaggtggggactgacgtagtgagagggtctggaggaacagtcgtagctgaaggtcaggacatgaagaattgcacgtatggtagggatagaatggcaggtacaacttttctgtactgaaggaactgggagaggacgatccggttagggaggttggggaactaatctcaacgctgcgtttacagatgaagccgcttttatatggcgtatatgtttgcttagaggggccgacggagattaggagaagccatcctttggcgccaatgatcaaagcgtctgccaaggagaagaagccaagggatgggcctttcagagagggcaaggagtcatgctgctctggatgccagtgtcaggacaagaaatcgaaaggagcgaggactcttcactgcgtgcctcagtctccccgcttctgcctctttcacctctgtcctacttccggcgcgaaagcaggccactcgctctgatctagacctagttaacattagcttttcccttccttccctcaaatcccctcccccctctatccccgtcccttctgccgcctgaaagggttaatctctcctgcgggtaaaaacaggtccgcggagtctctaactggcgacagatgggccactttcttctggccacaaaggggccggaatggagcgctccgcggcatacaaatgggcaggtcacgtggttccaggctcttggctggaccgggaagaccatatggcgcatgccggggaggaaggaggaggggcgggggtaggggtggagggtgaggggagcggttgtcggaggagggcgggagacgagcaaggcgtggggagaagtggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaaggtaattacagttctttcatttttttgccccagaatagaagcaataactgaagactgatgaacctacatattctgtatgtgtgcgtttgcgagagtgtgtatgtgtattgagaccagcatccccctccataattgcccataagtactcacacataatgagtcgtgtcactcaagtaccccctgcaggctttctaatttaaattttaaaaatttgggtttcttttgtggatagcataggagcttcttggattttttaaaagaatgcacggtaactatgattatctgctagtgctgattttaaagtcccaaaagcaataatgacttcactttctcacttcttacagtaagaaaaaaaaatctatgttatcaatatatattttgtgtgcatgtattttacgcacattgggagtgtcaagctgtgttttcagtgaatgaaagggacatggataccttgagtattcacaccatggaaaataaatcaggttcagagatagtttagttgagaggggggaaagtggagaaagggagagggactcactcctgctacctgttaccgctccagaggcggccaagtccccagcagccactactggagccagaaattcagttgttttactaaaggctttttattttccttactagaagcggcaacttcgcggttgccaatcgctgaccattataattactcaatcttttaaagggaggtttgaggcgaactttgaaaagccccaataaagagcgggcggccctttcaatgggctgtttattagagaggagccttccgcacctgatccccggcgcgtgggagagcgctctgcgccgcgcccccagccctcgccctgcagctagcgcttttgtacaaggtggaaatttagcggtgggccagagatggaaggcaagaaaagaaaggcgagggaggggtggaagaccctgtccacttttgttgccaaatgttacattgatggtgaaacaatttggtggaaactatttttcctcctttctgcatttgcttttcagtatcccgtcgatgtaatcttcttaaaaatcgctgccagtattagtaaattacgcaatggctgttcaacttaaatcgctaagtatctggaagccaggacagaaatggaagtagaatgtgtgattttacagcttttttttttttttatggagttgtgagtaactttgaacacatttggataaacatgaagtcgctgaaatgtacagtcatttccacacacattatcctgtcgggcaaccaccataaacacatttaagttaatcactaggatacaaacacatatgcgtgagtggtgtacacatatacatattcactaccctcccccagtcctgtcctcactcctacgtactagcggggcacacgcacgcgccattataaaacactgcatttaactttttctcagaggcattcattttgtaatgggcaggtacttttcgcaagcatttgtacaggtttagggagtggaagctgaaggcgtatctggcttttgaatatagcgtttttctgcttttctttctgtttgcctctcccttgttgaatgtaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaaaccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtgagagcaattgttgcatttcttcttaaagggattctgtttttatttttggggaaagtagttgcttttttgctgagttaaaaaatactaaacactatatgtagaataaaagaaaagaaaaaagtttaccttggcatatgctcttgtctgtttatcttgcacagggagtcaccagttctatgtagataatgaaaagacctaactgatatttcattatttggaatatgggactggacggcagtacaaacagtgtgtttttttctttgttttaagtggcttagcctttaggttttttatttccatttttaaaaatgattgttacatgttttcttctatttctttttttaaaaggtggattttaataattattaacaagcaagacataaacaagtatcctagcttagtttgtctatacatttaagatgtataaaacattactattttcttggtcttctgttatctgtacatttttctgaactaaacagttttatcttgcaaactagtactgtcccagaaaaatttatacacctttaggaagtaccaaagggaaatgagttaattaatttaaagaatccaagagaagtaacattttataattgttctattaacatcttgtgatgatttccatcatttttccaagaaaaagcataatggattatttgtactgaagaacacactatttgtactgtatttaggaaggtgtaattatttcctccccccaccctttggggcactattctgttgtttcatgaacacaactcactggaaaaacttatggatgattctgtctattgttaagtccacttcaaaaaaaaaaaaacagtttggcatttcttttcctctggatgtattgactgacagtcatgattcctagggaatatcattttggcacttgtgccctggctctactgtggtgctctgattactgtcattagtaactccattgtttctactctgattcgggtgccacattggatgactaccccccttcccaagcttgttcctttaatctccttctcattggtgatttaggggttccagaaagctgacctcatttagcaagctgctccagaaaaatgtgagtaatgtaatggacaggaacaattagccatactaataacattgccaatgaggctgcgtcaagctgtgacagaagcagtaaggaatacttcgacgttaaaaaaatgtttgagagcaatttaaaatatattattttaacatgttttctatcagccttcatcacatgacagaaatacttttaagttagtcccaactttatctaaaatgcagcaatctcattccaagtgaatcagagttgttattttggaatcaagctgttgctttctatatcctggattgttctcactgttcttactttaagagacataatactgatatgatacttgaatactaccagccttccagtgtaggaggtaatgaagtgagcattcagatctgatctaacctattaagtagctcaatttcacctgcaattaaaattagacatcttcatgcaaactaaaatctgttgctgtagtgaagagaagaaataaaagaatgccattttgagaattccagcttccaaaatagcaaacagggaaatctagactgtgttcttttgtaaggtagaaatgaagactaaaagttaggttttttttttttttcttcccattttgccaatacaacttcattctaaaacatagggattctttcagtcagtcaaggagtaactcacatgccaccatcttttattcaaaggcaggcacagatgttccttctgcaggggaggatttaatttatgaaaatgatattgtttatgcatgaatgaactgcatgcactctgcataacacatagcacttccatctgatcagagaaataccacagaaccagtgccaatgtcagaaacatattctacaaatttactcacttaaatgtttaatgaatatttggaaggcattttcaaaccataagaaacattttaaattatcttcttttatgaattcctacccatatttaaaagagactcttacagtttttgtaattggctaatgcttatacccagtttgtaagaaaagaacatattttactaaatgaaaaccaaccaaaaaaaaatgctggcaagtttggcttcactggaaaaaatatttcgtttagttttgctgtttaatgcttgtcatgaataatatttgggattctatctgtttcttcatcttgagccacgactattcctatcaaataagatgcttaggtatacttgtttaatgtgaaaatcctatgaatagttatttctagaaaaagctggtatgtaaaatcagggggaaatttcataaagatgaaattgggctaaatattgtaacatgcataattactattgaataggaacacttcacataacatattttactttatataaccaattgcagctatatagtatgatctatctacttttaatcattaaaacaattatatataaattaaaatgaaagattataatatcaagagtgttctactaattttaggtttataatatgttacagtaaaataccatttgaaataaattttgtgttctaatttatcttaaaatctctctgtttttacatttgaaagtccttacattcttacaaaattaatgcattttctgaaagaagctagcaattactaaaatgatatatggatcattagctaacagtttgaatcaagctgttttagttctataattatacaagaaatttaaagtgaaaatacctattaagcaattaataaaactaggtttcaaaatattggctaattttctcctaatgggaaatgtaaaatagcaaaactgcttcttaaactacacaaaaacctcctcacttctccttttctctctctctaacaccacttatttcctgaaaatcatctaaataaaatatttaattccagggtctgatgaagaataaaagagccaatgcaacatcttgtggaacaccaggactgagaactcttgttgttaccattgcaaagaggcgttctggcgtcagatgcacagtgatttgtatggtggcataatcattggctcctggccaggcattatgtttcagaggacactattgtcaagaaccattcaactagaaatctgcactgtatgcactcaaaagttgagatcatctgccttcctatgacaggaagaattctgtgctggcaattgactcatggactctcttcacatacactaaggcttggtccagtggctctgatggaattaactgtgcagccaaactagtggcattgacaagacagggccacagtctctggggacttcaggagaaattgctaattttaaaatgcagagtattatgttaatgctggattaaatcttcagatacattaaatgtggatttggccatctaagcattattatgttatttgcccagttaatttagaggtagatggatggtgacaataaccatctctacagatccacaattctaagagatggatccaattgtgaaatgatatggagagatagagtaagttcaatctagcatatatgaagtaatttggtaactgacttttcttttaacaagatcaaaagctaacctgctttacactttcatgtctaaggacagccaaccagagagatggcttcacacactagcccactgctaagtgcttttcattcactttcatatttcatcatcaaagcaccctcctgccttatttatagatggggaaacttcaggaagttgagatacctagatatttgcattcctgtcttcctttcttcattcaggtttttctttcattgccacttcctcaaagaagcttttactgattcccatttaaaatagcaactgacttcaactccaccaaaatcactgtattgcccctccctctttccagagcatttgcctatcaaatgttatcttatgtatttacttgtatagcttaattttaaactatctatctctaggtcttctgagcacctgagaaacagagacaaagttgtctcttctgtgtgttgctgttcctctggtgcttagaagacctagaggatcctcaataaatattaactttccaagggaactgaagagcactaatgtgatgctaaagcctgttgccttaaccactatgctataagtcaaatcagttgagaatggagaggaccacaaattattttcagtccagcaagtgttataaacattaattctataaaaagaaaacaattgaaactaatttcttattatattgcatggcaccaaactccccccacttcctttttgaggatcatgagttgtctgtcattgtttctttttattgatatcaattggttaaatataatctggaattggaataaaagaaaaactattataggctttttccagaccatgtatttcaatgcatattattttttcctttctgttcattattctttcagtaattgcacttgttctatttttagtgttatgtaaaattactgtagctcataatttctattttgaagggttcagtgtataaacttagcacatcaatactatctttttagtgttcgcgctcaatggtgtcagttaagagatcaccatcacttttggtgacgtcaatgaaggggtattgcaatgcttaagagaactgttaatccctttccactggtgtcactaacaattgtagtgcttgtttattcatagcaggtacgtgactaagtaatgttaacatcaaagcagaaagaggataatagagtgttctaaaaagaaaattcggtggttgggtgcagtggctcacacctgtaatcccagcacttttgagaggccaatgggggtggatagtttgagcctaggagttcaagaccagtctgggcaatatggtgaaacctcgtgtctacaaaaaatacaaaaactagtggtgcatgatggcatgcatctatagtcccagctactcgggaggctcaggtgggaggatcacctgagcctggggaggtcaaggctgcagtgagacgtgattgtaccactgtactccagcctgggtgacaaagtgagaccctgtctcaaaaaaaaaatgatttgagataacatcacttgtcattgtttgttaactgaataatctttattctagccagtgcctaaatacataataaatgatagtacaaatggatataaattataactaaacctaagtagtgatatttatcacaatatttctttactagaagaatttctttgttaatagaggcaaggctacttgtttagataccttaaaataacataagatttttggataaataaattaatgattctttgattctgactggcatattaaaaatattaagcgaagagatctttgcttcccaggttttattttttgtctaattaactactggtgcatttatattaaaacatattgtcaagggaaaacgtatatatatatatgtgtatatatggtgtgtgtgtgtgtgtgtgtgtgtgtgtgtgcacacatatgctatacttggttgagtagtatccccttcccttgcccacctctctcccaaatttatgtccatccagaacctcaaaatgtggcctcatttgaaatattgtctttccagatttaattaagatataagatgtaaattgatacaagttcatgctggattacggtgggccctaaatccaatcactgatgtcctgataagaagcagacagaacacacagacacacagcatacaggaagaatggcatgtgaaggcaaagacagagactggagtgatgtgtctacaaatcaaggggccccaaggatttggggcccacatcagaagctgggaaagagacaggaattctcagcttctccttctgaatccctaagaaggaatcaaccctgctgacaccttgattttaaacttcttgtctccagaactgtaatataatacatttctgttgtcttaagctacccagttgctggtgatttgttatggcagccctaggaaactgataggtatactaaaatctctaatgaattgatgttaaatatatataagtataggagagttcatttaaattcttctgaaaatgtcttcttaaacttttaatgatacagtatataacaaccagtatacgtagttggtatcgggtttgacatttaaacaagctgacaaaaaacagctgtttaataaacatctgaattatataaaagttttattgtttattattcatgtgaatgacttaaactgacatctacatttagtgaagtgtgaatgggcctagccaataaactatgggtaatttttttaaagtctcatctttgaactcacaaaaaattatcaaatatcagctattatgtattcttcatgtgaagaaaatgtcatatttatttgatttgtggattagcatatatattaatagagcttttgaaagaacaaatgtagcactttcccgatttcatagacactcatttaacacacaagttcatattttaaagtacataattttaaaaaaattctagtccaaatgaatttaagtgccatgacttctaaaaattctgtctctatttttgggttttataggaccttgagccagtactcttctggtgagcttaagaggctaagacttcacctttagttatatggggctttcatctgattatttgtctattttgattgctctaaatacaagttagtgtgtatttcatctgaatgtatttcattataagttttggttttatgtagatctggggatctgtcttgtttttaatcttgattggtctgtttgttttgggatagttggtactttcatttcttatgcttgctttctttttcattttgtgcccacctttagtcaggtgaacatcagtaaggaataaaattttatttttttaagccactgaaaaaatttaaaaaccacatcataactctgcctctgctgactgataaaaatgctaacttattaagacaaaatgttatgcaagaagactttattggaatagagaaacatcctttttatgtaagaaatatcaacagagacatgtgcctttcttgtgacaaatgtggtatgtgtgtggattagaggtctggaatgtggcagcatttcagtacttggaggggagaattagagtagggtagaaagatagacggggagcagaggatgattctcacccagtagaaagcagagtgaagaaagaaaggggaattgttttttgcattatattatttgaactgtggattaagtctttccataagccatccctacgcctctaagtaggttttattaacttaagctggtttgagatgggtttttggtcacacacaagaattgcctgatacaagagaggctttgattttgttgttgcttgctcatttttatacactaagatggagaaaaccctggacatagtgaagacgaaattgaggaaggtgttgggtagagtggagggtagaagacctgtaacataggtacagaattacattaaactggaaggacttatatccagatataggagtcagggtagaaagagagaatgttagcagtaagggtaacagagtagcagaagtttattcttaccaggtcctgttatgtgacagtggaggcatgttgaccttctgactaggggagttaaaggagaacactgaaggtttagaataatgtctctaaggatagaaagagaaagtttcatcaagactcatcaataatagggcagcagggcttagggccaagcaaattcagagaccatgatattatagtagtttgtagtggtcttaatccatctaatttttcagcattttctcaatggccaatacttagcagtggtagtgttttatggcatttggacaacagaagtgaaagcactggtaagagagacgttgaagtgaaacaccatggggctcagaaaagcagagttgatccatctggtacatgggcaaggatggtcctgaacaattctgcagtaagttggaagatagaaaaaatacctaacgaacttgtagatctgggtaaggagatttttggcagaatattgtaaggctaattggcttctcttaactatatgagatagggttttacaagggagagataagcgagcataatttagaagaactatagggggtcccaggcagactctctggctggaaaattattctgatagcaagaaattagccccaaagcaaagatgaaaagtagggtacttccaattaaacatgtcataagggcaagcctcaatcaagagtgtggctagaaggcacagctcacctggacaaaagtgcttctaagcatattaggagcatataccacaataacctgacttggacccaaagttgagagaggccagtctcaaaaaaatttgagggaattgcttttgcataatatgatactttatatacatatctgttacatatcatatatatcatattaaaaagaaaaaaaaccctgtttttccttccgttctttcatataacccttctgacaacaaatgtggagtttttcacacactaagcaattctttagttcttgctggacacttcctggatgtcctacaattcaactcgattctcacacaactgcccagagtcagtgcagacccgcagattaaaggcttagccccaaaagactaccccccactttagatgtcaatcacaagtctcaacttcatttacttctgaaggacgagctatacattggaggaaacccctctttctttcaataatttgctagaatggctcacaaaactctgggaaacatttacttatggttaccaatttattataaaggatataactcagaaacagccaaatggaatagattcatagggtgaaaaatgggggagaggcatggagcacaactctctcagcacctccatgtgttcaccaacccagaagctctcagaactccttcatttagggcttttatggagctttatcaagtaggaatgattcatgaaatactggcattggtgattaacttaacctccagcccctttcccctccctcaacattgggggtgaagctaaaagttccaactctgtaatcacagggtgagcttccctggcaactagtcccctgatccttagggggcttctgaaagtcacctcattatcataaactcaggtgtggttgaaagggatgttttgaataacaaaagatgcgcctttttcctttatctttctgagttgtttcaggagctagggacaaaagactaatactataacaacaacaacaaaaaattcaatttttgcttttatctcttgggaattacaaggattttaggagctctgtccagaagccagtgatgaagatcaaaatacatatttcttattatatcacaattcacacatgtacatgatatccgtaagataagtgaactacataaagtaagctcacaaagtttctgtaggagttttgtccatttacaaacagtttgtaagctaaaagtatctgtgacaagcctcagtcaatttagaagttcatttttccaatgttaaggacatgcctgtgacacagcctcagaaggtcctgatgacatgtgcccaaggtgatcaggctacagcttggctttatacatttagggagacataagacatcaatcgatacatgtaagatgaatattagctcagtccagagaagcaggactactgaaagtggaggcttgcaggtcacaggcagattcaaaggttttctgattgggaattggttgagttattatcttaagacctggaattaataaaagggaatttatcatgcagatgaagctttaggtagcaggcttcagagacattagattgtaaaggtttcttatcagacttaaaagagtctgttctaacagtctttaggtctcagtgttgatgttaatgctggtcagctgtgcctgaattccaaaagggaggagagtataatgaggcatgtctgagtcccttttcccatcatggcatgaactagtttttcaggttaactttggaatgtccttggctgagaggaggggtccattgagatggttgggtggcttggaattttatgtttggtttacaagtttaacattaaaagcctctgtacctccaatgttttatggacaaaaagaaggctgaaaaagctacttggctgtaatcatgggccatttcttgctgaaaagaagaataaaatggaggcagaaccaaaagcccagaggctagagccaagagctgctgagaatgatgaattagggaaccactctcagagagcagatctggatgtgagataggaacattttctttctcagggtctatgaaactggcaacatatgctctcctgaatttcagaattgctatggaccagtgactgtgatatgctttctatatttttcccttttgaatgggtgcatctatcttgattatcctctgtctcattattgtatgttggatttgtgtgggacgataacatgtgtttttagttcctaggttcccagaataagaggagcacactcaaagagcgacatttatgagatactggatttttcacttgatatcataattgggtgagacttgaaagaaagtgaacatattttgcaaatgggagggatgttaaccactgacaaccacacccacagggtccactgtattagcctatctgcaaagacggctgccaaaaattccttctgtccatatatacattcccttttttaatgtgactgtttcacctgccagcaactgaagggctttatttccatttccccttgtgacttgtttgactaacagcaagaagcaaaagtaatgctattccaattctagacctgggccttaagaggcatgacagcttctgcttttactctcttgaaactcaatgtcattttttaaaagctcaggctagactactcatcatgagggaccacatgaaaagagataggcccagctagtttccacccattccagccgctccagatgagatgccagacatgcaaatgaagccatcttggatatttcagccccagctgagcttccagctaaatgtaagtacattcagttgatacctcatagagcggaactactgagctgacttcatccaactcacagaatcataatgaataacaaatcattgttgctttaagtcaatacatttaaagtttttttgttatccagttgtagatgaattatacagcctggggggaaaaaggagatagcacactgttagttgcctcatcaatattcatccccaaattctttttcctttttagtaggtctcacctcccacctggaagctgaaaacacctttcccagtctctctggaagctacagcacaggcatgttgcccaattctaaacaataggacatgataggaggtctgctgggtgggatttttgaaaatatttttttttctggttaagaaaaaagaaatgcccaaggaaaacctacaaatgccccttccattcttgcttttggacattttttgggagagggtatgatgcttagcactcctgcagccatctcggggccaacaatagaatccttgttgctacctggtgatagtgaagtagaaagctacaaagctcttgatttcttttcttttttttttttttttaaattttattattatactttaagttttagggtacatgtgcacattgtgcaggttagttacatatgtatacatgtgctatgctggtgcgctgcacccactaactcgtcgtctagcattaggtatatctcctaatgctatccctcccccctccccccaccccacaacagtccccagagtgtgatgttccccttcctgtgtccatgtgatctcattgttcaattcccacctatgagtgagaatatgcagtgtttggttttttgttcttgtgatagtttactgagaatgatgatttccaatttcatccatgtccctacaagggacatgaactcatcattttttatggctgcatagtattccatgctgtatatgtgccacattttcttaatccagtctatcattgttggacatttgggttggttccaagtctttgctattgtgaatagtgccgcaataaacatacgtgtgcatgcgtctttatagcagcatgatttatagtcctttgggtatatacccagtgatgggatggctgggtcaaatggtatttctacttctagatccctgaggaatcgccacactgacttccacaatggttgaactagttcacagtccaacagtgtaaaagtgttcctatttctccacatcctctccagcacctgttgtttcctcactttttaatgattgccattctaactggtgtgagatggtatctcattgtggttttgatttgcatttctctgatggtcagtggtgatgagcattttttcatgtgttttttgactgcataaatgtcttcttttgagaagtgtctgttcatgtcctttgcccactttttgatggggttgttttttttttcttgtaaatttgtttgagttcattgtagattctggatattagccctttgtcagatgagtaggttgcaaaaattttctcccatgctcgtgggtaggaagaatcaatatcgtgaaaatggccatactgcccaaggtaatttacagattcaatgccatccccatcaagctaccaatgactttcttcacagaattggaaaaaactactttaaaattcatatggaaccaaaaaagagcccgcatcgccaagtcaatcctaagccaaaagaacaaagcttggaggcatcacactacctgacttcaaactatactacaaggcttcagtaaccaaaacagcatggtactggtaccaaaacagagatatagatcaatggaacacagcagagccctcagaaataacgccgcatatctacaactatctgatctttgacaaacctgagaaaaacaagcaatggggaaaggattccctatttaataaatggtgctgggaaaactggttagccatatgtagaaagctgaaactggatcccttccttacaccttatacaaaaatcaattcaagatggattaaagacttaaacgttagacctaaaaccataaaaaccctagaagaaaacctaggcaataccattcaggacataggcatgggcaaggacttcatgtctaaaacacgaaaagcaatggcaacaaaagacaaaattgacaaatgggatctaattaaactaaagagcttctgtacggcaaaagaaactaccatcagagtgaacaggcaacctacaaaagctcttgatttctaatgacatcatatgggatgaaccaacccaggaacagcctgactctggacctcttttaatgtcagaaataaaatcttatttgtaaaccactcttagttgttcaggttgttgacacaggcactgaagtgcctccaaatggtgatgaataatgaggcaaaagtcaaagacagcaagtctagtgtcaaattttttgatgcctatgggtaagaagttcaagaaagtgagctattttctttctttttaaaatttatttttatttttgtgggtatatagatgtatacattagtcagctattttcaatagtgagaagggatgttgccacttagtataatgcctttttcatagctatcatagaaaccatatatacatatagtatagaaaatgaggatagatttctgacttaaactgcctatttcatttgtgtgcctggttacacctaattcaagactctacaatacagcattgctagcaattactgtgagaatatttcaagctccctatttgctggaaatacatttcatttttttgttccaagtttatgaatattagaacctatctaaaaaggagcttttaaaaacttgaggaaaggaaaagggagggcctacttttcttgcctgtgttatttcttgttactgctgattgagatgctagagatcatattgggtgagatgtgtcttagaatacagctgagcaattcacttttaacagtttccatctgagtacaaaaaactggtatgtgcagaaaacttgatattctgacttggcgggattctaggatttgttctatttttttctgtaattgttgtagggacatatggccctgtaccttttgggcagcaggagccagaatagcaggaacattctgacaaaattcccactcagcatgagagggaagcagtccccttgatacactgatgatgtgcccacttagcattacaagtgtttgagaggtggacacaactaaaactcacctcactcaaaatatatattgacacggagaaagtaaatacaatttgctgttattaacctttcttctcaccattgagacatgttaaatatctgaaattaataaaggaattaaatttaaaaagtttacttatcatgcatttaacacatttattgagcatctgttatataaatgcactgtttcaggcacaagagatagagccataaataagcagattaaatcactattctcaactgaggtactaatctgatataagagaggagacagaaataagtaaacattataaatcaactacatacttttacatggtgtaaagtgcaattaagaaaatattattgaatagaggtcaattttggaatggttgggcagggaagaccttctgaggtgacaagaagttggcctgggcaccatggggagctctaccatggtgaaaagtgttccagacagagtagacagcaacagcagaggccctaaatgagaatgcacttggcttatctggagagtagaatgaaggccagtgtggtaggacacatactaataataggagaaaactgatagaaaagagggtttgagcaggtgggcaggaattggacaacatggtgtctcatatgtcataatagaagtttggattttattctacctgcagtgagaagttcttaataaaaaaaaaattctataaactggagtttgagaaagaactatgttgatgatagcataagccctcaatcacttgtcacataaactccaaacttcagcagagactcagggagatcaaagggactaccacaggattacccactggctaaaattcagatccatggcagttggtcctgactggaattagacttccttgtctgttgccctcattgcagtgggtctgaatgtctctgtcggctgtgaatttttctccctctatctgtggcactgagaaggtggcccagacttccagagtctgtctcattggcctattacttggggatttgctgcccttcttctggaagtttgggtatttgttttcagagcatacttaaaggcctcctgaaagcaatgttaacaatagcaggatatattttacagtcttctactcagacttggatttttaagaaccagggatggagactgtgtttccagatctagtcaaatcccttccaaacataaagcaacaaagtgccttttaaactaggacctgtactgtttaatgctctggaaacaaatacccaagcttcagccaaaggagggaaagctatgttcaggaagcttcctgaaagttttttgaaagcaattttcatgcattagtattttacatatatatatatatatatatacacacacacacacacacacatatatataaacatatatatatatacacatgaatcactaatgagacaattgatcttcaggaactaacgtgaaataattggggtatcttggtattattgttatagataaatgttgaagaagttcattctttcagatattaattgagcacttactgtgtactaagaactgtgatagatactggggatttaatggtgaacaagataaattctctgccatcagggggcttatattctaacaaacttaaaatttactgagtgttctctgtatttcagtattgttactaagtacactaacttagtggggaagctagacaataaacaaagaagtatgtaataagaattaatagtaagtgctgtaaagaatactaaagcaggttatggtagagagattaatggcagcgtgaagatgtccatgtttcaatccccagaacctgtgaatatgttaccttacatagcaaaagaggctttgaaaacataattaagggttatctgggcaggcccaatgtaatcataagagtccttatctaagacgggggacaaaggtcaaagacagaggaaaagagacgatttaaggatagaagcaaagaggagagatgttagactgctggctttgaagttggaaaaagtgaacatgagccaaaacaaacaaaacagaacaaaacaaaatccacaggtgacctttagaaaaggggtccccagtctctgggccatggaccagtacctgtctgtggcctgtttggaaccaggctgcccagcaggcggtgagtggtgactggtggacaagcaagttttaccacctgagccctgtctcctgtcaggtcagtggcagcatcagattctcatagcagcctgaatcctactgtgaactgcacatgcaagggatctagtttgtgctccttatgagaatctaatgcctccaaaatgctcaccccttcaaactgcccccatccgtggaaaaactgtcttccacaaaaccagtccctggtgccaaaaaggttggggactgctgctctagaagccagaaaagaggagatatattttcctctagagcctacagaaggaatatataggcctgctggcaccttgattttagtcctgtgaaactgattttggatttctgacctccagaaatgtaaaacaatgcattggttttgtttcaagtcactaaatttgtggtaattagatacagcagcagtaagaaatgaatacacaggtttacaggatggtgaattatggagggtgctcaggaatggcctctttgaggtggtggcctttaaacagaaaaatgagcaaagtgaaagaatgaaccatctggtggggagaaaagcattccagtcagagggaacagcaaaagcgaatgctctgagaagggattattcttctcaatgtgtttgaggactggcaagaaggctttgtgtgaatgagcaaggggaaaaagttagtaggtgatctcggagacatagccagggtccagattataaaggacctctcgccttgctaagcattttgactttattccaagaataatgggaagtcaatggaaggctgtgagcagggttatatgctctcgttattttttaaaggcacaatgtaactccaaaatggaaaattggctctgggctggaggtgccagcacaggggaaaccgaaagcagagagctgggttgggagagcggagactgaagttgtccagctgaggggtgcagaagtgcagactgcaatgacagcaggcagaaaggactatatgttctagacagaatggacaggatttgctggtagattggattgaaggcatgagacaaaggagacatggatgatatcaaggattttgatactacagatttgaaacattctgagagggacaggtttgtgatggaaaatcatgagtctggttttagatatgttttagaagcttattggacagccaagtagagatgtcaggtagggagctggacataatacctaaagttcaggagagtggttggagctggtgacatcatttgcagaaccctggatggtacataaagcacgggacagtgtgtggatagatcctaaagagagccctagggcactccagccctggaagaaggcagcttatcaaaggaaaaagaaagaaagaaggaaacacaatccttattacttccatcttcaggacaattcaaagccagtgtttttgacttcctggcttgagtgaagcttgaaaaatggcaacttgcccctttgcaaagctcctaaggagtagccattggcttggcctgtttgcactggctctgggtgagcttttaaaatgccagtgagctctaattgtgttgattgcctaacagctgtgaatacaagatgctgactccagaactgcaactcattctgcgaagggcaccgtccttttccctctaatgactgctgaacagagccacctgaagcctgcatggggtttagcagcagctgcacttctgctctaagaaatagctcactgcagtcagatcaaactgaagctcttccttgcttttcctcgaagcttgggtacttattgtcggagcattaaacagtaagagtcctagcttaactggtgcacagtgctttatgtttggtagggatttggttaggcctacaaaccgtctgagctaagaaccttgagaaactcctgctatagttagctctttctgtgactctgcagtgtgaccaggaatgaggacagaattaagaatttgctgcctctatgatagaactgtttaggcactagaacactggaactagatctacaaccctatgaatttaatttccttttcaactcccctactccttcttttcaatatgatgataatgatcttgtttaaaaaaaaaaaaagccttctgctttacttcccactctgctcctcttcccagggactcactttcttcttgactgcttccccattacaagtactcagctccctgttttatcaccctgcttagagcagccattatcagccttggctgaacattggaattacctgggaacttttaaaaatccggaagtctgggtctcgcctccagagattccagcttagttgtcttgagcgtggcctggacatttgggttttcaaaagttccctatgtaactttaatgtgcaaccacaattgagaatcactagcctccagactctctgtgttatcaaaattaatgagcagctgattttagaaatctcagttatcaggagaaaagggtgaacccccccagggctcttctccttttccaggtgacacttctttatggcagtgcgtgaaagtgaagccctgctgcttgtaatctccctcaagggagtgcaagatccaggcaaagacaagactgcagaggcgctaccttgggggaaagtaggaccctaaatacttacacctggaggcacttacctttaatactgaatttgtcagatgcaaatttgtctatgcaaaccagggccttatctctagcttcccctcaggggttttgggaagtgcgctactactctgaaacagggttgtaaagcgtcacctgtgctctccagggaaccctctggaaaggaggtggaaaaacagaggcttccacccttgcaactctaagtgtgttccttggccagtgggatccatcacctagtattttcttagatatgtggtatctgggggccagtcccacacctatgcaataagaatctccatttgaacaagatgcccaagcgattatatgcaagtttaagattgaggagggctggtttaactcgagggtaacgaaaagtacgaaatcgtactttacaggagaagctaggcggagggagccacttattcttcctcttgcagctgggtctttttgtggtgagtggcgaagcggcgaggctggcaggccagggtgctggactgggtcaggcgcggccccgcctccctcctgggtccctgccctgcgcgccgttgctgtggcagcgctggacgcggctagagctggggctgccgcgccctccacctccttctccaaaggcctccccggacccctggctcgggcccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgagtgcccggccccaagcgtcttcgcctccctccgcgcttcctccctctccccggcccaaggcctacacccacgagcttttgctccaccctccccttttctcgcctcccctccccgtgctcgcctcactgcccggacaggttaccgagtccccaagtcgccgcctcctccttcccaactgggaactcacgcctctcgccccatcccagaacccccagggattctttcgctacctagccttttcccgcctccgagaccttccccgggcaaacgtcacaagcagcttttgctcagagtctcagcagaaaatcttgagccccaaaggggaggtaatttacaaatgtgagaaggtcaactactcctcccctccaagttgaaaaagttttaatccattaactttgatggtacattgaaactataaacatctcacagattatgcctacacaagagttctgaatccaactctcattttgctgacttgaaaatgtaactccagagctttgggagtgtttctgggtttttttctgcccctcaccttccttgccattgtctagaattaagacttcttcaggctcggtctagaaacttttgatttttaatattgaccctagattattggatcacagttttgcgatgcttagttacgtcaagcggtttgcttaacgtttgccttttattgacttaaaattttagttacctaaaaaagttataatgctgtagtttacaacaaatacttcgagtctattttcacgtcttagtcaaatagccttatagacttaacagatattttataaagaccattttgcaagtcttataagtagactttcatatagtcttatttctaagtccaaactcgagaaatactccccattgttgaattagcttagatgtgagcggtgaaagacagatgaaatgggggaggaactacatcaaggttactctacttgcgaggagatgacttgggggagatggaatttggtattcaacctcttttagctaaatacaaatttatgaaattaaaaaaattgccttcccctgttggaaaacaagacacagtgtggtatttatgttacagaatagactcactgtcttaaagtcttgctcaaaagtctaacaaaatgaaaccaactagccagggattcagcactggttgcgattgtgaattctgcctgtgctgcatgtgccatgctcgctcgcttcacgaaaacagtctttgaccttaaagtgttttcaggtgttttaaaaaccaaggtgtagtattttcttgaaccttttaagttaaaagctagggatatagctatggaattatttgtaagtctttcaggcaattcgagttatgcaatatagaagtttataattacagtttggattagcccaaagagccagtttaacctacagtgcagctgaaatgctatagaattaaaatgagacattgtgcaatgagaggtcatacaaaccaatgttgcagtatttgtgtacaaaaaaagcaaacaatgacatgagaaaagaaatgctgttttatattgagtggtgattaaggtaaaataggtttaattagtgcacccctggcagtagagtttaaaatacatcttgacagatttgtaactttaaaggttgcaagtactgattctttgtttaattatgccctaaaaccatttggtggtcttttccttcatacaggtgtaccctttttctttgtaattaatacctggtattcaaaccactttgggcctctaaaattgggggcacagaagcctagagccttagtaagtacttctgtttatggaagaaaccaagagatgttttatttaggtaaaatatagccaggcgtggtgtgtccctgtaatcccagctacttgggaggctgaggcaggtgaattgcttgaacctgggagttggaggttgctgtgagcggagatcacaccactgcactccagcctgggcaacaagagtgaatctccatctcaaaaagcacaacaaacaaacaaaaacaaacactgggaaataagaaggagatattaagagatgatatatttaaatgttagaaatgctctgttgttgaataagcttagatgtgagtggtaaaagattaaatggaagagggagctacatcaaagttactgtacttgggaggacatgatatggtaggatgtggtggggggagagcatgtccattgctggttggcaagtgactggctgcctcagaaaaggatgagggtgggtaggggagatcactggagattattagaacatacgtatgttttcaagattgcttagtttttaaacctcatagtactttgttttcactgatgaaataaaatactatgtgatctttttctaattttccatcttgagtaataagcaaagacattaatgtattttatgaaggctctgactgccaaaattgggacaaattgatggtcttgttggcagggtaaatgagcataaccgtagtaattgtagttctttttattgggttcagggatgacctggaataatggatgtgttattacccttccctgtagaagtgaggctttcgaaaagaggctataagtcaatttgggaggcacaaagtatcagcgctttttggggattttttttttttttaagtagagaaatattttaaatgtgtgatataaagttatgcatgtgcttcttaagcacattaactcaaccagatccaacagctggtctaataactttttaattgtttaaaaaaatttaattgacacattgtaattgtatatatttatgagatactatttgatgttttgatatttacgttgtacaattatccaatcaaagtagttagttatccttcacctcacactttcattatttccttgtgggttagaacattcaaaagactctcttctagttattttgtaatatatagtattttactgttaaccatagtcaccatactatgcaacaaaacaccagaatttattcttcctacctagttgtaactttgtgtcttttgactaacctctctccatccttccttctcccctccccttcccagtctctggtaactattctaatctctgccttatctatatcaaccttttataatagaaaaagattctacatgtgagtgacatgtggtatttgtctttctgtgtctgggttacttctcttaacacgatgtcctccaggcttagcattcacaattgacaggactttattttttaatggctgactagtattccattatgtttctgtatcacattttctttattcatccattgttgtacgcttaggttgattccatatcttggccattgtgaatagtgctgcagtaaatatgggattgcagatctcttcaacatactcattttatttcctttggatgcatacctggtagtgggattgctggatcatatgatacttctatttttaattgttttaggaacttccatgctgttttccatattgactgtactagtttacaatcataccaccggtgtgtaagtgttcccttttctccatatctgtgtcagtacttattttcttttgtctttttggcaatagccattctaactggagtgaggtgtatctaattgtggttttgatttgcatttccctgatgattagtgatgtcaagtatcttttaaatgcacctgttgatcatttatatgtcttcttttgagacctatcaattaaagtcgtttgcccatttaaaaaatcaagttggccaggcacagtggctcacgcctgtaatcccagcactttgggaggccgaggcgggcagatcacgaggtcagaagatcgagaccatcctagccaacatgatgaaaccccgtctgtactaaaaatacaaaaattagccgggtgtggtggcacatgcctgtagtcacagctacttgggaggctgaggcaggagaattgcttgaacccaggaggtggagattgcagtgagccgagatagtgccactgcactccagcctggtaacagagtgagacttcatctcaaaaaaaaaaaaaagtcattattattttatctgttgaattaattttcttatatattttggattttatccctttgtcgcatgtatagattgcaaatatttttctcccattctgcagctgttttcactttgttaatagttttcttcaaggtgcaaagttttttagtttgatgtaatcttattttgtctatgcttttgaggtcttattttaaaaatccttgctcaggtcagtgtcgagaataatttcccttttttcttgtaatttcatagttttcaagttttacattttaaatctttaatctatttttatttttgtatatggtgagagggaggggtttaatctcattcttctgcatgtgaatatctgattttcctagtaccatttgttgaagagactgtctttttcccagtgcatgttcttgacatcttaaaaattcagttggctgttgtaggtgcaaaaatttatttctgggctttccattttatttcatgggtctgtctggttttatgctagtaccatgctgtgttgatatagttttatcgtatatttcgaagtcaggtagtatgatacttccagttttgttctttttgctcagggttgctttggctatttggggttttttttgtggttctgcatgaattttcagattgtaacatttctgtaaagaatggtgttggtattctgatagcaattgcattaaatccatagatcactttgggtagtatggccattttaacaatataattatttcaatccatgaacatgtactatcttcccatttattgatgtgggaagataatttctttcatcaaagttttatacttttcagtgtagagattctttcacttccttggttgtttatttctaggtatctttttttttaaaaaagtactataaatggaattgttttcttgatttttcacatagtacaatattagtgtatagaaatgctactgatttttatatgttgattttgtgtcttgcaactttactgaattctaacagttcttttgtggagcattttgggttttctatctataagatcatatcttctgcaaacagggacagtttgacatgcttctttctaatttggatgctcgttacttctttctcttgcccagtttatctggctagaactttcagtagtatgttgaatagaaattgtgtaagtggccatcctttccttgttattgatcttagaattgatctcgttattggtcttttcccattcagtatgatgttagctgtggatttgtcatatgtggcctttgtgttgaagtacaaactttccatacctaatttgttgggtttttaatcatgaaattatgccacattttgtcaaaggcttttaatgcatctattaaaatgatcatacagtttttgtctttgttaatgtgtatcacatttactgctttgtgtatgttaaaccattcttgcatgcctctgatcccagtgatgaatcgcacttgaatgtagcaagttatctttctaatgtgctgttggatttggtttgctaatatcttgagaatttttgcacctatgttcatcagggatattgtactatagtttcctgtgttgtattgttatctgattttggaattagggtgatgcttgactcatgaaatgagtttggaagtattccctttgcttcagttttctgaaatattttgagaggaattgatattggtttgttaaatgtttggttgagttcagcagtgaagccattcgtttctgggcctttctttgatgaaagactttattactgattcaatttcctcacttattattggtctggtcagattttatgtcttcctaacttaatcttgataggttgtatgtgtcggggacttcgttttttctatgttatcaaatttgatgaaacttgttgaaaaccaactctaaattttgttcatcttttgaaattatttttagtctctatttcatttatttctcctctgagttgaattacttccttacttctaccaactttgggattagtttgttctgttcttttttttctttctttctttttttttgagatggagtttcgctcttgttgcccaggctggagtgcaatggtgtgatctcggctcaccgcaacctctgcctcctgggttcaagcaattctactgcctcagccttcctgagtagctgggattataggcatgtgccaccacacctagctaattttgtatttttagtagagacggggtttctccatgttggtcaggctggtctcgaactcccgacctcaggtgttctgcctgccgtggcctcccaaagtgctgggattacaggcatgagccacaatgcctggccgattagtttgttcttaattttgtagtgccttgaggttcatcattaggctgtttgtcagaaatctgttgtcttttttgatatgggcatttaatactataaacttacctcttaaaactgcttgtgctatgtttcgtaggttttgttatggtatattttcattctcacttgtctcaagaaaaattttaatttcctttttaatttcttcactgacccattggttgtttaggagcattttgtctccatgatttgtgaagttgtcagtttttctcattgttgatttctagtttatttcttttctttctccttccttctttccttccttccttccttccttccttccttccttccttccttccttccttcctccctccctccctccctccctccctccctcccttctgtattgctttgtctcccaggcccaagtgcagaggcacgatcttggcttactgcaatctctgcctcctgggctcaagcaatcctctcacctcagcctcccaagtagctgggactacaggtgtgtgtcactgtgcctacaggtgtgtgtcactgtgcctggttaaatttgttttttgtttttgtttgttttgttttgtatgtttagtagagatggctttcgccgttttgccatgttgcccaggctgttctcaaattgctgggctcaagcaacctgcccaccttggcttcccaaagtgctgggattacagccatgagccactgcacctggcctgatttctagtattataacgctgtggtcagtaaagatacttgatattatcttaatcttttaaaatttgttaagacttgttttgtggcctaacatgtgatctctcctcaagaatgttccatgtgcatttgagaagaatgtgtatctgcagctgttggacggaatgttctgtaagtgtctgctaggtgcatttggtctatggttcagcttaagtccaatatttcttgatctctctgtgtgtgtttgtgtatgtatgtctagataatttattcattattgaaagtgggctgttaaagtctcttactattattgtattggagtttatctctttaggttgaatatttgctgtatgtatctgggtacttaggtattaggtacatgtatgtttataattgttatatcctgttgttgaattgatccctttatcatattatgaccttctttgtctctttttacagtttttgacttaaagtctattttgtctgatatgagtattgctactcctgctcacttttggattctgattgcatggaatatctttttccatttcttcactttcagtctgtctttaacggtgaggtaagcctcttttaggcagcatgtagctgagttttttttccagtcctgcagctactttatatcttttcattagataatttatttacattcaaggtttttattgataagaacttatttctcccattttgttacttgttttctggttgtcttgtagattctcagttcttctttctctcttgtttacctctgtggtttggtcattttctgtggtcctaagctttgttttccttctatctcttgtttatgtatctgttgtaattgctttctttgtgggtaccatggggctaacataaaaagtcttgtagttataataaactattttaagctgatagcaagttaactttggtcacataaaaatactctagacttttttcctccgccatccctaatttatatttttgttgcctttatttctttagtatgtgttccctagccattgtagctgttgttgtttttgaccagttgtactttaaaccttcatctagaggatcgacaggtttacatagtaacatgatatcactggggaattctgagttggatttatacatttacctctattggtgaggtttatattctcacatgtgttcatgatagttatcattttttcatttacagctgtagcactcctgtaaacattgcttgtaaggctggtgtaggagtgaattccctcagcttttgtttgtctgggaaggcctttattctcctccaggatagttttgctggatatagtatcttttgtccttggccgagactcgtttttttttgttcttttagcatcttgaataaattatccctttctctcctggcatacatcagtaatttaatgttactgatgagaaatctactgatagtctaattaggattcccttacatgtaacttgatgcttttctcttgcagattttagaattctctgtcttcaacttttgacagtttgactataatgtgccacagagagaatctttttgggtttaatctaattgggaatctttgtggttccttcatctggatgtctatatctcccccaatatttgggaagtttttagctattatttcattaaataggttttctgtgcctttcttcaacttttctccatctgccagttctataatgcaaaaatttctttgcttagttttttttaaactttgggttatttcacaaaacctattttcagattttgaaattctttcttctgcttgatctggtctattcttgaagctctcgattgtgtcttttattcactgcattcttcagatttctgtgttttaaatgatagatcttgttttaatttctcattttataactttcctgatttcattgggttgtttgtattctcttgtagcctgctgaatttttttaagatcattatttttaattttgtttcaggcattttataaacacccttttctttggggtctgttactagagactcactgtgttcctttggcagtgtcgtgtgtccttgctttttcatgtttcttgtgacatctgcacatctagtggaatagtcacattttccagttgtatgcagtagctttcacagggagagacttttcctgtagatgggtcctagagtgttggttgggtatggtacattggctttggtttggggtggattcagtaccatggtctctgtgtagtttcgtcagctgtaatcttcacagcaatgtctgatttcctcagtggcctaggctgcaggagtttttgatggtggtatagttttgctagggacaggcatgtcatgctagttgtcaggctggacacttgcaggctcggagggctgacaagctgtcttttgggctccccagggaagagaaagtatgattttccagcttttcttctatgtttatttaaaactttgttgtctggctcacagtgttctttatctaaagtctagccagtggtggtggtcatattgcaatcattattacagcttcagactttctagaccttttccattttagtgaccttcagccttcattcgcttccattcatgaccacagaatagatgtagtcatctctattgaaggcaaacccatcccatctcttcagcttcatctagaaatttgtttcatctgttacactttctttctttggtttttagccttcattctctaccagctctttcacttaagcagagatatgttcaagactctcccattctaacagttccctgccttgatcctacaagcttttctctttagctgctaccttgctttttatttttatttttttctcacttgctctgataatctcctagaaaaattggcttactctgaccatctccattagttcacctcttaattattcttcaaccatctgagacctggctttgttctttctctactgaaactcttcaggcagagattagcagaagtcttctaattgctcaatgaagtggaaattttcagtccttattttctgtatttctccttcatttgactttgacttaactctcttggtttttgtaataccaccagcacctagtttatcagtctctcatgggaacttcattctatctgcctgccaaatggtggagtcccaaggactgtggtctgatctgctgttcctcattacatgctttctggtcagtattgcacactgtggttctcatctaccatcatctacctccagaagtgccatatatttagtaagtttacaagaaaagcaactttccttgctccgtagactaactctgatcttttgttccctatcatggttatggaactcactaattattcagcatcagctgtcagaatgtttaactttgctatttaggtttgtgtaagttatgggacaataactaggataactagaattagcttgtagcttatgtgggttagataatacaattgcatatgtaagtagtgaatattttggcttaataagtgaaggagtatttaggaagctatctggaatgttatctaagtcaggattctgaaggtaactctagcctcactgtcccttactcactatttctaaacacccaccaatcctgcctactttatttacttggtatttctccaatctgccatccttctctgtccgaccaatcactaccctagctcaggccttcaaagtctctcacttgacctactccttcacctcctttgaacctgtgcacaaatgttagcttcttagtaaggctttctctggtcacctgtataaaattcccatctgctacatacttcctggttccctgtattgccttatattcctcagtggcatttatctccttgtatactatataatttctgatctctgtcctttctattaccaccccacttcaagatggcaaggatttgtctgttatattagtgactgtcctaataggaaaaaaaatggcacatttatattagagtaacttgagaagaatttttaaaagtcagtatttataaagctgtagatatagagatagtgaagtactcttgggactagtaatcattgggcaggtgataccatttttaagcccaaaagggcatagtgaaagagcaggtgcctgaacctggattcagagagactatgtagaggaggccactaggcaggagctgtggcctttgcctcagcttggctgattacctcactaatcctcactaatcctaaattacccaagttccttcttttctggcccatttcacagtccaaagccaactttaagccagagggcaaggggagcacttgatgcagtccatgcagtatggcctcccagtgaacagggcaggtggaggatagaaactaaatctagatggaggagagggaagatattcagaatatgttttttctttactgtcagcaccttgaagagtgcctggcatatagataatatttattgaatgaatgaatttgttactggtttactggcctcatgaactttagttttgcctattctattataacttggtgactacattcctatatacttgataccaactcctcattaactacaaaggcagtattcccctctccccctttttaaacatcaaaactcttttttaaaaaaaattcttaaatgaatcgccagtatataacacataaaagtatgggtgccttgattggagtggtgggtaaatgatcctgagtctgtctgtttgggttccctctttgcctagcaggaatgtgactgtcttgtttaaagcccactgaagtagaaaacaggatgagagacacactcttcaacatggcataagatttccatgcttggctcctgcctatctctgcatcctcatttctcagtagtttcctcatattttaccatcctgtaattgaaagaattacaaaactagttctctacacaagctttcttgctgttccagctgctgggaattagcttcctttgtgcttttttttatttgaatgattcatgtttacattcattaaaattaatgaagattcattacagttgttttctctttaggcataattggatctcctatactgagacattgaatgcaactttgattgtttttttcccccattatatgttaagctccttgaggttcttttcaactttgcgttattccaggatttctatcgtaagagttaaggttcatccacttctctgatgtgaggttcatggcaggaaggttccatgttgctcagctgcagagtagaaaatactgagcagggcttaaatagattaggatgctgccattataatataaactgtgtttacgaaagagcatcatcaattcagaaaatatctttttcattgactacagtggtgcctgatgatctttctattacaatcttaaattatggtcattttaattatagaatcatacatgggtttatttatgttaaaataaggtaattatcaagctagctgtgacctatgagaaaaatcctgaagaaatgatgaagggatcaggtgactgtttttgaagtcaagtgtgaaaggtcagaccactctgggtcatgggaccctgccaaggcagagcaggtcaagtgctgtgcccagtggggccaacccccagtatggtgccagggactgggtgtgagaagtcaaaaattaagaatacacctcagaaaggggacatggacagatgccacagacttatttgcgtatttcatgatttagcccttagcttgtgctgatactggatcagatattttcagagttcagtattttcaaaagcatcgctgatcacctgttggcattgttttacatctcaaccaaggaaaaacttttgggacatctgtttaacaaggggtaagcttttatttgaaatgttcgattaaagcagaagagtcaggcatttttttgtgcctccccaaagaaagatttgtttactgtcctgtgtgaataaatataatgtcattatttcccgtaaaggaaaagctgatggggagagtaagtaatgggtaagattaggcaatgttaagctcatatattagtatgtttaagagtgatcaatttagggatctctgtgacagagatgccaaatgctcacagtgctatctcatgttggaaacatgtgtctcctccacttttcctcagtcctctgaaatgacggccctttagggattgacagatactatacagatttctgtgctgatatgtgatttgtctaaaacaaaagtttcacaaaacaattcttaccattgccatttaagagtcactctgatatgctctgtttccattgcaaacaaatgctcattatgatttgtgaaattaacttcacaatttcctaatggataacaccttgaagtatgaaaagcactacaggatcttttatagcttccctcctccagctctctataatctgctcccatctgtggtgtaggaaagatttcagcagtggccgctgaaggccctaagatcttgtctcaacagatagcaaggtgcataacagactttggacaggttgtttaacatgtctgagttactgtttattcactggcaaaatgaagggcttatattatattgtctctaagtactatcagttctgaccacctatgaactttcattttaaagaaaatacctatttctatggcctttaggcattagggaattttgtcaaattaaataaatctcagtaaggtttgatggtcaatggggcccactgtctggtgtgtgtggaggggtgttgtattttacatcaggaacttcagagccctcatgaatttctaattagaggaaccacctgggaaatataagtcaaagccctttgctcgccttactcagctttagggcacagtgactagaggtgggcaatcgctttggtgtaggtattgtcattggaaaggaagaaaccattttctggaggaaaagaattggttgaggctagctttaagcagctatttcatgatggacaaaaggactagctcatccattcttcattcgtttctctgtatcctctatcaaatttctgagtaaagattttatacaatgcttgattagcattcaaatagtatgtttcaaagattttaaaaaaaataaaactaggcctttgaatcataattatggcttataactctatttttcatatacttactatctcaagttacaaatttcatgttatgtttttttcaaaagagtattcctgccacaactcagagctcagctgaattagagcagtgactagaaaatctgagaaggctgagcttcaaaataaggtctggaaagtgtttcttattgttacaagagagtcaaaatgattttcttgagctttaagtttatgtaagtatttacttgacacttagcagtttaaaagataatgtgcaaaaatatgaaaatgagaaaaaacaatttcaaaacaagagttggtgattacgtgagacttagtagagcaaagtatattctaagtattaatctgtctaagctgtttgggaacagatgtacgtgaaatggataccgggtgttctgttgtgtacaccccaagtgagacatctgttggtagactgtgtggtcagaaataatggaagcaggggttaaaccccaatatgacctattactcatgtgaattattgaaggactaattactcagtaaaacatgatgctttgattcatcagtctacacgttaagaaaaaagcctctttagaaaaaaatttagttctgtttctaagctgtcaaatttgaggaaatttttaagatgtatgcaaagactcaaatttccatagtaactgcaaatactatctgcttataaagttttaaaatgttttgacaggtctactaatttatcataaaaatagcctcaaaagttttagctttttgttagggtaggttgggtctcacagaaaacaaatgtagagtgaattttctaaagcagggctgtccagttagacttcctgaaatgatgggagtgcactatatctgaagtgttcaatacagttaccaccagctacatgtggctattgaacagaaacatggctagtgtgactgagaaactgaatttttaattatatttaatttttattaatttgaattcaataactgcatgtagcaagtggcaactgcattgtacaacacagctctgacacatggagagttgaaaatgtttgtttactttcttcccaagttttcattttagtctttgtttctacatagaaaggaagatatagcttttgaaaaatgaacctgaatgtagaactgatatggttatgcaatttgagctgcctatttaaagataaagcaactgagtttagagatttcaaagtggcagagtcctttaacatatttcgtgggctggccacggtagctcatacctgtaatcctagtactttgggaggctgagatgggaggattgcttgagcccaggagttcgaggccagcctgggcaacatagcaagaccccatctcagggaaaaaaatatgtgtatatatatgtatatatatatatatatatatatatatatatatatatatatatgcatacacatatatacatatatacacacatatattaacatattttgtgtgtacaaaaaatatttttattatgtgtagattagttggttactagtaaagttgaagtcttgtctatagaaatcattgtatttttcatggtcattgtgatacattgtttgaactgaaatttggcaaattcaatctgtttcttactacaagaatagtacatagatttgaaatggtaactctcttagtctgtgtactctgaccctgtgaacgtctggagactaatgttattcctaaatatgctatgtccacatggcagcatctgaaggcaaacactttttaaaactgatctacttttgtggacccttcctctctctctttcctgcatcccggatggggccctctggggctggaactggcacagaactattcccctaggagtgggttcattgaagccaagggacacacaaattgagaatcagatagactggaccaaggtcattaaaccagagagggcaatccagatggggttgtccaaagtaggaagttctgaagtgaattgcagaaatccaaacatggcaaagctaaaggaatagagaaccagggcaatggatatagagaacagagcaattgggtatgcaggaagatgctattgcctagactggatgtttttgtaccctctgtaatttgagaaaatggaccgtccttgttgaaatggtcagggatgtagtagataaattcattgcagttgtgtaatctcagcactagaatactgatcataaccatatcacttgttatcccacctagcctgccacttgattgggttattagattacatttcagacattgacaagtctacaagcatcattaaaatcctaaacacagacttctgaccgtattcctacccaagttttagaagcactatgccaatgacgggggtagtatatgctgagcaggtgagttttgattgtgtgtgtctacatgtgtacgtgggtgtggtgagcaacaggaaggaactctcagccatgactctaaatgctcttgtgttggccaaaattggtataagctaggaggagaaacacaaaggagagagaggcatgaagttgaaggacattaaaccatttgcaaacttttggcatgcaaaccagaatatgaggaaacttagtgtaatgggtgactgaattcagaggtagacaggcaatcaggaaggtataggcaccaaaaatagttaccattggtgagcgtttttgtttttgtcattggcatggtgttatgaacttatgttaagcctaagggtaagtctaaaataatgtaccagctggcatcagggaattcccatgtacattcctagattttcattagaaacagtgttctggaaactaccactgctgctacacagcagtgcccagtgcttgactgaaaatagtgaacacttagatttgtttactctgccaggttctgtgctaagtatcttatcttgtttaaccttagcaaagaaactatgtagtctagatagaatttttatccctagggcccagaggtgttaaataacttgcccaaggtcataccagtaatttcagttgctggggttcaaagctaggcagtctgactccagagcctgcactgtccccatttggttatgttgcttccccagttaagcaagcaagagtctatctgacatctgagttggtggtagtaaagcatcatggtctgaaccaaaataataaaaacctttgaaacaacattatctgacttctttcaggcttttaagacagttccatcatcaacagcttattccatttctctggccacttccagtttctgaacaaatgaagaaaatgggagtgataaattggagtttttaacaagtttttttaaatctaattttttttatggaaaccaccaaacatacccaaatgtaggaataattatgtaataagtcctcatgttcaaccctaagaggggtgaagctctatgtgacccattactgagtttaaacagttttcaatttatggccagtcttatttcatctatactctacccacatcccttcttcccctggaatgattgaagtaattcctaggcatcatataatttcatctgtaagcatctcagcatgtatctctaggagataaagattttctaaaaaatcatattactactcttcaaatttaaaataatctttatagttttacatatccagttagtgtccagattttcctgatattttctctattttttaaatatgtcaaccttgaaatgaggtccatattatagctgatggctatgccttttaaattttctcatccacagattcttcttccttttttttcctttcaatttatgttttgaacaaactagtttggcctatagtttctcatgggcaagaataaccttcagactgggatggccatcactctgatacccgtaaaggggatgaggcaggttggggaagggagagcctcagaccatgatcagatgtcacaagatttttgcttacctagggtgaggacttgggaaaaagattgcccattaggagtcctgccttgggcaaaagtggccaaacttcagctgtgctgtcacaggctgtgggctgccttggaaatgtaggacctcaactcctctgaagttgaggtggagcttgagggtacgaatccctggtggccattataatgactacactcattgggatggcatggcaagttcatcctcaaagatggatcctagcatccaccatgaccaatgaggtttttttattgttatgatcactataaactcaaggatttaaacctattaaatgtttttcaattcacagcaatgattatttttactgatcttcaaattgtcacattttggatttttagaccaatgggagccccttcatcttgacttctgagttcttttgacattcactcagctgtctgatagcttccctgctttctggaatggcaagatattccaggttcatcttgaacatttcatgcttgagatatggaatcaagctcatcatcagagggtcctggttccttttactggatagtggtattagagacctcaatttgagaactaagcaacatcattgctaaaacttcccctatgtgtaccttgttacttaggtttttcaaagaacagagctagaaaatatgttgggtttttttgttttgtttttaaagaaaaaatgtatcataggattatgctgatacttccaattcaagtgcaggcctaagcttttcacattgtctcttttctcctacccttaaagtcctgattcctaactataacaacatcattactcatttgctttatcctgcattatgtagacacaatagagtaacaacaccaatgctgccaatcaaaagtataattactgaaacccacttaagatagtcctgcaatttttttttttgttcatagagtgtacactactagggaggtgtagtcaaattactatgttttaaagacacttggaataattcatatctgtgaagttatacccccaacttatttgttttttgtattattgtttcattttgcttttgatgtttaggcatttcttttttaaaaatcaattttataattacgtgaaatacttatatggttccaaaatcaaatctactaaacaaactatattctaggaagtatagcttttatgtttcccttctatgcttttccttccttcctgtaggtaggaaagcttatttgttcctcaaagctctgggttgttcttttattttatataaataaacatgtgcatatattcttttcattacccccacagtacccaccgtcttaaacacatgtacaatatatgtgtttttctaccttgatttctttcttacttagcaatatgcccagaagttcactctgtagcgctttacatcagcatcaaaatccattatgtactatcgtttattgacctctctgttggagaaatttggattgtttctagtcatttttgttatcgcaaatagtggtttaataaaaaactttactttccgttttttgtttttcaatgtgcttttaggatagatgcctagaagtgagattgttgagtcaaagaataaatgtgttaataattttgctcaatattaccaaattctttcaaaagggttgtgcaattttgctttttaaaatcattattgtataagggcatgtatttcctgaaaatttctccagaagagtttattgccaaactttaaaaaaacagcctgatacataataaatgatatctcagcatagtttaaatttgcatttttcttgttaaatcattcatgtttttactgtagtcctcctaacatttagggagcaccaattatggggtctctagaaggttccaggattctgtaatcaatttgacatgatttctgtcttcagatattcacaatcttcaggaagatatattgacaaaagaataactacatgatctattttgtgtgcaacttagtacttacagagcattataaatgcacatggaaaaataggtaaaggagaaaatcattctctgttgggcgggctgagggggaagtcaggaaaagctacagagaggttcgagggtaaactttaatgtgggccttgaagtatgatttggagttagcaagacagacaaaggagcaaggaaaccattctagaaaaagaaaattttgaaaaatctccagaaaaggatgctttggcctatttggaaaataacattgtcttatttatgggggagatgacagtgctttgtttttagtcagtagtttatacaggactttgaatagcatgcaaggaagttggcgtctcaacctgaaaattgaggaaggtgtgacaaaggctgggcattaggtgagatcaagtatttctgtttttttttttggtaaattaggtagcaggatagattataaatgggctccacactgaggagcccagtgtgatggctgatccagcagatcagggggcagtggctgcaaagctgggagaatggcaaggtaagcctggatgcaagggatattgtcaaagacaaaatttgggggatgtgaggcttaaaagggaaataaataatggtgatggtgagatttctagcttgggcagtgggatagatagtagacgctgcgcaaattcgtttttaaatcagcagaatgagaagcatcttatttgaaatatattctaccaaatcttagcatcaaatgtgctagtgactagcaaaatatgtaaacagaagggaagtagcttgaaaagtacacaaactggagaaattgctcctgaaggactgtaagttgaacccttttaagcctaagatctgtatttcctatgagccctaggctctttccttgtgtatcctgtttcttattagagtagaggctacttaaaaataatcatagtttaaagcgctctattttcagaaaacattattcattagatgttagtaaataatgtaatctttatacattcataatatttctgcattattggagtgtaaaaagtcagtgaaatagtcatttgtaaagatgtcagtttttatctgtggaaaatagctgttcataccattttaagcttaaaagttcttcatttacttcttaaaatatccatgttggtattattttgtctaatacaagtaattaatatttaccccaaattaagcttttaagtttactaaatgttacaaacataattcaaagcactgtttagtgtccatctgtgcaggaaaaataagatcaatacaattgagcagctgttagcatgtattggtttccttatattttaagtatgttttcatgttttgaaggtgtaaagggatgacagtatgttttgttgtggttttcatcatacagataaaaacttattacagttgaaatcttggtgaacataatacattttaaaatttccattcctcacccatttatctagatatttagacacagtaaaataaataacatggatacatttttgtcatgtgatttatgttttttaaaaagtagaaataaatttctctaaaagttatttttattttttaaatttagcatttttcatatttgaggaaaaaacaatatgtcttggtaccctagcttctgaactaataacacacctgtcattttacaggttattttaatgtttttcattgggatcaaacctactctggaaatatctcatgggtgagctttatttttatgaaatgttcttggcacttgaagacctttgtaggtacatgccagactcatcttacatccagttcttctgcatggaaaatatgtgcattgaaattctaagtgccttttcaaatttgaccttcttagagaataatatgagtcccaacaattaggaaaactatggaatgccttttggcctttacttttcaaagattttcagtcagtaatgtttaattagcattcattgtgtacattgtccttttttgtgtgatatggctagttccaaaggaatattctagaagatctcagccttctgctattgaaggtgataatacactactaagttatgtgttgctttacattaaaataatgttgcagcagttacttattgcttaactagcgggtataggacatcaggttgaaataactgattttgaagtgaagagttcttgtttatatcttaaactaaccaagtatgttcattaactttgagaataacaatgatctttttcattattcttgagtagactggataaatcagaaaacccatgttagaggtccctgtaaaaacttcagtcttatttggtaagtccctttataagagtttcaataaaatcaggtaaatttaaactctgaaaattctacgtactgtctatcatgttcaatttactgttaaccagtactatgcactggaaaaaatttttttcaccttaatgagaccactggtcattactgctgctactgatgctcttttgtctgcacatactgttgcaacataatgtgttgtgcatttgatacggatattatcatattgccataaggagctgctattattttagacaccaactgattccatgatagtgtcagatttctttaacatatgcttatgtttttgtacaaatgaccccaagaaacatctgctagttttgtggtggtatctactgtttcttttttagaatttgacctgtcagtcactttttaacgtgaatctacaatatttgagttgtattcctttctcgtttttatgctattgatattaacaaaattgagtcagttttatggcataattcagagagaaaccgaagctgtctatggatgttattttaaaaatacctttttcatgatgattgtgcctttaaatttttgtcattgattgacactttaaaattgaaaagtgcccttttaatggatcctttaggttccaaaatcttaagttgaaaatttctgtctattggtcctgaaagtactctctgaatttgataagtatgtagtagttgtggtgtatccttggtcagtttatatcctgtgctaattgctaatcttacttagtttctttgatgcgtgtgtgaagacaggcaaagaaaaaggaagtggaatttctacaaaactgtgaaatctttactttatggagactagagaaatttctaagtaaaagaagacactcattctattgtagttaggatcccttcttttacttgcttttcatgatcttgactgaaaagcaacaattgagatttccattgcccgacgctttctcttctgcttttctttttgtttctcttgcatttttaaagacagctatttattcaaaaacaatatgaacttttatttattggacttaaacctggaacatcaacaaaacaaagaacaaacaaaactacctttccaaatttattttattagaggatgctatcaatacaattttgtattatgttcacacttgataccaaacctaaacccaagaaagtgtgtcctgtgttacagcctatccctctgtttaagataataactagaacaatttacttttattttctactcatctgctttctgtgtatcagctgttgtcctccctcagcctcgaagcatgtcatcatttccatctccgtgctcattcagtcatccttgctgctcttagtcccctttttgtcccttgggtgacttatgtcattaggacaaccttctgtccccacttggctgaaactgagctgaggcccttgccagttgcattaggtgtggcacctttcatggctcagtttgggcctctgtgatatctgtgtgccttctactccaaactccattctgccagaggtggcagggtgactggaagctttagtttcagtgacaaaacccaagcgtggctatgctgagtgtctaagtagctttcatttaggcctgaaataggagagtcaggcgcctctgtgtcccctgagaaagagagatttccctcagctctctgggcccagcactcaaccatttaagtcagctggttagtataatttccctaaattgtggtttagtttccctatgagtaggactggagtaggaccaagtaaggaaagtccctagtgacctttctgcctcctgaggagcaggccatttactttgagttgtagcttcccatctgtctgtccccactaccctatccaaggccctggaggagccacaggatgagggaggagattcatggaaaagcgccttcaggtactgggtatgtctggagtaacatttaaagtttaaaagactctttaacaattttcctctgatacttactactgcctatacttgtttggttttagtacagtaagttttgcctatcgtgggggtgaagaaaatagaaatattcccattaactttgtatggtgcttggtatgacaccctgaacaggtgcacccgtaattgtttacttgatgttctttttaataagtcaattatatcatcggaaattgaagaatagcaaagttaatttgtttaatcattctatgggaactcttgcatgctcgttcactagaggaacattgcgtttctcccttaaaggacaaggctttgttttgtttttaataagacacactctttataattaaaacaaaatcccagtgttaagggatttctgttttaaataattggatttctttcctttgttcctctaatccctctatatgagaaaaaaatctaatggtgtcttaggataaatatttttagattaaaaagttctcttaaccactgaaatttaataatacttctcaaagtttatggatgatatagaatgtaatgtaaggttgagaattttagatttggcaaaggcaaagatacaaaaactagtgaaaaacaacaaactggaaacacttttaaaatactgatgtatttatctttgcaataaattattcagaaatataaataaactcactatttacatagttttatttaaatttgtcctcaaaatactaaatttagtactatatattttcttctttcagataaatgctttcctgaaaatggtattttaatatctacagatggtttagtttaacaatggttggggtaaaaatgacatagggaaaagcaaaatgtgacagcccagcttggttacctttagagaaactcagaataaactctattcccatttccttctctttcccctttccatactcgagagcccttttctgagactcttaagtcatgtttgggccttggagaggataaatagcagggtgggtggtaaaaggggagagtgctttgcttgaggcaaagttttcctccatatgggaccttcctcaagccctcccttcaaaccctttaaatgagagcatgagctcctaggacagaggtcatgtggaaagcagcattagcatgaaggggggtgctgtggaggggtgtaaggtgcaaaaagcagcattagcatgggggaaggtggggtggaggggtgtaaagggaatgagatgtgaagtggttaaagggccatttttctagttggcctctgggctttgatgaaccttttccagtgtgcctgtttctccacttagccctgggctaatcttgactcttaactttccaggtgtgtatctatgctgatttctcctgggtttggaagctctgagaagctctggttctagttcaatcacaagacttttaaagaaccagaaaaataaaacaattttttaaaaagtaatgaagaaaagacttttaaagaaccagtgaaaacctgggagtaaaaatatagaagacttgagaaatttcatctttacctttcaagtgggcagcatgagaaattcttgtaaatggtgctttcaaatcttacacaaggttctcagttacctttatttgtactccctagactgtattgcatcccttgctatgttgactaattcccacctaaaataattcaatggcctcccaatataatctggcattctaattaataagctaagaaattatttggtttttcactcattggcgttaaatattcttcagtgcccacatttggaaatattggaacacagaaatgaaaaaagatacaatcagtttctctgcttgccatgttttccttgatatggcaatacgacaacaggtcaccctttgaagaaaattcagagatgctaaagtagaaattaaaactgaagataagtcaaggcaggatagtataggagtctgctacagctgccatagcaaaatactacagcctgggaggcttgaacagaaatttatcttctcacagttcttgaggctagaagtccaaaatcaaggtgccattggggttggtttctgaagagggttctcttcctggctttcaggtggccaccttcatacagcatcctcacgtggccttttctttttgcctgcatggatagagatctctggtgtcttccttgtaagaacaccagtcctattggattaggaccctatgctatgacctcatttaacctaattaccctatttaaggccctgtctctaaatacagtcacactgggggttagggcttaaacatattttaggggaacacaagtcagtccataacacgtgatttgctatagttttcctttacctaaatcttttccaaccttgagagtggattttggccaggtgtggtggctcacacctgtaatcccagcactttgggaggccagggaaggtagattgcttaagcccagaagttcaagatcagcctgggaaacatggcaaaaccccgactctgggggggcagggggagtgggggaattagctgggcttggtggcgttcacctctagtcccacctactcaagagggtgaggctgaggctggaggattgctacagcccaggaggcagaggtcacagtgagcagagatcacaccacttcacttcagccctgggttacagagtgagaacttgtctcaaagaaaaaaaaaagtgggttttattcttccccttaaattcctattaatagtgaggtgaggcttcttgtgttttttttttttttttccaagacaatggttaatgtgtgattacttaaaaatgatatataacactaagaaataaagaattgttaagtgagaaggaacatattaaaatggcttggaaagatgggtaattttttacattttaagtaggttttctcaactctaactctgtggaacttggtcaatctaatcagtctaaatatagcacaaataataatagttatatggacaggagaaatagtagccctcaaagatagtgaaatacatctgaatatcactaacaatgtcatgaatttgcttgttctaaagttttctgaaagtatgaattcataactgagtttttttttttttgcctatgactactaatgtttgaggagagagtagtgtcagaaccacccccccatttattacatgtttatttcatattttggtactgaaatcagtgtttattttgtgtcttcctgataaatcttgccaataagtaattaccttccatactgaaaagttcttaggattaccaggttgctgggggcaaccttaaaaggccatgcagaacattgacttaggtggctattaccctgctttattcaggtctgagcatttactttcctactacaatcagaatactgacctacatttaaaagtgcaacactgccctgttatctaaatccactgtgttcctgagaggaaataccagaaaagagggcaccaatattatttttctgctgttcttgatcataagtgattacctttttttttggttaggcattctgcttctgaaagataactgaggttgaagttaatagaactaagattcttatataaaatcataggaaagataattttcaggattattgaatcatattgaaaaatgatataattgtgttaaaagataaggactaaaatgagttaattcaatttggaaatagttaaattagaatttgcttctgtttttgatgaatactgctttttgaaaaatcttctgagtatttaagcttttactactctagtcattctctctaaagtagacatagaagcgtgttcttatcttgatttggtaaggctctgaaaatgcaaagcaacagatgttgtacccagcataattatatgtatcctggaaacacatctttattgagtgggatttgttcttggggaaacaaaaatttggcaaacaaaggacattaacttgctgatctcagcagtaattacttgggttagattataataatcttgtgtaggtggtaactgcatgcatatattacaaaatctaattctaaaatacgtacattaaaaggaaaatgaacttgcgcaaactttagatcatgtatccccttgaagagcagaaaagatctcaatttcattatttgaaagttgtttgaacagctttttggaagaggtttccaggattccaaatcctaatatgtgtattgatactgaggctttggactaatctttgggggttactgccttttttatgcccactgaaaatagagcatttcaaacaaatgaactgatctctgatctttaagcatgccagtaactctttggaacaaatccatagttatttttaccaatgactgtattaaaacagtactttctgtattatctcttccattccaaggccattttaaaacaccctctttctcttctcccaataggtaaagtacgacagagctccttaggactgggttatggagaattatctggaggtcaatttgagaaccactgtgcaaaccatttcttaaataagtagctacaaggttgtccttacaaaaatttctgaagttgatggtgttgcgttttggagtctgaagcttaaataagagtttgtcagtggtcatggtctaaatagctgattactaccaaggtcatctaatttttttttaacacaaaaaaatgttctgagcacaaatgaaaccttcaggacaagacatttatgttttgagaatgttcttaaatgattcctgtcgtgtatcttattttacatatcttaatgatcagcatgtattttttgttgttgatgatgattttataaatgtgctatcacctagtttctaattcctaacagctccttcatcagtagaatattgctgtagcacagttttgccatctgttaagaaaagatggtgactaataagagtggcacatttcagggctggtgtgctatcgcaacatctagtgttttagtactgaggacagtgatgtatgcagtgttccttacagccatggggtgtgggaatgttttcctcttcggcaaagtctgtgtatttctatagctgaactctcaggatccagaggaaaaccacaagatgatgaaaccagatgattgtcatcaaatttctattccccactacatgattattagttttcgtcaaaagaaatactcatcctatcctgggttggaattggtaaagaattttgcattgtgactaggacacctaaaagtttttaggatgagtacaaatggaatttgatagatttccccaaaatgtttgggaaaagatttattcctccctaggaacagcaagagtagcagcatcacatgaggcaactcctggtaattttttcttcttgctcttatttcaatgatatcttttcattcttttctgtatctctcaatttctatgtttctcctcttaatgtatcctgtaaatttcttagtagaacctttttactaatgagggtttcctagtttgctttaggaggcactcaggatgcccccttttgtaaggcagtaaattgaaaataagaacttggtgaaggtccacgtgacggttagtttccattctccattgtaccaaactgctacagggaaagaaccatatttaatcaacctcaaatcctcaatatttaggtcagaaaacacttggcatagaagagacactcaaattttgcagctaaatagattattgatagaaaatatgtttcttgcctctacaagcaatatgaaaccaatacaatctctaaatatcttcagactactaggggcaaatactgtattataagaataattcttcagaaaggaaaatccagctactctcatatcacctctctatgttgaaagctagggaagataaactggcttccagccagtgagagtccatgtggacctagtgctggctggagatccctaatccaaaggcaagagccagatactggttgtctgctgaaaatcagaagatgacctctctggtagtaaggccagtgactcatccctgcatcttttatcctcttctgatttgtataaggatctctcctttttccccagtacccactctcaagaattgctttcctttttaacatgatcataccaaaatgtatctaacagtaccttgatttcctttctgaggaatttagggagcatatttactttgtcagactcattagaggtttggcttcttggtcgggttcttaaatggacaacttgtttgggtgatttggcagagaataggagaagccagtcccctctgatagagcaaacctggggagctgtggttgacccacctgctaactgtcctgtacaattaggcatgtggcatcagtgggtgactgaccagagccaccatctcaatggcggctgttctttccttcctgtgccttctcagatctcttttttgttcttgttactccactatattggtttttcttgagtttttttcaagcaaatatcattattcacttctactgcagttcctctgttgttcgctttttctcttagtcttcattgttttccattttgaacattcagagatccatcaaaaaaagtaaaataacaggaagggagaggtaaacaccagtcaaatgaagtattataatagtgtattactatactctttaaagtaattgaagggtggttttttggggtcagaatatctgttagaatttggaatttgccactcttgagactggggcaagctatttaaactctaagcttatctgtccttcctcacaatctgtaaaatgggatcataataatggcacccagtttatggtgtagtgagcattcactgacacaattaatctaaacttatttgcactacatagaacagaatttttgtctattaaacaatatagcgttttaggcatgaaagaaactttagattaaattaaatatcatttttcttaccacagggtaagtttctgttttgtttgcccctgtttctctaactcctagaatagtttccagcacatagagattaaacaaatattcgttgaatgaatgaatgcatctattctaatcctcttgttttaggaatgacccgtcaggctcaaaagtgaaagcatttccctcaagattggtgacagagttggggactaaatctaaggctttctcttcctacaccagtgtcctttctgagaacacgatgccattttctcaatatttgtttatttatatggtaaattggtaggaagctgtgtggtactataagaggataaactttgataatgaggtatacttgctatcaaattctaacattctcatttaaaacatggcataccatttgtcttctacattttcatatgtaaagtgaggtgatttctaccttatagaactattgtgaggattaactgaactaatctttgtagagcacctggtcccatttattttttttttttgctcaccccaccccccaactttctagctagataacttatacattcactctgtttttcattccttcttgaatctcctgtggccagacttgacccctgtcactctacagcttactcgtcaaggtcagtcctcatctgacttgacctactaagagtctgacaagtagtcacactatgctccttgatacagctttcttcacctaccttcttggatgtcattcttttggttctcctcctaccccattgggctgctttttcccagtctccattcttgggtattctcattttcccatgtctgtcctctgacttcttattgtctctgtttctgttttctctggttggaccttctctagtttctggcttcaaatactatctaaatgctcatgtctttcaaatttgtaactctagtctagacctctcctctgaattccagttttataaatcttctacttaaatattagaggtctaataaacttctcaaacttatgttctacaacaaactccacattttctcctgcagcctctaaatatgtacctcctatagattttcccatttcagtaagtgggaacttcattattctgattgtccaaaccaaaaacacttggagacttgctacattccaccctttgtctttcattctacatccaacctatcaacaaatcctgttgcctcttccttggaaatatatccacgcttgagcagcatcattgtcaccacttggtgttatacactctcatttctcacctggagtattgtatttctcatctggagtagtgtctgtccaacgatgtcccccatcagtctgttctccatgtagcaatttcgtttttgtttgttttaagattgggtcttactttcgccttggctggaatgcactggtgatcatagctcgctgtagcctttaattcctgggctcaagtgatcctcctgccttagcttctccagtagctaggactacaggcacacaaccacacttgactaatttttttttttttttaacttttactagagatggggtctccctttgctgcccagtctagtcttgaactcctggcctgaagtaatccttctgtgccagcctcccaaagtgttgggattataggcatgagccaccatgtctggcccagatgttaattttaaagtgtacattagagcacatcgttcttctgcatgttcagcataaaatccaatgtccttaatgtagtctatattaccctacatgggctacttgtgcctgatccctctactcttatgtcttatccctctcctgctttctcactagcaccagccacatcttaccgttccttgaacacaccaagtatgcatttgccacaggaccttgatgcttactgttccctttgcccagaaacccttggaaccagctatgtgttaaaattcagatatttactgattttagagagctaaaatggggtatatataatatattacataacactcacagctggtttgtggtagcatttcataattaaataatatttctgaatgaaacattaagaatgcccatgctaagagggatgagtaaagactcaactctcattgtcagttcagctgcagaatgaggtcagctcaagatttgctgccaaatgacttaagaaaaaaatgtttttggagctttggggatttcagaattgcagatgagagattctagacccgtacctacacagcatgctcccttattttgttccaatctttgttcaacgattatttattgggtagtcaaggaagatctctgtctaaaaggcttctctgtgtggaacaagactggcatgtggaaggtttccaattaacgatattgaaagagtgaagctcaaatcatttttcactcaaatacatactatttagaagacagtggccagtttaagaataatcattattggaaacaaagtactatttgattagggatagttaacacaaacacttattagtattagggatatgtgaaatacttaatggatgagtcatgtgctgacataaaacccattatccattttagttcctggtagcctaactggttgaactctgttttattgatctattattgatttggcctgtaacttcaagttacattttaatgtaatttcatccttttctgatcaccttgtgtcttcaagcatttttaagcagttgatagatagttgaaagatattatcactatttcaatctaaaagatattatcactattttaatctacttaaaatttttactacattcattttaagtatgacttatggaacgaatcgaaaatacaagatagtgaaaaacttgtgaggatcacctgaaattttagcattcactttccttacatagaggaacttagtctctctaaagaattatgagtaataaagtatcataatgatatttgtcttagttttggttaagtgtactccacaggagaaagttaggcatgagcaggaattattgtagtcccacattctcaaacagttctccagtaagaaagattttatgtgtttccagaaatcattttcctcctcttcagagctttgggaccataattgtatttaaattgctaatctgttttaaggaatcataataaattgtttaacatttatattcaatcaactttgtaatttgtataaatttttcagggtgacatttgaacaatttttaagaaaatgggaaatacagaagtattcttagttttaatatattttaaaaagatgacatgtgatctactgactgaaatccttcaatcatttttgtttttctccccaagattagatagaatggatgtgattttatttttaatttgcattatggagagtacttttggggggttttatgaaaaagacttcatttattttgttagtggtacttcagttgcataagaaaatgttcttttaaatatagtggtcatttgtgtgcagccttcaagttagcaaacatgcctttgagtagtcactatttttgaaggtctttatatctgattgcaatggcttatattcaatagtcctcctactaaatgaaataaaaatggatgcctcttctgccacagaggcacaggtggacatgttggtagcaagccccatgcggtgtgacacatggcacagcccaacatgggggcaaagagcatgcggcttgagctaggagtcactttatggctactttagtgtagatttgtgtttttctgtggaacagccattattgaagacatttatatagtatgatgtttgtttttcattaaatgctgattgtgatttcttaaaaatagttaagacttgattagcagaacctatttagaagccagagttcccctgcttcacctcttgctatctatataaatgatatttttgactctgtcctttataatgttggcaccctgtgcatattagatgtaatcagggctgaaaggaaacttgaatccatctggaagcaataaacttttctaaaagactgcacagtgttatttaatcctgtgacttcttactgtgagtgaaattaaggtttgatgcagttgtgtcacatcgtattgatatcaaatttatctttctaaaaaaaaactgacagtattacagcacagaggagaagatggcttgctgtaatcctgtaagctattttacattgattacatgctacataatgtacctaagtatataaaatacttgatctagaatgtttatgttttctccaaaattttctcatcaggtaatactttctcaacttcacctttagttttggcttcttatcatagtactaactatgcggtagtaattgtgttatgatgaaaggcatggagaagaaattataattttaaaactattataaagtggagacacacttgtataattaccatctatgtagactgccaaggtataaacatttagcttattttagtatcagactctttgaatcaatttaaggctttttcaataaaattggcttcctctaatttctactccaaaatggttaaaattttgttttacttcaaatacgttgtagggtatcatatttcatgtgactaggagcctaaactatatcagctgactggcataatttgtgaattatatgtgtgtttattaaaatttaaagtttttattaagacttacaattttattaagacttaatttttttccttacattttgagtaagtccaactgaaaataacttagagacttaggaaatttgactacattttataagtaatttccttgtaatttttctttcttgtggaaacaattcttactgatttacttaactcttttttcaatggcaaaaatgaaaaccaaatatatttgtcaactatattcttttaattgtggaaatgaaaggttcatatcccccatttgcctagcatattaaaaataaacatgacctttgtcttgaatgttgttaacttggattttaaaaatcaaaccaattataagctatattaaaattgcttatcaccttccctttgtcttcagtaagtctgggcctaaaaatactcatcatatgaataaataaagttttacaaatactttttagaacatcttgaattatatgtgtgtttgaagcttacttttggatgttcggtcaacaaggcttctgacagtttctttttatcttccctctattccctgccactgtgcaccccaaagtgatccctgaccacagtggtcccattgctggcatcaggaaggtagactgaggagttcaggtatcctagaggctgttaggtgaatctcttctacctctttcctggtcctaggaccactggacacttcaagtaaaaataacaattactttaatctctcaggtaaagtttcttctcccttccagcaacacagatctgcctgtgccgagttcaaatactctgaactttcaacagttgttctgaatacttttttgtcatcttatgatcaaatattgagagcattgaggggataactgaatgggcatggtataaaagtcagacttttagtgtttctaagtagcagaaccctttggacaatttagagggctgtgcgatatcctcaccgtgactgctgggaagtaatgggatctgacctgcagaggtactaccttggctgacaataatgacaaaagtgagagcaaagtacatatgactatccttgaggtcctcaggaaaaaaagagtattagtgagttgaactgtatgtaagggtctttaccaataaggaagcccatgcccagacataatccttacaccctggcaatagaaaccatcattgtggtttacatctcatcctgttcctacagtccagcaagttcaggccacaaaaggtttaagcactttttcctttgttctcatagcaacagttgcccatggaggttcagttacactaatattaacattttaatatacacaaagaagtgcctcgaatgtagtaggtattcaaacttgttaaatgaaagaagtaaactttcagacttaccttgaactactacagttttattctttctctaacctctcccactactaccatcttaaaaccaccatttaattagtattttataacaagttattaaaggctttcaaagacctttgaaccttcaccctctggtaagttaataacttctgatatgcgattaaatgtcaactgagtagtagtgggccctaagagctcagagggactgagaaatgaaggttattgtttagaagagtggctcaatgtgcttcgacagttggttaatatttgaaaagactagagtcaagaaagccttccatgtgctaggaaatgaaggagcaaaggtccagaggtggaaatgtatacagtgtgattaagggattttctgattgatagtaaatacagtcaataaaaaacttttattggaagcctagcctgtgtttgaagcattaagctaggtgctgggatacagagattagagatgaagataatgatgaagatattgttgaagtgaattgctgagaagctggagaaagggccaattaccataatctgaggctcaggaggaattggtgcaaagatcatctggtatgatatatatgaactgtatatacaaactgatctgtgtagctgaactgataatgccaaaaaaaaaaagactaggtttttgattaagatgaatccattaaggtcatgttttctgttggtgccattcttggagacctcccccaaccctatacatttataaatgtttttcctgagggactgagatggaagtggacatataaaaggaaaggtctgggcaaatacataagtaggtagtaaaatcaaggaacaaatgatctcaacaaaattgcccttcttgaaatgaatgaaaatgatgaaagccaatcacattgcatgatgaacttggggtatagaatatgaaatatttaaaattgctttatttcatgatgtttcagatgtagtaggaacttgttgcatagatggtgtaaaaacaatctagtaataaaatcttaggtatttaatacaaggtgaagaaagatgcaatgcataaatcatgccattttaggcttaattttcataaggctatgcctgtctttataagactatataccaggagttctcaagctttttggtcttggaacccttttatactcttaaatcgttgaaaaccacaaagaccatttatttaagttataaccattgatatttgttgtattagaaattaaatagacattaaaaatatttactatttaaaaataaccaaaaagatgggcatggtggcccacacctgtaatctcaacactatgcgaggccgaggcgggtggatcacttgaggtcaggagttcgagaccagccaacatggtgaaaccctgtctctactaaaatacaaaaattagccaggtgtggtggtgggcgcctgtaatcccagctactcaggaggctgaggcacgagaatcacttgaacccagggagatggaggttgccgtgagccgagattgcgccactggactctagcctgggcaacagagtgagactctgtctcaaaaaaataaaaaaaataaaaataaaaataacagtaagttcattgcatattaacataaataacatatttgtattaaaaataactattttccaaaacaatcaaaaaagcagtaccactcttctattttaaattttttcaaatctcccttttctaaaaaaaaaaaaaaaatattgtgtaagtttaaggggtacaagtgcaattttgttgcacggatatattgcttagtggtgaagtctgagaatttagtgtatcttcacccaaataacatacgttgcacccattaaataatttttcaacacccacccccttctcactctcttgagtctcctttgtctatcattccacactctgttcctatgtacacattatttagtacccacttaaagtgagaacatgtggtatttgactttctgagttttttcaactctggcttaatagaagacagctgaaatctcagaatgcttcttcatccagtctgttgtgaatatgttgctttgattcaagtatctaaggaaaatacagttttacacagatgtgcagctgaaaaggaaacatcttttaatatgttcagataattgtggatattgtcctttgatactatagcaaaacttatcaagtgctaatttcttaaaggctggttataatttgaaatctgaaaacatatctatttaattgtagtttgctatttgaaaatttattggtctgtcttgtactttgaatggatattttgcccacgtatgattttataacatcctgtattggccttttggaaaatttggtttactattatacagtttctaaatgttgataatttttattataatatattttaaaaagtctaatgtcactgccagtctcatcagaaaattctttgagattagaaagctgttaagatcatcatcacacttacaagttttacaaaattttaattttactcaaaactttatattttatcattgacaaagctctcagttgctttgcttagtgactgactcactttgttcattttccagaaagtgtttaccaaatgctgctgcctcaataccagagtctgtattgtcagttgatctttcaagtaaaaagtggtgttctatgaaaaacagctagttcagctgcgactgaaatgatataagtgtttctcctggagcaaaccaccacttcgatttgtagcagaaatgctgtatgtatactttccattgttattactcataacatttttaaaaatatactcaagggtggagatttttttaaaaataagtgttattgcttcatcaagaacagttaaatgaaactggattttttaaactgagtttgagttaatgaagaatgcagcaattattagtaaaatttggtgctccaccttgattcatactgacactccaggagttttacccactatttcttttgtacctttagtgcaaatgttaatatggtaggaatggtaaatgacatctttagtattattataaaaatcgtttttaccctgtatactctttgagactacacattgagaattgctgatgaaggtgttttaatttatcataagcactgaaaagatttacttaattcaccaatttctcctgaatatttgtttatataaaacaagactatgtgtatacacctacctttttattaatggtagagatctaggaaaattaatttctaagaactagccaggatatttggaatgtgaataaatcatatatccagaaaaaagctttagaagattgtctatgattgaaagtcaaacagctctcatttctattatactgttctttttcaaagaatttaccaattttatgtggtatttatgattaaacatacaccatgtaatttaacatttttaatgtcacttttacatcataggtattaaagattagcatttttattgtctgtattttaaagctcaaagaataacatttaggctgggtgcggtggctcacacctgtaatcccaacactttgggaggccgaggcaggcggatcacgaggtcaggagattgagaccgtcctggctaacacagtgaaacaccgtctctactaaaaatacaaaaattagccgggcatggtggcgagcgcctgtggtcctagctacttgggaggctgaagcaagagaatggtgtgaacctgggaggcggagcttgcagtgagccaagatcgcaccactgcacttcagcctgggtgacagagtgagactctgtcttaaaaaaaaaaaaaaaaaaaaaaaaatttagatttttgactgtttcattgattcatcttagacttcacatgaaaatatctgtatatcctcaaatgcttacattcttaagaagtatctcagccatttacacatgatagaaacaactaaatggaaaaaaattgcagttggaaattcactattttttatttgatccgataacaatgtgacatttgcgattggactgtaattttctgtctttctctctgaaaataagttcaaaaatttccctctaattcttttactagataagaagcctacttcgttgtaactcttgatatatgtatgtatttaggaacttaagcttttctgctaataaatgttatgtcataattcttgaggatagtattatattgtgatgggttttcagtaaactacaggagcagccctatttgtttaaaccctagtttaacctgattattaacaattaaattgtgttttcttctaacaattaaagtgtgtttaaatttattggtcccttgcttcacagatttatctcagtatgtggtgtattcaaacagaattttgtatttttaattaggggattagataaccaattctgaagagccaaaaaaattgttagacatcacattgcttaaccatctaatataccataagtgtgtgtatacactatgttgtgggagccatctatcaggcaggcctgtttttcaggcagtattttaaaaagtggacatgtgcagaaactgtgagcacaattagcgccaagcagataaatccagctctaatcctgtttacggtctacatcagacagatgtgccaagattgatttagacaagcccgaggcttacagtaatatttttaaaagtgccattcgctgttctatttttgttaaacctttgctaaatattcttaagtcttgttggttttgctcttcttattaaccaccgtaagtaacctactttaagcaggtcccgctttgctctcatggtgacaaggtaacctgccaggagaggttatctttattccctgtaattaagttgacttttccccccaaaaaaatacaacaataggaagtgggtgctgaattaaataaatagcatgatacccagtagatgtatacttaagttccttgcaagaacagatggtccccagtatctctgtaagtaatgtgagaggacagttaatgttctgaaacaactagctataaccagtatgatactaatgaaccagtagatttcaaataataaaccacatgccgccaagcaaaattatatgtcattcataaggatttaattatcataacttgcaaaaaagtgtcaatagatgatttctatatttttatctactgatatcaaatatcaatttatgaatagagtttcacttcatattttttaccaataaaggtatgttttaacattaaggtagaattaaagttatatttaaaatacatgccccaaagtatgtggtgatttttttttaactcctcttttactatactgtctgtatgtattgggctgtatatggaaatgtagcttttacatacaattaggaaaacaattgcttttatttctagcagaaacttgtactataacagaagtggctagcatgggaatcagagtagttatcttgtagatgacaactgaagcagacataaaagatgtaatattttttcagcactcaaaaatttataagtaaaattttataaacaaaaagcagtatttttgtgattcatatggaaaataaaatgagtctgagtcattcttaaggtgataccgtaaaggtgtatagataagaagtccatttttaaatatacccaagacaacagttttttctctcagtatggtttgttttcccttttttctctttaattatgtttcccataagtatttgtatattctaagaatgtccaaaaaataaatgttttgcagtgggggttgaaaagaaagaaagacctttttagatttcagctgatcttatcagatgatctctagaaccttgaaccttcaaccttcactgaagttagctggagggcttttcacctggaaacctgagaaacctcagaagccttctgctttagctctctctcaagtctaggaagccagtggcctgcgaccccacagagccagctggtccactcctcatataagaacttcggtaacaatacaaagacatagcaaagcaccatctaatctgataactcattaaacaatatttagatggctcaagactttaaataaaaacattttaagcttgtttatagaatactaacaagttttattcccaaagactatattcagagtgagaaaacaattttccttaaaactaatattatatacatgttcatatatgttaggaactagttatatgcaaaatcaagtgactcttgtgattagaactggtcacatttattcatgtagcataaatggttaatattgccaaaatgagtaatagatcagattttctatgtgagatattgacacctgagagatttacagtgtttcactgttgtgaaaaatggagtgctgaagaacatttgtctattgttatacatttgtaaaagaattcacaaattactaatttcaaataagaactaaatatttcttctaagcctatagtttttctttttaatttcttctaagcctacagtttttctttttaatttcttcttgtaacattggcaaaaagaccattcgtgtgaaaacctcagattttgatctgtacacaaatgcaggagtagagattggaagcttgagctggaaaagcaggaaatactgctcagagccttacaaggattttcagaattttcactgttgggtcctcctggttgctgcagtctaacctcgcatctccttgaaggcagccccagtttctgatgaaatactcttcagttaatttatacatatgctgtcttgctgttttcctaaggactgcaggcagaactgtggttcacctactgttttaaatttggctagatttaaaaacagatgatctcacttatatgtggaatccaaaaaagtcaaacttatagaagcagagagtacaattgcggttgtcaagagctgggggaggggaagcaaggggatgatggttaaaggtataaaatttcagttagacagaatgaataagttctggatctattgtatagcattgtgactatggctaataatgtatacttgaaaattgctaatacctgaaaatcactaagagactacgtcttaaatgttcttacaacacaccaaaaaaaggtgtgaggtaatgaatatgttacttagcttgattttaatcatttcacattgtaaacgtgtatggtactgatcttgtacctcatttcattttccatatgaatcagaaaaatactgctttttctttataatatcttatacagcatagatacaatttttagtggtcaattatattgtaatatatacataaatatatatgattttcattggtcaattatactgtaataaaacagcaaaaaataaagttgtaattaaaaaataatttggaagaaaaaattagcaagtggttggagattgaggaagatgggaccaataagtcctccaaggagagtcatacattagttttttttaaaagtccattattaatcttataatatttaatatgtttaatttcttgacacttattaatccaattaagtatgagaacactgtggataaatctaaaaaccttaaagttgagtaaaataaaccagatacaaagaagcacatactttatggttacatttatatgaagttctagaaaaggcaaaacttagctatagtaaaaaaatcatggtcctgagggaataactagagagtggtatgagggagctttctataatagtgggaaaattctgtatctttattgggatagtggttatgtgagtgcatatacttaaaaaaactcatggaattatgcccttacaaatctgtaatttttgttggtaatttataccttaataaaaaacaaaacagatgacagggttagtgattgtttccttgaagaaggtctttacatgggtctgttgttaacgagttgtagtaaaaatcatccaaaatgcttggattcaaatcttagatctgttcctaccagatgtgtgaccacagacaagttacttacattccgtcttcagtttcttctcttttaggaaaaagcatctagtttttgttgtagagattaaattagataatacaaatgaagtacagagaacagcgtttggtgtgtaacacatgttcattattagctacccttattttttagagaatggaaatttttaaatttaaactaatcaaactattttaggataagcaagtgaaacaatctttttttcaatcgatcacagaaatattttcactgaagacaaattagacatttatataagcaaactacagtgtcattaccattcaaattttcatatgcatattcatgcttacatgcatatgaaagcattacacatatgtattctataaatatatacaaaacagtaatggaaatgtgctgtactattttgaacatctttctagtcagcccggcattttatttacttttgagacagggtctcactctgttgcccaggcttgagtgcagtagtgtgatctcagctcactggaggctggaggtcctgggctaaaggaatcctcctacctcagcctcctgagtagctgggaccacaggaaagcaccaccatgcccagcttatttggtttattttgtttgtttgtttattttttatttttttgtagagatgaggtctcactatgttgcccaggctggtctcaaactcctgggctcaagttatcctcctgcctcagcctcccaaaacactgcaatcacaggcattagccactacactgacctctacattttaatagctgagtagccttctgttatatgaatatacttttttttaacaaaaccaatactccattattgtacatttaggttgtttccaagtttcactcaaataatgcttgggtaagtaagtatttttatttattattattatttttttgagatggagtttcactctgttgcccaggctgaagtgcaatggtgtgatcttggctcactgcaacctccgcctcctgggttcaagcgattctcctgcctccacctcctgagtagctggggttacaggtgcacaccatcatgcctggctcatttttgtatttttagtagagatgggatttcagcatgttggtcaggctggtctcaaactcctgaccctgtgatccgcccacctcagcctcccaaagtgctgggattacaggccgtgagccaccacgtctggcctggataagtattattttagctaaattgtgcatatttattcccttagagtaaattcctggaagtaaattgctggatcaaaaccaggtatattttaaagaattttccttttctacattaaaaataattataattctgattacaagaaaggaaaattatggagcttcataagaaaaaattagtctcatatttcatacctcatattgcatatttaataggtaaccagtgttaaatttgttgtgtgttttccactgggatttctttttatctcctttaataaaagcaggatcagatccctcagattactttgtaacttgcttttattctactttttcatacctcttagcatgaatgtctttccagaccagaatacagagatttcacttactcatttatgagctgcagaagatgactatgatttattcaaccattctcctattgaagagcatgaatattgcttcagatacttttgttattataaatattagtgcaattaacattttaaagtcttttgatacatattcccaacttgttctccagcaattaccatttttgcattcccaccagcactggggctacttccctttagttgcaccatcatttagcattatttttgatcttgtgccaatctaaaaggcaaaaagtggtatcttgttgttttaatttgcatttctttgattactaattagattgaactttttcatttgttcattggtcaatttgcatttcttcttttgtgaaatgcctgcttgggtcttttatgtactttaccattaaagtgtttttcttgattaaatagattatgtaactgtcatatgttgcaaatatttctgtccatttggcctttgcttatgactttttatgagtctttaggacttttgaggtctttattaggtattcaataattttaatgttaaatatattgatgtctgtcttcctttgtgtcttacggcttttctatttaaggttacgtaaatttctaatatacaaatattggtgtatattatgaaatagggccctatttttctttacaaaagattagtcagttctaaatcatcctttgctatttctagcggcgcttagatgccaccattatcacatcagtgaatttttaaatgtgtaattgtttcctgatctattcatttctctattcctagatacttctattgtaatagctttaccaaatatatctgatagggtgtgtactccccctcattacttcatttatttatttatttatttagagacagagtttcagtcacccaggctggagtgcagtggcatgaacttggctcactgcaacctccgcctcctgggttcaagggattctcctgcctcaacctcttgagtagctgggattacaggtgtgtgccactacacctggcaaatttttttttttttttttttttttagtagagacagggtttcaccatggtggccaggctggtctcgaacttctgatctcaggtgatctgcccttctcggcctcccaaagtgctgggattacaggtgtgagccactgtgcctggccccctcattgcttttaaaacattttcttactgtaatatatttattccaagagaattttcaaatattttatgagattccttgtccattccttacatcaaaaaataccacggagattttgattgaagttctattataagtagttacttggggtggggggaggggggagggatagcattgggagatatacctaatgctagatgacgagttagtgggtgcagcacaccagcgtggcacatgtatacatatgtaactcagctgcacaatgtgcacatgtaccctgaaacttaaagtataataataaaagaaaataaagagaatactggcatggaaaatatgtaatcttggaacttgttgtatctccacttattcaatcctttgtctctcagtagattttgaatggctctttatcccacacgagtctagaatcattttgctaagtttattcctagatataatatgctaattgatatgggaattttttttatctccattataccttcttcttgggtgtagacatatttgtagccagcttcctcactgcatattttttattaggcctaatggcattaagtttattattttggattttacaaaaaaaattatgataacatctttaaatagttagtttcaactcctcctttccccttaaatccatcaattactgtcttttatttcactttccttatgtactgactagaatgcctagaataattgaatgctatgagtaataataggtattcttgccctgtttttggaaatccttctggatttcagtaagtgtgatgttggcttttggtttagtatctttaaatttgcaatttacaagatattttacattggaatagtcattgagttgttaagtaaagcacaaacatgttaaattcagactgaagtacaggacttcaatgaaaagttaaaagagtttatttcatcactttcattttttctttccctcagtggctgtttgtcccctccccccaccccgctccatcccccagcttccttcctttgtgctcttattgttctaggtttgactacataaaaagagactctcaatttatatgtgatacaagaccataactaatattataaaattagtctagaagaagttatttgcaacctatataataagggactaatttcaagattatttgaaggactttaaagattggtaagaaaaaaatagacaaccgtttagaataaggcaaagcatgtgtagaggcaactcttaaaaaaaaaaaagtgagctgggtgtgatgatgcacacctgtggtcccagttactagggaggctgaggcaggaggatcacttgagcccaggagttcagggctgtagtgcaccacagtcacacctgtgaataaccactccattctagactgggcaaacataagaagactctgtgtcttaaagaaaaagaaatgaaaagatattcagtttcattaattgtttgactagctgatttttggaaaatacccacaaatataaccaagcctacaagttattttaaggtgggtaagagatacatcttatctatatgcattcacctatgtgaagcggacacccagtaacacccccgtgtggaagacaagcttccttaaacttcacaggacagtatttcccatgtagtccatcatagggtgaggatttttcaggacctttggtaagcctgcttgctttcattcttgagggtagaggaagggtgcaagacttccctggtctctcccaagcattttggggaccctggccataagcctacttgctcaacaggtgcaaatgactggtaatatgctgaccagatgcaagtgtaccaccaatgatttgctgtgactgagtttggtttcctttgcatatactatccagctttttgtttctaatatattcttccttaagggaaccaggacttcttggggaatccagatgagcttgaaacactgtttttataagagaagggctgttttcaaaaacatctatagttcgtaacaaaggagttagattgaagggactctcactgttcagtctgtgacaagcatgagtgttaaaatggagacaagaattttagttaattgtaatgttgaatttgtaaaaggctataacttcataatatgatcaaggggaacaagcaatctaaaatgtgttaaagtagcattttcaaagtgcggtccagggactctcagggttggtgaggtcacaactgtttttataatattgctaagaatgtatatcactctccttctctccaaggatacggtggagttttccagaagctatgggatatgtggcgatagccttgccctaatggagtgtgtgctttgtgctttgcatttttgtcctttaaaaatgcttggttttaattttgaatacaataattatagatagatataacctacataaaccaaagttatttgcggccctcagtctttaagggtgcacagtggggcctgagactaaagagtttgggaattgatgttctagagaaaagtcagtcttactgatgagggttaatcaattagtatttactgaccgggacaggacaaaccattcattttataaagacacacagagcatttcactaaaatacttttactctgattaagtggtgattttagtaatagtaatgattgtttgattttctgatacctgaaggaaaaagagcctgttgaattgatactttgagggtgttgagttttaggtcactgggtgactgtagaaatggaccaggagaagaactgaaacttgagccttctaagaaatagaagaccaaaaaatgtttagtgttaccctatcccatgaccacaataattgagaaaaaggcctttccgttccctcttccctaccctcccccttctcccctaccctctcctcccccctcccctccccctcctctcccctaccctctcctcccccctcccctccccctcgtctcccctaccctctcctctcccctaccctcccctccccctcctctcccctcccctctcctcccccctcccctccccctcctctcccctcccctccccctcctctcccctcccctccccctcctctccctccccctcttctccctccccctcctctccctaacccctcccaacctttcccctccttctctgtccccctccccctccctccctgtcttcctcccaccccccactccctgtcttcctccttgtcttccatcctcccttccttcctttccttcctgtctttcttttcctttctttcctttttcttctttccttcctgtcttccctcctctccgtctgtctccttctccttgtccccttctctctgtcttgcctttcctttccttctgtctttttctttctttctctttctttttcactcttcctttttttaatttcccttttacttgccttctctctttcattccttccatgctttcttttttttagtggtatgtatactttgtgagcaatcagactatagcttgcagaatagttgggagaggccaaaaatgcccctgagaatgcaagcaaggaacttcttagtgagcatatgaacatcctcactccaatcggaggataacattgttcatacttcaaggactaaaaagctgagagagggtctctgctttctgttacttttagcactcgagtcatttctgcatgtatttctactgattactttttctcctattttggttcatatgttttctgcttctttgcttgtctagtgattttggattagatgagtgacattgtgaattttactgtgcaggatggctgaattttttttctattcctgtaaatatttttttggcattgttctaggatgtagttaagttacctggaaaaagtgacatccttttgagaggcttgcttttaagttttgttaggtggaatcacagcagtctttagccagctcactaaggaccaatactcttctaaatacttaccataatgtcatatgaatttccatgtttttccacttcagctggtaggaacacctgtgtcatctctaagcattgtactgttaattcttctagtagttcttatctggctttgtacatctgctgatcaatactttcagctaaagtctcaaggggacctctgcaaatctacagtgttcactgttcagctttctcttctgtagtaaattgcacagtgaactctagtccccttagccttcctgaacccccagttctccttaactcagggagatcaccaggccccaccaggattcctgtatctgccctgtgacctggagattctctgcaggcaataggttggggcggtcgtagggtccactttgttttcctcctcttcggcttcactgtcctgtgttacctgatgtccaatgtctgaaaactactgtttcacgtatcttgtgtgcttttgtagttttaggtgaaaggtaaaactagtttcttattattccacattggccaaagcagaagttttggaagtctttttttaaggtctaaaacacttctactttgagagtcaattgaaatggtcttttccacaataattattttctgacctatggtttaaagataagtcatgaaaattttatgccactatttttttttaagtctgattatggttaaattcagggggctatttcctcctagattgacagagtttataatgtttcctactcacaataattgtacttctgcttcctctttgcatgtgttactttaatgggaatgtatatttccttttcgttaaggctgccttcaacaatttgtcataaagtcacttctgttagtgaattctattttttctgttactttactctatccttagtaccaaagagctccttatgtgacaccaatttattactaaaatgtcgctttgtttatgttcttggaattcttcatacattgactatcctcagatgtcgaatgttgtaggcctgtgtggcagggactctcttccatttattctatttttaatctaattcttgacaaaataaacccaatttttcttttcttcccctttccatctcacgtagggactggcataaagggcaatccataaaattacaaatgatgaatttttttggttttaactattattcatacatttaagatatggtcacaatttttatttcttactagtaattcattttattttttaacttttaggttctggggtacacgtgcaggtttgttatataggtacatttgtgtcatgggggtttgttgtacagattatttcatcacccaggtattaagcccagtacccattagttatttttcttgatcctctccctttgctcactttctaccctctggtaagccccagtgtctgttgttcctttctatgaaacacaatggttttaattggaaaatttatttttttttcaggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggtaagtactcctcatgggaaattttaatcagcccagtttccttgatatacatgattaatctagacatgttttgagtaaaaacaactttagtgatgttgagatagtttccttctgttcctagtttttgtcgtgagaaagtgttgaaatttgctaaatactttttctacattaattgagataatcatatttttccctacatcctgttaatgtggtatcttatattaattgattttcatatgtttaacatccttgcattccaggaataactccccaatggccatggtgtataatcttttaaagatgctattgaatttggtttgttaatattttgttgagtatgtttgcatcaatattcataaaacatattgttctgtagtttttctgtactgtttgtctgactttggcatcagggtaatactggcctcatagaatgagttaggaagtaactcttgaatgactattttcatgaagaagcttcaataatctgaaataaaatacttaaataatttagttcacctgagagttgtttttagaagcgtatttatttttctattaatgtcttttttgaactatataagaatgtattctccttccactcacacattgatggcaagtgtgtatttgtactctgtggcctgaaaataagatttttttgaataatcttaagaggccatgctttatactctggtaattgagaattacctatttcacagtagctttttctaaaggttaatttccagagaaaagagaacatgtttattaggatatatctcttaatgaattcagtgtatctgaaatttctaaatgacattttcatattttgcatactaaataaaattcataagtacaaatataatgcaattcataagtacaaatataatgcaatttggatttctagaagttatctagttaaaatatgatcttaggatttattttttttgtcttagatttatgaatcttgcttgtttttctgttaattcatttcttcttgtttgctgcatcagtcagatcagagtagaggcagcttgtatagttgatggcacagtttagggttagatggcacaggatagaaatgggtgctagacaaagagcagtcacagaggcatgttagaaatttccagttccagcatcattgatgaagaaaaccatgaggacccaagttgatcaaaggcagccagccaataaagctatgctcatgcgagatgagctgaagtgacattacattaaaattggaagaccctcttactaagtggctccatgcttccctgctagcccctttgggacttccaagaagacttggttatttcaagaagacaagaacccacagaggctgtagtttagtttatctctctggaaacatagagaatatgtataattaaataaaagcactttaatagtgaatcctttacagtgttatttgaaatttatgtcaagtgatttaaaaagtaaaaatgaaaattaataatttcagtggaagtaaattgattaacatgaccaggaatacataaaacttgcatggtcttgtctataaaataaggatatgtcatttaattaggagagtcaaagctcattcttgcgcttaaggtctgaggaactcttctcccatggggcttatgaagggctacactgaggcaacttcctcaatatatctcagccataaaaccaagagaaagtaagaagcagaggacatcacaacaaagctcaattcagtaaaagcaattttataggagtagagggacttgtcaaaaacaaaaacaacaacaaaaaacaatgtccaaatatttattcagcttaatgagtgatgtttttgtttgatctagggttaaaatctagacaaattacagagatgaataaactacatatcctttagtctaccatcctctgaaaatgttactttttgaaactttgattttgataagagctggaggcactcagggagtcattctctggcatggtctttgagtacagagtgattttgctgattaaaagcaaatagattgacttttaaaatcaactcatacaaacaaactgttaaaatcctctaatgagagtgaagaaacctaaccaagactgactgatacattactgctccatctctgcaccaaagtggactcagggaggcctgtaggagatgccaactccttatcctactccccacaaagacagttcttggctatcttcatcagacacaaatgaatggttgaggctccaaagctctctaccaattcttgtgttacactggcacttttaaaaaattttgtttattttttatttttaaatggagtctcactctgtcaccctggctggagtacagtggcgtgatcttggctcactgcaccctttgcctcccgggtttgagcaattctccctgcctcagcctcccgagtagctgggattacaggcacccgccactacgcctggctaatttttgtattacttagtagagatggggtttcgccatgttggccaggctggtcttgaactcctgagctcaggcaatctgcccaccttggcctcccaaagtgctgggattacaggtgttagccaccgcacctggctggcacttctcttaaaactaatatctcaagaagttttttctttaagaatcttctttcaattgcaggtccatgtagttctggtattcattaaagtgcctatcccaggggttttggtatgttgtgtttcaattttcatgtttcaatttttttgatttatgcattaattttgttttttcagaattcaggtgcaggttgtttagtttccatgtatttgtgtcgttttgagaattcctcttgttcttcatttctaattttatttcattgtgacctcagaagacacttgcattgattttgattttttttatcttattgagatgtgacttacgactatgtggtcaattttagagaatgttccatgtacagatgtgaaaaatgtatattttgtgttgttgggtggaatattctgcagatgtctgtcaggtccatttggtcaagagtctgatttaagtccagtgtatacctttgttagttttctgccatggtgatctgtctggtgctgtgagtggggtgttgaagtcccccactattattgtatagctttttttccccataggtctagtagtatttgttttatgaacctgggtgctccaacattgagtgcatatttatttaggatagttaaatcttctggttgaattgaaccctttatataatgccctcctttgtctctttttgatgttgttggtttaatgtctgtttcttctcatacaagtatagcaacatctgttcttttttaattttctatttgcatgctagatctttctccatcccttcactttgagcccatggttgtcattacatgtgagatgggtctcttgaattcagcagaaggttaggtcatttaaaaaatctaatttgccactttatgtcctttaagtggagcatttaggccatttatgttctaagttaatattgatatttgaggttttgttcctatacatttgatatttgtgtattgttaagtagttgctttctagtttgaattgtgtaattgctctataagatctctgagccttgtacttttgtgtgcttatatggtagcaagtattgttcttttgtttccatgtttagaactccttggagtatttcttgtatggcaggtgtggtggtaacaaattcccttagtgttttcttgcctgggaaagactttatttctccttcatttatgaagcttaatttggcagattatgaaattcttggctggcattttcttttttctttaaggaggctaaaagtaggcccctgatctcttcttgcttgtaaggtttctgctgagaagtcctctattagtctgattggatttcctttataggtaatttggcccttttctctagatgcctttcatattttttctttggtgttgaccttgcatagtctgatggactatattccttggggatggtcatcttgtatcttgcaggtgttttctgaatttcttgtatctggatgttaacctctctggcaagattagggaaattttcctgaattattgcctcaaatatgttttccaatttgcttacttcttcctcttctccatcaagaatgccagtaagtcataggtttggttgctttacataatcccatatttatcaaaggctttgttcatttttcagattctttatgtttgtctaactgggttaatttgaaaaggtggtcttcaagctctgaaatcttgtcttctgcttggtgtagtctgttgttaaaacttccaagtgttgttttgttttgttttgttttgttttgagatggagtctcactctgttgcctaggctggagtgcagtggcatgatcttgactcactgcaacctctgcctcctgggttcaagcgattctcctgcctcaccttctggagtagctgggattacgggcgagtgccaccacccccgactaatttttgtattttttagtagagacaaggttttgccatgttggctgagctggtctcgaactcctgaactcaggtgatttacccatcttggcctcccaaagtgctgtgattacaggtgtgagccaccatgcctggcctgcttccaagtgtattttgatgttccctttagtgaatttttcaattccaaaagttctatttggttttatcttaatatggctatctcatgtttcatatcctgcattgtgtttctggtttatttgaaatggattttaaatttctcttggctctcactgagtttccttgcaatacatattttgtttttttagtctgtcatttcaaagttttcaacttggttaggatccattgctatagagctagtgcaattctttggaggtatgaagacactctttttgtagtgttggagttcttgggcagattccttcttatctgagggagctgttgattcttatttttgaatttcctattggttgggcgggacttaaactttttttttttttccccttgagggtatgactatggtgtatgttgtgtgtgatcattcaactttgtttctgggtgctttcagggggccaaggctctttatggattccttgggcgtggtagctttcttaaatgctgcttattgtagcaatgtattggatttgtgagctgacactctatctcatgtggggctgagggtgcagaagtctcaggaagcttattttgtggagtagtgctaagcctttctggtagtgggctttttatttgatagtacagttcaggctgcaatccagtagatggcacttaaaaaataagaaccagcttgccctcagttaggctgatgtccagtagaagcacctgtcctgacaggggagtgacaggaagagattctgttggtgtgtgccgaggcctttggggtcgctggttggggggagatagggggaggtgcactagctcctcatgcaggaatgtgatctgcttttctatcataccccatcagagggctcatgaccttcagttcataaagattttttccttgggttcccagccatagtctgtctgtaggttatgcatatgcccctctgaaggcaaccaccaaaatggtcttggggcagagcctcttcccccagtctagggcagacaactccatgacttgtatgtcctccattgctgggacactgctgctctgtgtagggatggggagttgggccccaccctttatgtaagcctaagtggcattctcactttcagcaggggtggagccatcttgaaaaccatgaaaaactctttcttcgagtacctgtgctggcccccagtgggaagaaccactgctgcgtcttcaacagcgtgtggggtgggagggtattgccacagatgaccccctctccatatccgttccttgacatggtgttgccccctttagcgattggcactgtgcccacctttcctttgtcccaaaggggttttggcaagttgtgtccctctcccttataggtggcctacactaggggggttagatctctagaggttccatagctccctgggaacttgctggccccctgggcttttcaaagtcagaacaggttatgaggtatgtttgctggggatctggtgctacagagactcaagggtagagaatccctgggcagagcagaggcccaccactggtgcacaagcaatatggtgaccaccatctcagtttgtgtctgaggggagtatgggaacccctgcaggagctggccacccagttctctatccctgggaaattcctaaattaccaccaataacattgccctgggtcacaagggtggggccttgaattctttgggggttgatctctgccagactctagctacttttcctttctgcaccccagcttcttcccatgggcactccaaaaggtcctggctctctttccccagttttccattagaaacttgtccatttgacagtaactttgatcttctttctaagaagagctggcatccaaggtctgtggtcagctatgttggaaaaaagaaggagaaaaaaactagtttgtattaaattctgaaagactagtggcactggttaagtctttaaaggattgttaacaaaagaaaatctttttaaaccaaactcctaattttatcagaattgtaactgaaaatataaatgtatgaaaacataggtattatgtaaaatttgctcaataaaagaataggaaaaactactatttatcttggactgatagcatgttagtttgagatttgaaccctttctactctagtaagtagtggtgggaaaaattcactgtaggagtctgcagacataacaaactatcattagactgccaagacctccacataataaagcaagcagagaatgtcaaataagtatgtgaaaaatgatcaaaaaagagaaattgaaaatataaatagggtgctattaaaaaaggatagcatttatgttatgacatatgtacacatgaatatcactttttagaatttcatccttcttaggacttattcctgagtccgaggattgagaggttctgataaaataagtctcagtgggttccaggcatgggctttctttaaaagtctctccagggattctaatgtgttgccaggaccaagtaccatggacagccaagatctcatcagcacagtttgattgaatgaacttatgtagaaccctgaatgccacacttaaccaaagaaacctttccagggattaattataggtgacagaacatgctatattcttattaaatattattaaaagttaagcaatacccattcctgattcatgtaaaattctcacttattttccaagagttttactgtatgactggtttatgggatgcttggaaaaggttgacagacatggcaaaggttcctgcagtgtttctctttgtccatcaacagccctagctcataacctctaccctttcagctaaaagcaattagctcttcagaagtgattcattctatttatacttgggataagtaacatcaggcagtcttccctagggcttctcacgggccctggtggcatttttattctaagagagggttatatttttacatgtaattggtcataattatactaaaaacaagtaattggtgtcttatacaagaaaattatatttctgctttagtcattgacagagtatcctgagaataagagttaagaagtatattcattgtcatcttatttctgatatatttcaaattcttttgctaggaagaagcccttttgactgtgctttgtgtaacaaaacttcttcggagaaacaatttagataaactttgtcagatcttatgtgattatattcaaaatgctaattgaagattctctaaacattttcagtaaaatgttgaattgttttcatgctgttaaataagttaacatgtcttcctttactaaagtcattattataaaaatgtaaatcctaatgataatagctgatgtttattaagcatttagtaggttccattttttgatagcaacttttatgaattatctcattaaatcttcataataatagcatcaagaactacaaatatgttttcatgtaagaagggaaataaaattatgagttttgctgtgaggtttgaagaatgaaaacaatgcatgacttagaaaatagtataattaagtgaattttattatcattatcatctcttagtttataaatgaaaaaactaaggcttacataatgtaaaaatcagttaacaaggttaaacaaccggtagatggtagaggaggagctgggaataaatctgtacatgtctgaatctggagcaggaacccttaactgatgtgtcattctagcaggtcatcagttactctacaatacctattaagtatactttatttactgtgtttagatttatagtagatttagactctactgtaaaaacaaggacttcatacacctgctagaaagtatccatatcatcttgtttgaaagttgtcccgctctagtgttcttttctaatcatgatgattcagaactccaaactcttgaagcagggcaacccgtagggtcagcattcataatttctcaatacttaaaaaagtttcctcatgactgttgctattattgagatttctcaaatgtcttggcctgaattgggtgtgcactatgaaaaaaaaaatggcagacatttctttttgttaaaggaattttaaaaacacatataaacacactgatttgtgacagattaccaggctttatgtttagcagggtttcctaagcaaaacacaaattctgtaaatctacagaattagataaaacattgactcaatccttagatgagagtataatggattatcacttaataacttctgtcactgaaaataaatgatgtaaaaagtaataaagttctactctcacagtatgaataaataggaaatacataatactttaaattaggcaacaaatcattaagcccccagcattcattagactatcattaatgataataaaattgtgtggtatttatacagatattatatgtaactccaggaattttgttataattgtgtatgaatatatttgttgtttgaggcaggtagatggatatttgcagcagctatgtgctgaagcattctggtaatagttttcaaatcaaccatttttttctccttgtcgatcatctttaaagcaaaagcaccgttttttactatattttttgaaaaaaatacattaggtgtaaaattatatattttgaagaagttcactttctgtttttactagtttcacacctttgttattttttcagtggaaggagcagagataggcaaaggcgaagcctgtgtgtgtggtcaggttcctgggcccttcatagcatctgatgccaagctgtgttctcttttgtgtcattgccttcccacttgctaattacgtgacagagctagggacttccctctgtctagaatgccccccatctcttgtttgcctagtgaaatctggtttgaagttcaaggtctgatacaaaccaggtgatcctctgcaaaactaactgtacctgagcaaaccaggcacttactcttttatatgttcctggcactgctgatactctgatagaaaacatcatcacttaatgctaactgtgggctcacaaaggggatacttctactgtaagaagactgtaactcttcttagcacagagattagtaagtacttgaaacagagtttcacatataataagtgttcaataaattttattttttatttctaacacttggcacactgcatagctcagtaaatgttggtgaagtgaactgagtattctccttatctattatgtggtaggcattattctagttgcttctgttataaaccaactcatttaatccttatcacagcacttttattgtggtcaatattttttaatcctcacagatggctaaggaatcagcactctgagagattggttgacttgctttgggtaaggtgcttataaagtggtagaacaagattcctatccaggccttctgattcaaaaatacattctttttttttttttttttagtagtgttttctggaaaggcagggtataactgactatgctgtgtatttgggactaagtatattattgtcaagtatattaaaaatgtcgcaacactggaaaggagtccatcaatgggctatgcaggttgagggatttgtagatgagaaactgataaatttggttagcaaggaaagccatcaagctgtgaaccctttatattggcaaaagagagggtcctttgaaatctaagggaacagaactttcctgttctccaagtttggagcagaataggtaagctctaggcagtctaatgcccaacttttaccagtggtgttttagttttttttttttttccaaaaggaaatgatggaattctttatatacttctgaattgtctatcttttcaaaaataaaaattttcattttgcagtacatacagaatcaaaagactttcaagtcctaactccacaaatgtttattttgaagctctttaaactgtttaccacggatattagtaaatctgtcagaaatgaggtgacttacttatccttgtcccaccagatatgtgggaaggatgatcacgctagatagcatggatgggtcctctatttatctctttttacttgaatggaaaacacatcattcagattaatcaattagtcattgtgactgatagaatttttatatggataatctgggtttggtccctagctttaccacttacttggggtctttatgtcttctatggtctcctatctgtaaagggaagttgataatgccaatctagctaggttactgagatgcttaaatgtgtaatgtatgcaaagcagcaggtactcaataaagggtaactcttactattattgtatagctctccaggtatgtattgagcttctatagaatccatagccccaaactctttagccctttgagaccaagattaagcattgtctttccagaggagagggtgagagagattgccattatactaatagaattcatcattatcaccgtcatcatcatcatcatgatttcttggtgtgtcatggaatgtactgtgtttcacattaccaacagatgttaattttcacaacatccctgagacaagaaactatgattacattttacagataaggtcatgcagctataaagttgtgaaattgggattcaaactcaggcagtctgtccccacagtccatgttcttaacccaccatgctctcctgacacttgaaaagttaggaggcgtactccatagcctgtaatgttgctgcagagagaatctaattttaaatccagtgaagcatattagttgctgtctttgatatgccattcagattgtgctatccttatgatgcctaccttggttgtatatgtaactgggcgtcaaatatataaatactcaaaaagtgataggtgccaataaaatattttatagttaatacttatgtaatctgtgttctctgtgtttgagggctggttctaaaatactgctctatatttgacttctggttaaaacaataaactttgctcatattagttatatagttgataccattctcatgttgctaacatgtctgtaagtaacagttgaaattgatctggcaattttagagctgtcagacccaggagatgagagaaacatttaaaatgtttataacattaaatcagctgagtcaagagagagaaagagaaagatgattcagatttcttgtactggtggatgtaagtgcttggaactgaaataaaggagaaggtgtagggagggagaaagataaagaagtcttccctttatacaagttgaaattgagttttctttgagatatagaggtgaagacattttaagaaacttcttaaaactctctaatgtggcttttcaacctgtttccatcaatttggcacatctcacttttcggcacaacagaatattctaggtttatctcacaccttccttgccccagcccaggaatcagccatttctctaagaaactcttgtttattttggtggggaacagtattgggaaaccaacatctgggagctaaatatactcctagtggttaggaggtcataccttgtagactcttgtagctgacggagttaggacatatttattagaaatcataagtttatattgatcttgctaggatctatccaatcctacaagattcttccctgtgtctctcctttgtatttgtgtatcctttcttccatattaagaactgtggctcccaacaacaaggcatgtgcccatttgcccaatcgtatgatgtataaaaactactttgagaaaagtggcagccaaaccactaagaaaaataaacttgctgaaatgagttcaagatttattggcagctctttttttggcccctagactgaaagtatatatttcaagtattgtgttcaaaaattatttgggttagctttttccacctttcataatagtaatattatttacttgaaatacagttggctttgtttctatattcagtttttttctctctatcttcattaatttcattatatatatttaatatgtaggacattaacatgtttccaaaagaagaaaacactccttcctgtatcatttccacctcatctctcttaccccttataggtaaccaattgcactggtttctagtttatcttacttatattcctatttgaaaagttacctcatatatgtatgttttttaaatttttatacttttttacacagaaagtaacgttcagtatgtactttgccactttccttttaaacttaacagcgtatactggaaatcactccatatcgtgtcacagagagcttccttatattttttaatagctgtataagacttcattgtgttgtctgtaccatattttattcacttccccatgtgtggacattttgactgtttctagtatctgcaattactaataatgctgcagtaaactttgtgcatatcgtaccttggtaaatttctagacatagatttctgggttaaaggttaagcacatgtgtagttttgttagatattgataaattcctttccatggggtttatatcatttttaaaatatttaccagcaacgtataacagcgtccattacttcaaagcctcaccaacagattgtatgttttaagtacttttatgttttagaatttttccaatgcgataggtaaacaatggtatatcaatatagttttaatacattaaagttcagcatcttttcaagttcggctagtctcagggctattcttaatatcttgtgaattatcttcatattattttcccatattccataatacttttggttttttttcctcctcaattctgacaagttctttatatttcaggaatattagccattttatttgatatgttacaaatatttttctcccaatatataacttttctcttataacgatttttttttcatgaaaagtttttaattaaaaccttttatgggcccaggtgcagtggctcacacctgtaattccagcactttggaaggctgaggtgggcagctcatttaaggccaggagttccagaccagcctgaccaacacagtgaaaccctgtctctactaaaaatagaagaacattagctgggcttggtggcacatgcttgtgatcccagctactcaggaggctgaggcatgagaatcacttgaacccagcaggtggaggttgcagtgagtcaagatcgtgccactgcactccagagtgggcaacagagtgagactctgtctcaaaattaaataaatatataaacaaaaccattatgggccaggtgcagtggctcattcctgtaatctcagcactatgggaggtcaaggtggttgaatcatttgcgccaaggaactggacagaccagcctgggcaacatgggaaaaacctctctctaccaaaaaagaaaaaaaaaaaaattagctgggtgtggtagcatgcaccagtagtcccagttactcgggctggtcacatgagcctggggaggtcaaggctgcagtgagcagtgattgtgccattgcactccagcctaggcaacagagtgagaccatttctctaaatacatacatacatacataccttttgtggagttaaatttacacactttttctttattggctctggcttttgcattgtagtaagactttctttacactcaacttatagataaattcacccatgttttcttctagtacttgcatagttgaattttagatctctagtccatttggagtttattttttgtatggtagaaggtattgatcctattttttcccaaatagttgttacccagttgtcccaaaacaagttattgaaaagtccatctttgtcccagatagactggaacaaaatgaattaaagacttaaatatgaagatttttacttgtgtatcctttcttcctagaaagaaaacataggcgtaaagcttcatgacgttgaatacttcatgccattggtctggcaataatattactattatgaaaggtggaaaaagctaacccaagtaacttttgaacacagtacttgaaatatatactttcagtctaggggccaaaaaaagagctgccaataaatcttgaactcatttcagcaagtttacttttcttagtggtttggctgccacttttctgaaagtagtttttatacatcatacaattgggcaaatgggcagatgccttgttgttgggagccacagttcttaatatggtagaaaggatacaccaatagaaatatttatatttaagtctggcaatcatttttaagatgtgaacttgaacaggcaacaaaagcaaaaataggtacgttggattacatcaaacccaaaagctcttcacagcaaagggaacagtcagttgagtgaagagacaacctatggaatgggagaaaatatttctaagccacacatctgacagagggttaatatccaaggtatataaagaactgcaacaactcaatagcaagaaaacaaataacatgaataaaaaatgagcaaaggatctgaatagacatttctcgaaagaagacataccaatggacaacatgaaaaaatactcagcatcactaacaatcagggaaatgcaaattaaaaccacagtgagatatcgcctcacacttgttagaatggctgttatcagaaagataaaagataagtattggtggggtgtggagaaaaaggaactctagcccactgttagtgacagtgtaaattagtatagctgtgatggaaaagagaatggaggttcctcaaacagtttaaagtagaactaccatatgatccagcaattccacgactgggaatatatccaaaggaaatcagtatattgaagagaactgtattttagtgattattgcagcattgttcccaatagccaagataagggatcaatctgagtatctatcaatggacaagtgataaagaaaatatggtgtgtatacacaatgggataccattcagcctttgaagagaaggaaatcctgtcatttgccacaacgtggttgaacctggaggacattagctgagtgtaataagccagccaccaaaagaaaaataccacatgatctttcctatatgtggaattttaaaagttgaactcaaggaagtagaatagaatggtagtgaccaggggtatgcgataggctgagggatcaaggagatgttggtcacgggatacaggatttcagttagataggaggaagaagttcaagaggtctattgtataccatggtgagtatagttaattataaagtatacttgaaaattgttaagagtagattttctgttcataccacaaaatgataagtatgtgagataatgcatatgtaaattggctcaatttagccatttcacaatgtatatatatttcaaaacaacatgatgtacatgataaatatacagtttatttttaattaaaaattttaaactctctaattggtcttcaacatatagtacacaagtcttttcacgactctttataatggaacatatgttcttggaatgctaaaaattattttttttggaggccctgcaaataactaaaaatttatcttaaaagccacacctaattacttacatatgatccagaaaggatactttgaaaaagctttttaattgataaaatcattaaggtaaaacatattcataaaagtgttctctaataattttataattttctagttcatgaaggattaaatatacaactatcatttgaattggattttttatgaggttaattgtatttaaatgctaattattttaactaattttgtggttgacttctatgtagagtagggaaaaagaatttcctaaagccagttacgtatatctctttttagtctggatttttaattaggaaaagtgatatagttaaataggtctactctatagcatcttctaaaatgagtaaaaattcattatatcaggataaaaaatgataaagatatatggatgacacatttggctgaatttttcttcttcgctgttctcttgctctctatttaaatagtcttagctcttttatcatttaaattctgaagtattgaggtgattattccggcagcaggtgattctgctaattactgttcagtcagttttagctattagaaacagagatatgtttacattgctgggctgcatgtaaatttagaagttacatggctttgtttttactttgacttacggcattaaaattattttcatctgtgtatgtaaagatctgcatctataagcttttgtggataataaggtgaaattgatgcattttaatataaattgccaatataaaatatctctaactcagacctctactggaaagttgtcaaatcttatgtaggaaaggcttttaccatcactgttacacattaactgggcatagtttaatattaatagctcctgagacttgtggttaactgaggtttctatttcctgtgtttgggttttatctttgcaacaacttggttgcttttctgtgtaaaatagtggtgaatatacacaagagtatgacaaggttctgggctcttaactttgatgaacaccatgccatttccatcatgctgcactcaaaacagcacagatgtgagtctgggagtggcgtccctgccgctctcatgagcctttgtttggagaacaccctgattaacccccacccttcacggttcattgactcactgatagatcaagtttaaactagtatatattagcacatttgttaccaacagaggaacagttggccattctgttttacattgctggttcattgcaaactggcgtgctaaaaaggtctgtactctagagtatgaattgggaagttaccaaaggactgagaaccaagtcagttgcatattaatgttgaattatacctatattttaatcttggattgtctacttgggggatgcttacactgttgtcaagttatgaataagtgataattaccactttgaaattcatctttttttttcaaggagtttaggggatttaggtgtctcaatatagctttcatattaaacagtttgtcataattggatgagagcagagcaaggtcatgactacctgatgccttgtgttggagcattttaaaaatgttttccagagagttatttgtacctaatgactttacataagtccttacattatactttatttctaggtcacctaaaaatgttaattgtttagtcaagagggttaggatgtgtgtctgttttctcatgaaaaaaattaagctgttccctttttatcaattttcttgcaatctaaaggcttttttttcttaccttcctaacctagtgactaaggtcatcttattgttacagttcctttcatgggagataggtttactgcatcatttggcagtttcatagggtgaattttgtcttggcttcatctttccttactggttgtcatcccctgggccacctgcttttttgcattttcctttctcttgtgagatgatgaagctctgtgccccgatggggatgagagacagcactctgagttcaagtctaggataaggcaatgggcttgcttttcaaaacaaactagtgtcatacgggctgctgctttcaggtccactgtctgattttatcactgatgacttgtttctggaaggcaaactgatttaagttctgagcaaaagggtcggtgtttattttcaatgctactattaatttagagttttaatttagaaaagattttttaccagttctcaaatatgatttttctattgactttaagtttgtagatataaggagtagacatgagatagagactgaattgcttttttgtttttaaaacttggcagtaataaggggttgcttgttttttcatgctaaatattttttctaagggatctagatacctatcagaaaacttaactttgataactctggttctttattaagtatttttgtcttattttaggaattaatagaaatagttgtaattttagacttcctttataaaataccaatttaaagagaagctttttgcttaaatgattgttttgcagtgttgtgcttttgttttctttaatgcagttgaaatcgcagctttataacttattttttaatttggggtttttaaaagaatattagttatttatttatatttattgggcacctactgtgtgccagacactattctaggaactagtaaacatagcagagagcagaatcatgaagttcttgacctcaaggagcttaaatcctagtggtagagggggaattcaaaaaaatcaaataaatgtatttctattatgtcaagtgatggtatgtactaccaggcaatcagatgaaaatatttcctcttctatacacagtgggcaaggaaggcttcattgactgtggagttttagaagaaagctgaaagtaatggggaaagagagccatatcgatatatgaaggaaaacatggtccaagcagaggaaacgaaaagtgcaaagaattgagcaagaaagtcatgttcaagtggagtcagcaggggaaagagtaggtcacaaatgcggctgagggtgggtcatgaagggccttacaagctttgtatgagtttttacttttattctgaaaaaaacaaaaacaaaaacaaaaaaaaccggggagctatttggggattttaatagaaaagtaacataatttccttttaaaatggatatgtggccactaagtggagagagtggtgtatatatgagtggatggaataattgatacaggcaagcaggagacaggttaaatgaaaaatggattaatccaggcaaaagatggtgacttaaattaagctgggagtgggagagatggtgagacatgcttagactttggattcatttttccagatagaactggctgacagagacatgtcatttaccaacatagacatggcagattttttttttcttttctgagacaaggtcttgctctgttgtccaggctggagtgcaatggtgtgaccatagctcatggaagcctcagactcttgatatcaagtgatcctcccacctcaacctccctagtagttgagattacaggcatatgccactgtatccagccaactttttttttttctgtagagacaatatctctctgtgttgcctagggtagcctttaactcctggcctcaagcattcctcctacctcagcctctcaaagtgctgggattataggagtgagccaccatgcctggccaatatggcggttattaagaggataagtcaaagattacatgaatattctgttatgaaaagtgtcaaacatatagaaaatataaacagtattccagtgggcacccatatttttatcaccttgattctacagatcttaacatttttctgtatctgcttcaaacattttattctgccaatgtgttctaaagtaaattgttgatattgtgatagttctctccaaaatgctgcagtgtgtagctctaaaaatagatatttttcagataaccaaatatcattaacctgccaaatcaatgaatgataattgcttattaacatttaatacttggtccatagtcaaattctccatattttccataatgtcttttatagttaacttttaccaactagtgtctgatcaagaatcattcatttaactaattacatttaaactgtaacattacaacatgttttttcgtatgttttattctctctgacattgacttatggaagagactagattatttgtcctgtagacattttatcatacataagagttactaggagagctctgattactagtccccactctcagaaattttgattcagttgctctttccagtgagctgctggtgatgctggactttcattctgaagaccatactttgagcactactgctgtaccactatccgatggcttctttgtgatatcgtttaacttgttgttctgttgcctgtatttcctctaaactgaattttcaatctaaaggcttactgagattcatgtttgatactttgggcaagaatacttcataagttctagtgcttaatgttaggtagcacttaattctgactatttcactattcatgaggctaagctaaggaggtgacagcctgatccttctattgtaatgtttcatgtgaaactactagataatttgttgagttggggggtgggtagggaagagatatctagttttcaataaatatttcacctaatggttttaacacacattgatcatccttgcctgaactaattatttaattagggatggcaacatggagactttctaattcaatctttttttttttttctaaatgaatggccttgtttttatttttaaatggatgttacttcgcaactggggttatttgattacccagaaatatagcgcatattaaaaaggtaggataaatgcttagttaactaattaagcaatttttaattaccagttttcacagtaaggcactaaagtttctgacttgagcaaagataaagtggaaagataaagtggtcgtttagtgagatgggcaagactgtggataggtagactaggtttggtgggaaagtcagaatatcagttttgaatatgttaagtttgagatgtctattagaaacatatgttgacgaggccaggtgcaatggctcatgcctgtaatctcagtactttaggaggctgaggtgggcggatcacctgaagtcaggagttcaagacgagcctggccaacatgtgaaaccctgtgtttactaaaaatacaaaaattagctgggcttggtggcatgcacctgtaatcccagtaatcccagctacttgggaggctgaggcgggagaatcacttgaacccagggggcggaggttggagtgagccaagatcccgccagccactgcacttcagcctgggtgacagagcgagactccatctcaaaaaaaaaaaacatatatatatatatatatatgttgacaatatttcagttgaataaaataaaatattctagctattttaggtagaaaggcattttataccgatactactactaaagggtaagaagatatgactgtagtacattaaatatgctgatggcctacaactgttgctgtgttgctttttcctcttcaccacacatatgcagcctcatgaaacattttccatgaccagcacactgaaggaaataaaaggaacctagtttagagatggttctgcatgatacaacaaaaatgagctgctaaagcattacaatcccactcaagagtattcccccatcaaatagtggggctggtattttaatcagttgatactaattgtcaaggtgtgatggccaagggattgatgtttatcagtgtatggacagtggttcagagtttggtgaattagtcgagttgaaagagaaagattggtgacaaagatgtatgaggtggaaagtatactttcacagaataagaacagaaaatgagatttatgtttttttgtaaacgttcaacaaagaaaattcattcagaggaggaaataggtaggcaagatgccctattctacagatgttagtcagcatcactgcaaagcaacctcagggcttatgcagtggacacttaaaatagcactggtgcagggatgggagaaataaatggatttaataagcactgctgcttaccaaggttgattgaattgccactattgccaagtgttctacctgcaaacagatcaaccttgagccctggatatggcaccatgtcccagagcaaccagccagccacctggtggcaggttgattgcattggatttgctccattatggaaggtcagtggtttgtcactgctgcgatgaatgcttactgtacgtttggatttgcattccctgcccaccatgtttctgtcagcaataacatggccttattaaagccttattcaataatatgacatcctatataatattgcttttgatcaggagactcattcacatcaaaataagtgaggcaattggctgtcaactacaggattcactggtcttaccatgttcctgttgtagcatattgtattctacctggaagatgaaaccttgtgacattaaagtagtttttagttccataaacataatacaggggtctatgaatcaagaagtggaggtagaagtgttgtcttttacttcacatctaatcacatgttcaaaatattttttcatcttgcctctgcaactttgaactttgctgacacactgaggttttagtgtgaggaaacaatactttcacatgggaacatgatagtcgttcaattgaactggacatttagaataacctggccacattactgaactgtataactgaaacaacaaatgaaaaaaatgaagatgctacgctggcaaagatgattaattttgattattgggagaaatagtattgctactgttaggaggaagactatatgtctagaaactaggaggaaacctgggttgcctccttgtagcagggtaaaatgagtgagtaccttgtctaagaaagggaacatgaccaaactgaacccagaagacataggaaatctaaacagatcaattaacaccaaagaaacgggcattttttggtacttctaaaaaagtaccagactgatattttcacagagatgttcgttatacccttaaggaacaggaacagaaaacttctatactatttaaactattttagaggatagaaaaggaaagaaaactccagattttatttatagaacttgcatgaaattgataccaaattctgacaatgcaagttcaaaaaggaaaactagagatcagtgttacttatgtcaaacagctcttaatagaatagatggatatggttatcaacatgataaatatgtttatcacattttaaagcctacatggagaaacatttgaggttttcttattctagaactgacaggaatgtcctttattatgagcactattagtcaaatttttctggtggaactaatgtaagtagactgctgaagaaaatgaatggtatgaacattggaaaggggaaattaaatgattattatttacagataaaataattgttaagctggaaaatccaagtgaataaagggaaggcctacaattaagcagttaaggaaagggctaggtatagaaatcaatagttttgatatatgcaggctatagccagttaggagatcagttaggggaaaaacacgttgacagcagcaacgaaaagctgataaacctagaattgttcaccacttatcttaaaatgtttaacatggtactgagggacacaggagattatttatgtggaaaaacataccatgtttctatacagaaaaattgaacatcacaaaagtattatttgatcttaagataatttatatttaatgcaatctcagtgaaataccaggagaatgtttttaagctagacaaacttatttcaaagatcatatgtaaaaataagcaaaaatagatgtgaaaaattctttaaagtaatgagagaccagtcttattgactattaagtcattataaaactataatgtttaaaagatggtactgacatatgaatagatcagtggatctcagatgggcagtgcagaaagagatccaaacacatacaaaaatttagtacctctaaaggtggcatttaaaatctgtggggaaagatggattttccaatgaataatgttgggataggtagatagccatctggaaaaaatgaaagtcaaatcccaactttttaccttttatcaaaatgaacttcagatacaattgaaaatataaaattgagaccataaaagtattagaagaaaaatgcagtttttaagtctcaaaaggggactcttaaatatcatacaaagcccagaggccataaaagagatgattgataaattcaaatataggtccgtgtaagcgaaaactttcagtatggagaaaacataagttattaaggcaaatgacacactaggaaaagcatttgtaactcataacaagcctagttttcttactgtgtaaagtactgccataattgacaaagaaaatatgaagaattggcaagtgacatacatagaaagttcatggaaaaaataactcttaaacatttacaaaattttacaacctctcatgaaaagagaaatggaaattgaaattagagtcacatacagtatttcacttttcatttgtcaaagatcaaaaagtttgaacatactgtgggtttatgtttataaggatgtaagaaaacaggcaatctaaattccttgtagagtgtaaattggtagtaataagagaaaaatttactgaatactttgtgccaggtgcttttctaagcactttacatttaattatctcaattaacttatccagaaagtaccattatttctgtattacacgtgaggaatttgaagaaaagttagacaagtaattcaaagtcacacagttaataaatgacagagtgaagatttgagaccatttcctttttctcaagtgtccacttttggtcgcaactctgctgtttctgtagtgagtgatttaacactatatgataaaaccttaagagtacgtactctttgatccagtgattctacttccagaagtttgtccattttgcatcaaatagatggagaatagcattcattgcattgttatttgcagtaaaggaagattggaaacaacctgaacatttatcctcaaggactcatccatacaaaagaattgaagtaaattcatccagatgaatatgaggcagctttagatagagtgagatggcatcctatgtagtgatatggagtcatctttaaaatacagtaaaaggaaaaagcaagatacagaatagcatgtagggaagctgctgtctatgtgaaaagctgtagaatatacgtgcatttttgtatatgcatagaatattcctagacaaggacaaacatggtggttcatacctgtaatcctagcactttgggagactgaggcaggtgattcacttgactccaagttcaggatgagcctggccaacatggcaaaaccccatctctagaaaaaatataaaaattagctgggtctggtggtgtatgcctgtggtcccagctacttgggaggctgaggcaagaggattgcttgagcctgggaggcaaaggttgtagtgagccaagatcatgccactgcactccagcttgggtgacagagcaagacaccattcatctctctatctcttttctctctctctctttctctgtctacacacatacacatacccccccacacacatatatatacacacatatatgtgtgtgtgtatatatatgtgtgtatatatatacgtgtgtgtatatatatgcgtgtatatagatacatttctagaaggattctcaaagtgatatcagtgattgttgtgcaagaaggaaactagatatcagtgaatgcgctaaataaggtgattttgaattctgtagcatgtgtatgatttacctatagagaaagcagtctagcatgagcgtgggtttctcaaatatagaatgtttgcagtgaggtcacttggtgaaaagtatagccatgtcagacagatgtaggttcagattccaggacttccaggactgctgaaagggaaaggggctttggatctccttcagctccaggcagcattgctcctttcccagctttgacattagctggagggaagacaagttcttagagctctatgtgcttgggacaagaccccttccccctactgccttactcgccaaccataactgctgcaaacaattcttacctcttccaccccatgtcactgcctaaaacccttcatcacctggcctcccatgcctctaagtctctgtacatcccctagcctgatactgtccccaaccctcctcaactccagacaccattttactctaccctctggaattgtccattattagcaaaatctcctttattttcaacctcctttctaagtatttcccccacattcttgttgtaatagagacacagctttcccaggactgtatagctttccttgcagtcctctaaagtggtaactggtttctctgccatacatttcataccactggtcctggagatattgtcaatatcttaatgtcttccttccatctcacttaaattttgagaccataattcctttttcctctcttaaaagttctcagtgttgaagctcaatccattagatacctctagctggcactactagttgcagtcctgtgcagactactgagtcattttctttactccctgaagacttaaactctatcttactctcactctctctgacattactcctattaaaatgttatgtttctttagctattctttcagtttttggtctcctctccttcaacgaggatgatttctagaatgttggttctcaaaatgtggcccctttgcagacatcgtcagcacctgggaacctgttataaatatgaatctgcagaccacaccccagactactaagcccaaaattctgggggctggagcccagaatctatgttttaagaagcacgtcaggtaattctgatgaatatgccagttccttagatcttgttattgtcattactgacaactttctctgagaccacaatttgaatctaccaatttttcactagtactcacccatcttaagtccttactttccccttaccagccagacatttgaatattccttgactcttctctttcacatactatatccaaagagtcaacaaatgctgtcagctataccttcaaaatacatgtagaatctaacttttaacctccactgcagtcacttcagtccaagcacaaccatttcccacctggagtattgcaactgttcttgtttggtggcccttggccctactttatctactttccgcaaagcagccagagtgtttctttcaacacctaaggttatatggcttcattgattgaaattcaccgtgcttcacctctttctctacaaaagccaaagtccttgtaaatgcctgtaaggctcgagggtgatctgaccttccctggcctgtcgtgtttcggtaaaagtaagctgagtctttcatagttaaaggacagcaatattgtcctgcatgatattttaaaaacccaatcaagaatcacacattgcatttaattttcatgcctttagtctccattaaaagtgtgccctttgtattaataattggagtgatgagggacagagtttaagaatatataaatattttgtccccaactgactgtcactggatggctttggcacccattggtgattcttacctgaatcagtaattattgtgatgactgaaaatagtgatttttctcactgtataattcttctatatttattaattaccttaatattatcctatagaacagaatgttcccttctcatcttttgtttgtttagtgtcagtattactcatgaagttgggtgtttagaaaattcaatgttgtataatactgttattattcaatattgtattttctcagtttgagtcttccatctgcgtcctttcatgtaaatagtataaagatcagtaatagaggaacatagagtaaagtgtgagcagagaagccttactctgagacaaacttcagagaggtgaactctgttgctgattaagaaaggcttcactgaggaagtgttgtttgaagtgagctttgaaaagtcataaaattttgacaaaagtggggatggggtggagcttaaaggaaaaactgtctgaacaaaggaaggcccggcagactaggaatttggcaataatacagtggttttggaccttgatgaggaagttgaaatggaacataaaaaccctctgcatttagctccatttatttgctcaggcagctctcactgcctaaaattttcacccctgctgttttgctcaggggtgggatgaggggtaatgagggaggaaattttagggggtgaaaacagcacaagccaaaaaccctgctcagatactcccttctcttgaagccttttccagatccctaataagaattaaccaccctctctcacacactctgttgtactttgtccttctctgttaaccagcctctgtgttttgtgctgtctgtatttgtggatacatcttcctcctttaaagcacgaatcatatcttaatcccttggcccttcttcccagtacttagcacaagtgctcaatacatgtttctttaacgcgtgtaacagaggaaggcgaggagagtgagtgggattgggagcaggaggattctgaatgtcattttaaggggtttgggctcgctcttcaggcagcaatgagccatagccgcctttgaactgtgcagcactgaccagagctgtgatgccaaaggatgcagtggaaggggaggacagccagcatgcctgggcatggtccccaagtcagaggacatcagtgggagaagggagaaggcatggaagcaagtggctaccatcttatgaatctgagcactcattcaaaggtggcaaggaaaaaggaaggcattgagcacggttttgaggtttccagcctgggtgattggaggctgatgcaggcttcttaccaaaaagggccctaggcagtttcaccaggaatgtttaaggagtttatcatgaccctatctcttcctcgtctaaaactctccctaaaatcaaaacagtatgtcctgttgaaatactttattgtatcaaatataatgagaagtaaaatattctctctacttgatgtatgaaacactgacttcttgtagtggacaattttcacttgtctttttagtaatggtttttattaaaaatagatgttaataactgcttgtttaatctttaaacgtggccctctgagagcagcttaccgtaaaagaaacggttgtcagctttctttttgctcctcagtccctcctgccccttcctaacaacagaaaatttgctttgcacctgctccaactgggttcgaagagataagcatcttgcaagcccagaaaattgtagtatcaaatctcagccccaactgtgaggcagcactatcattgaatccctgctgagaggcgttgctttcccaattcccaaaagagttctttctcccctggccccttttcaggcttgaactctgaccgaaaccctctttttaactcccagcatgcactgcacttggtactgacactgacccatccctgcttcctctgttctgcactggactcatcagtaggtcaggcgttggtagccctggggtcactggggtgcccaattccaataatgagcacatttagctaaggagaggaaatgtacccttctatttgttacagtccattgctttttttccagaaacaaatgctaaaagaacatttgatatattgtggtttggtaaatacacatagcactgcctaatattcacaaagttgcctcttttttttgcatcttccttcataaattaaatatattgttctaactcatgatttattttaagagggatatacctatttcacagctaggaaaatgttttcaaataaagttatattcagaatactcttgcaagaatttcaaataaaaatagcaaatactatttaaatgcatataacattctaacagacttgtgtgtcattttaaagggaaagaaaaaaaatgatgacaaggactttacaactttgtctttaaaatttcttcttaggctttccaaacagaccgaagtcattaaaaatactccttaacccccaaagtcacaaaaaagaagctacccaggtttattatgagaaggttgaacctctgttgaagcttgcaggaataaaaactgatgtaacaagtaagtaattttcagaatataatttcaccatctacaaaaacatacaaaagcaaaataatctgaatttgtccttaatgcaaacttgggaaactacttgtaatatctatagcatttttacgtcttcataacctactgcagccagctcgagggttataatttaattatttttgttatttttattagaatattaatattttctctttagaattttttcagatattttttcagacttaaacaattgttagatataattacaaaggaagctgtatacttgtttacatcttcatggagatgtttgctacttacacgttaattttgcagttaggcaagaaattgattttttgctcacttatatagttgatgtctttccatggaattcttccttgggttgttttcgttctgactctgacccctggtggttaggtcaaaactaagcactgaactgctggttttattaatagatgaatttagagatgctagaagcttaaatttgttgtctaaactaagaaatgtacttaggtttgtgccaaggaaaatagaaacttgttaatgctaaacttaatagatgattagtaatatcctttttgatttttttaatttggtagtcacatttctttgtttctttgagacttattttcgtatggtggggaactgagtagaagagtcgatgctatggagaatcgcaaccttcctagctttatttctatgtggcttcgctaacagtggaaatttgcaataaattttaattgatgaaaagtattataaaataagcctactcaggggacaagcccagagtgcaattggaacttcctagtcccagttatagattcctagggaagggattcacagtgatgtggctttactcagctgtaaacaaaggagataagtttcaagatgttaataatatcattgaaacctacacctagtgatctgatggattgaggtagaagaaagttcaaaaaaaaaaaaaaagcaagttttgtaggaaggtcagcccccatgaaatgtgcctataactatagaggttcgagagaaactaccatgaaaaactcaagaggaatttttgaattaaaataaagttatagtgaagaagttaacctttatgtttgtgaccttcggcttatttagaggtgatttacaagtaaaagagaaaattcagatttatgttttctttctactgaagatttccaaagattggctgaaggaaaagtttgagatttgtattagggtgagacaattaaaagttgaataaacatattggcatactcaatgactattttgttcattgcttttacatgtgaatactacaaagcagcttaacatggatattgctatatagcattcacttcaggaatctcattgtatgcttgctctgtgttcaacatagtgcaggatgcgagatgaataagctatcatacttggatgactttctacattattagagattcaaaaaaatgcttaaaaccattataactggggtatacataaaagaactttgatgtctcagaggtgatattttgatcggaagattcaagaaaagcatttgaactaggcagtttttaagaggcagacaaaaaatgagggaaggaagtcaggctaacaggcatgtactgtaaaagttgggagggggggcggagagagagagtgtgtgtatgtgagagagtccatgtgtgttacacccatacatctggagagtttgtgccataactttgctctactttcctcagtttttacattatctgaaatcttactctatcatcataaaatagctgccagtgaatttcatcctttcttattaatatccagtgggatggggagaggtgtgcatatgtgtgcaagagagacccaacatgctttaatcctgaagatgaattaaaatttccttttttaagtttgggcacagatactgtattagcgcagtcaatctggaataatcatttatttaaccatcaagactcttcccaggggctgaggacagatccccttttcctgatgactgaaatgcctcagctgaatctggattctgttagggagaagaaagggcaaaatgacttctaggaaggctctcaacaatgtatactacaggaggtataattccaggttatggatggatccttaagctgcactcagcagtttactcatcgtgtattgatccacagttggtgtaaatttttttttatcatactgttgcaatctggtttggcaaagatgactccaccagcagaattaaaattaaaaaggaagagagaaaaagagattggagacaagaaaactgatatacaaggcctgaactaaggcagaggaaatcatctaaatgtgctttccttcttaattgtattggagacaaaactattatgttctaggatttttttctctaaatttgtaaatattactaagtaccatatttaaacataaaacaatagaatattccgtaaagcaaatttagaatttacttacatttgtgcagaatggctaattattagctgcctaacactcctcctacaggcaaatttataaaattacatcatttgcttataaaaccattttagtatgcatattggctcaatatttatgaaaaatatttcttgaataaacctgtgaatatttgaaaagttttagtcttcctgcctatcttacagtgttatttttgtagttgaaataatatatttgaaactttgtatattatactacagaaaggtggtcataatactgttagtttcagtttcaaaaattatgtcatagtaagatcgaattcgtactttatttgaaagtatatggaagagtaaagcagaaagaggacatatcttctgcatgtccagtgggacattgttttaatgtatccttgtgtgaatgggtgagtccaaatggaattggaattacaaaataaaccctatatgatgagttaattaggaaatagtgctatataaatatgaagtataatatgaagaattacagctagatatatacactataaggtactgtaattttttcataaatttattttaaaaatggatcttaccacattaataaaaacacacttctttcattttgggttgtgctgaaatcctaactacttctgaatatagatcagcatcttttgaaatatttgtgctaaagttgcatccccactctgctaccaccaccaaggtagtatcttatctaatagcatcagaaaaacttccgggagaacctggaaagaattattttttcctaattacctattcgtacacaaatcaaagaagagtatgaacgataagcccatgctggcatatgatatcatttctcttgcttctgaaacaaagcaagttttagagattgtaccattaaaggtgtgacagatattttgaggatcagagatccataggataattcatagtacaatagagtgaaaaagttaaggcagcagagaaatcagactgaaaagaactttcgaggccatatggttcaatttttctccttgtgggtggagcacaggtgtgtggcactcaactttggcttggccacctacactagaggcagagtacgttgttactggacaatactgtttgacattcttatgaatgttcagagttactgtacctttgggcagattagaaaaggcacctcctctgtgctgacttacaaaaaggtgccctttcttccagactaattcatcctttgcttataaaaccatttcagtatgcatattggctcaatatttatgaaaaaaatatttcatactttcaaaatattcatatttcaaaaatattcagcccaaggtcactagattcagcctaaagtcatttgttagattgcaaatccgtcattcccgttagccaagtacctttgtgctaggcataaactgtacaaaatgagaacttgtcagctgacattcgcctctttgtaatttttatgtactagagttaatgttatctcttgtagtaatatgaaataaatgtgccccatctattgtataggagtcattgagatatttgaagagagatatcctgtctgcccctcatctcttgttcacgataggtacttccatcgccttcagttactttttgcattaacagagctgctagaccttatcatggtcattatcattatcatactcaaagacatttatctgaaggaaaccttgatctctgccagctcagggctcttgggagtgcctagtcaccagataattttacctcctgggcagagttgtcaagaaagtggtgtttgttatcattttccccttctttctcctaaaatcacgcttctaacatggctgttaacaagcctcttcatagtgtttctctggttgtttatggctctacttgaagccttccatttcttggaaatgcctcttgcctttctaaatctcacccagcagaaagctaggccatctaatgaaactgtgtcacaaaagattccagtagcctgaggcatcactccttccaattttacctgcattttaatacaaaatctgaaaagtaaatgttcatgcatcatatctagctagagagaaagataattctgtgtaaaagattctttttgttacctcttaaataattgtgggtgtatatggccagtcctgttcccagcattcagatgtgagttaggaagttggaactttatacctggggacgatgaagactcactaatggggtatatacaaaaaagtgatatgattaaatatgtatctgaaaatggttattctggctagagtgggggagaggtttgagggagacaagataaaaggctattgtagtacaggtggagtatcccttatctgaaaggcttgggaccagaactgttacagatttaggatgtttttagcttttggaatatttgcattatacttaaccacttcagcatctctctaatttgaaaatcatggacacaggaaggggaatatcacactctggggacagttgtggggtggtgggaggggggagggatagcatcgggagatatacctaatgctagatgacgagttagtgggtgcagcgcaccagcatggcacatgtatacatatgtaactaacctgcacaatgtgcacatgtaccctaaaacttaaaagtataataaaaaaaaattaaaaaaaaaaaaaaagaaaatactccaatgagcatttactttgaacgccatgtcattgctccaaaatttttagatgttgaagcgttttggattttagatattctggttacagatacttaacttgtctacacatgaaagatatttagtgatcagatcaatcagctaatttagggaattagctgggagaaatggaggaatgctatggcataatttaaagacagaaacaactggccttggccatggagtggttctggagagtggaggaaagggacactctagaaagaagtcattttcctgtcttggggtagatgatggaacacaaaaagaacaatatatttgagagagaatatatttgaaggtatacataatggattctgttttgagcttactaactttaaagtacctacaggacaggaaagaaaatgacatttcagtatcatatcccacactagaattttatcaccaaaccaagaaatgtttccttatgtccaaatcaaatctcacctgattttatttcaggtgattttctcatcaacattgaatatcaaccttaagactttcttgtcttcctgaggaagttgcatttgcaccaaagaggggagggggaaattcccagcagtgagaattgtgttcaaagacctgtaaactgtgaaggcttcacatctcctatttagaaagagcacaggttggcaatctcataggaaaaggcaaatagatgaaagaagaggctgggttacattttttgaaattacatttatctagcaatcctttctttgtttgtttgtagggggatgatttgaatctggctgtcactgattccagggcccacaatagcctgtctaaatacatatttggtcctttctactatatttaaatagtaatccagatcactctttatccttttgcctaacattgttttgtataaccacctattacttcatattataattcattatttcattagcatatattgtctatctccagaatgcaaattcctgaggccaaagactaattcattttgttcattttgctaatatattttatagatgtagatagtcaggttcttttcattttgtttctttgttctagatctttgattttattggacttttgcaatgttacttaaaaaattgctattttcaggcaggttgcattagtgtataatcaaattccacccacaatatcaaaaaaagactattacaaattaaaaaaataaaaatagcattcaataataacacagttctaaagctcattattggatctgaaaaactttaccaatgtaagctttggtataaaagtaaggcttggtgaactgattcttagcataaatattttttcatgatattcttatttttaatgtgtatatgtaagatgttttattttgcattttaaggttgtaagtacttgctgtagttataaatgaatgatcagcacacatcttctttgataacctttcaactttattaatattaatgtttcatatgtagttttattatggctttcttctgattggaatttaatatagagaggttttattcatgtgagtgttaatggcattttgaataagctatgggagaattacaatgtaacactgctggatacagaatgattcttttagacaccaagactaataatttttaacaatatcgaaaaacattgtaggaaaagcttgaaccatgctggcaccagggacagacaagcatgaaagattaatgtaatcttgcatataatgacacacattcttacacaaaaaatccatctgcaatgtcatgtcagtcagcagaaatctttgatgggtggatacagctgggctgtctcttctggcagagctgccctggaaaatgctaaatgtggttgtgatgcttggtgccatctgcagtgtgcccgtttatcctgtcttcactggcatttacgatactgcatagggcatcagtgactgtggagacagcgatacagagtgacagattcatttcctcggagggtctgagctctggtgggcctgtgtgccaccctccttcttgggtctgggtctcttataattggtgttggctttactttgtattttcacatccaactcttcctctttttagtctaacagttccagtacacattcttctggtttgtaaatcttacactaaccttttgactaatttattcatgtaaggttgccaaaccgatttaagattgactgttcaatgccagctaatatgccttatttccaaaatactgctcctcctaagcctctgatttaaaggacatgtgtcttatttagggaatactaaacaggcaccaggacaaattgggtaaccactatgcgtgggatattcccaaatgactttatgtagttgaaacaaatatatgaccttctcttacataaagctataaaacatcaggccagtaacacttagtcctcttgcccatgattaaaatataaatattcaagaataaatgctgttttatgacttgaccatatgtttatcatattattttgccagaacaagttaaaaagtgtgatcattgtttaaaactgtcactttgtgtatgtgtgtgtgtttttttaatagtaatggaatatgaagggcacgctctgtcactgcttaaggaatgtgaactccagggatttgatgggtaggttatattattaatcaatatatgttatatcatttatgtattaaatgccttcactagttttagctacatatttggaacctaacatttaaaaatatttgtagtgtatgtactttggctctatcttgttcatatctatgtaataataattaatgataatatgacatggtcatctatctctcaggatctggcataggaaagcaaaaagaggaatctaattattaaaatactgggaaatgacagtgtactactctatacttactaatgtgcatacatttgcatctataattatttgcttttaccatatatctagagaagcactaatggaagatgttatactggtcacatggcataactatatgatgatcttcttttgcaaattaattgataggtttaatagctacccattggttaacttgtctgtgatagattgagggaagatattttataaatacaagtaaataaatacattatttccagaaacaataagaaataattttaattatctcataatgtagtgactacaatttaggtatgttattcacagtgggcatcggaaaccattgttcgcaatacattggagtgtacagagattgttcactggcatgcaaacgttagaaccaaggcaagtgatataaatttcattgccattttttaaaattaggtgaaccaatttgctaaagtgttggactgatgtgtaagactaaaacatattatattcctttagggaagttctttttacgtgagtagatatttgagaatttaaaaagttgacaagtgtgtgaattatttgtgttacatggtgatgggcagggggcaaagacccataaggtcaggaaagggagttaggtctgtactttcaccaaagtgaaaggcattaaccttcccaaagactgatttgaatgtgctggggagggaagtgatgcaatcaaaatggagtattggcagggctgtttttcagaaatgcttatttatttatttattttttggatgaggagaaaacaatagctgttgagaaagaaaatgtggtaagtaaaacatgatttttccaaaaggaatctaattgagggaagtaaatctagatagcaatattatataaacattgggaatcaaaaatatggggtaggagattacttcagaactttatacttagaggtagacaaaaacattaataggcttcatttagaaaattgtcttacaagtatacaatttaagaaaagtccttgtgggaatcatgcataccaactacctatttgaatatgctgcatagtccctcactagacctcatgagtacatgaaggtagctgcattgcaaatgagtacctgcttcaaaacttgattaaagaatgagaataaagatatcacagatattaaacttgttcttacacagcagcattacagaatgttctgctgaatgcagtatctatcaatatgttttactggtatttgtactgggtaaagggatgaaaagaactttgcagaatgaagaaagacgattgctgaagtgtagtacaataatatttttctctttacctgaacatatttaatccttatttatttttcatggcaggtgttgttatttttcagtgtagagctaaaagatgtatagatttttcagttattatattttataaaccaaatagtttggcctaaccattatatgaattgagttatgtaagtgtttctaaactctatggcatgctgatttatttcagacttacaataatttcaaatttctactgaaagtcatcttccgtgttctaagactctttaaatcaggggtccccaactccgagactgcagatgaatatcagtcagtggccttttaggaactgggaggcacagtaggaggtgagtggcaggagagggatcatttccgcctgagctccacctcctgtcaggtcagcagcagcattagattctcacaggagtgcgaaccctattgtgaactgggcacgcgagggatataactggtcatgcgagggatctaggttgcgtgctcttgatgagaatctaatgcttgatgatctgaggtggaacagtttcatcctgaaaccatccgtctcccaccccaccctgcagtccatggaaaaattatcttcccacaaaaaagtccttggtaccaaaaaggttggggaccactttaaatagcttatttatttttgtggggtcagttttcccagtagaagctgatatggtagttggagtaattatcttaataaactggcaattttaagtcactgtacttagaattacatagagagatatatgaggagaataatagaaacatagtttcttcaggtacttcaaaggaacaattctcttgcaagtaaaattgtttgaaaatggaatattctacattggtgagttttctattcctgaacctgttctaaagagtggctaaaggaaaattttgggggaaatttatagaaaaggtgcagagatgagagaaggttaaccccaaaatgctatggcattttgatgagagacagactcaaatttctttaagaactttggcctgaagcacctccgtctgacactagtggaactattaatagggagtgattaggaaatcacctaacagtttggtttctagatacaggctgaagaagttaagagccaagaaagattctatgtatagtatttagtaaagcaaaacaatttggtaagtaatgtttaagaaatgctatttcctaagattttggagttgtatttattttttttaatgaattacatatgtttctatgagacatcttgtgacatttctaaacccaacagaaacagtgtatcagcacttatgacagctagttctccactgcagtgtgtcctaggaaacactctaagatccactgttaaaccttatgagagcttcagattctatattgctccctattttactgggcatgagtaggaagttttaggaaggaaaataaaagaatatcagctgcatagacttgaagcagtaacacttgcatttataagtgtgagtatagttttaaaaatctatagattttatgcaattgtaaatatatgaattcctcgctattaatatttgtttcagaatttttaaaaaaattgttgagttacttttcttttgttcatttcaccattaattagacccataatgttgtagacattatttggattatattgacattttatcagattgaacatatctgtattacttagtaaggtaaaaagcaaaaacaaaaacaaacttttccagaaagaaaaaaaactgtgaatcaaaactacaacaatatattgaacatttcatagatgatgggttcatagataagtataaaaacattcattaaaaaaatctttatcactctttgaaaaaggatatattatcacccagtgtttcttttctagacagaataattctgtttggagccatggcaaggagtttacttattttaaaaacaagatttgtcacatgcaaaggattagttactctaaggtttatgttttagagtgacacaagtgtgattaactcactataaatgattgaatactttgctttttgcctttcttgtatatttagactcttgtgatatttttgtaagaagctgttgatgaaaaaaaccaaactgtaaaatatttaaagaggtttattttgagccaaatatgagtgctcatggcctatgataaccccaggggggtcctgagaacatgtgcccacagtagttgggttacaacttggttttatacattttggggatacagaagttatagccaaagacataaatcgataaatgtagggtattcattggtttggcccagagaggcgggatatcatggagctggtgggaaggggagctcacagatgaattcaatgattttctgattgtcagttggttgataagctttgctgaaagattagaagtcagcagaaagaaatgcttgagttaagataaatggggtggtgtaggctgggtgcagtggcttagcagtggctcacacctgtaatcccagctctttagaaggctgaagaggggagatcacctgaggtcaggagtttgagatcagcctggccaacatggcaaaaccccatctctagtaaaaatgcaaaaattagccgggtgtgatggtgtgtgcctgtagtctcagctacttgggaggctgaagcaggagaatcacttgaacccaggagggagaggttgcagtgagctgagatcacaccattgttctccagcctgggcaacagagcgagactctgtctcaaaaataaaataaaataaaataaaaaattataaaaataaagataaatgaagttgtggaagcacaggttcttgttatgtagatgaagcctccagatatcaggcttcagagagaatagatggtcaatatctcttatcagaccttaaaaggtatcaaactcttagttaaatctctcctggatcaggaaaagacctggaaagggaaggagattctctatagaatgcaaatttctcctgcaaatgatagctttgcagggccatttcaaaatatgtcaacaaaatacattttgggataaaatactttgatttcctctagggcctgctatttgttatttaatgctataccagagtcaggttggagttggggatcttattgctaccaagtctgttttgtcagtcttatgatctattttttttttttttttgagataaattctcaccctgtcacccaggctggagtgcagtggtgcaatctcagctcagtgcaacctctgtctcccaggttcaagcaattctcctgccccagcctcctgagtagctgggattacaggcatgcaccaccatgctcagctaattttttgtttctttaatagagatggggtttcaccatgttggccaggatgatcttgaactcctgacctcgtgatccacccttggcctcccaaagtgctggaattgcatgcatgagcctggccaatgatttacatcttaatgccagtgctggccatttgcgcctaaactccaaaagacaagagggtataaggaggcatatccaacctcccttcctgttatgacctgaatagtttttcagattttctttgtgaccttcatggccaaaaggggaggatccattcagttagttggcgacttagaattttatttttgttttacaaaacttatttcctaggttgagtcactttacctgaacatgatcttaatgattgaatagttgttaacataaataaatacatattttttctaactcacttaatttcacactggttctactggtaaactgtttttcaaaataataagattctcataaggctatttttattaggtttcatatatagaaaaggtatctaatatattgaataatattgtagcttctaagaccaaaatgtcttatttcaaatccctgttctattacttactagtggtacaatcttgaaaaagttactttatctttctatgttttagtttcctaatctgcaaattgaaggtaatattacctattgcatacagttatttctccacttaaatgagttaatacatggagagtgcttaggaaaatgtctgatatatatatatagtaattattcactaaatatttctttattgttataattgtcatttgtattagtttcaaaagatttaacacagaatgtattatgacaaaatttcagatgtttcagaacatgctcatagggaggccacctctaataactctagcaatatgttaacatatgcatgacgctataattgtatgcaacattctaggagttaagtgttcgcatcctatgtatgtaagggtcaagttatttggtgctaaattagatttttttgggtatgactccacatagtctttttggtcacacccatatgtcagcatttagacagccatggattgagggttacgtttaagttcacagattagaaatctcatagagatttttgaaatcaggtaagtttcaagtcaaaccttggtttttttcattcataaagatgggactgtggcctattttgcagacttctgaggatttaatagaaattagtaaacacattacctgatatatagtttgtccttagtaaacatcattccttttctctgaataggtggtcatattgcgaacctctggaatcagtttagacataagaataaaacacacctaatcaaacatgacctgggtcatatcttgagtcttctaaccagagtagccttggattgcccaggctatgtggagctagtgggatgaggaagatggggactagagggaatagatggccgagagaaagatggtgggaactgactggaaagacactttcagcctttggtcaccaccctccagagcttcctaaacttagagaaccagtaactactgctgactgtggcccatagacagttttgtttgaaatagtgtttttaaatatattgaatgctagttgcttagtatttacaaattaggagactcagccttaaatcagaatctctggcttctgtagaaaaaccagatctgggtccattaggcctcacacgtgatgtgagtgggccacagcaaagaagtggctgcgcctttagattgagcctactcttccattcctgctgggcccttgtagcccttgagttgtgacacctgctttcactgaggcaaaatccactttccattgggttaactggtgacattttgatacgtaagaatattttgcttcttttgaacataaatgattatgaaatgaatttctggtacttctgtgttattttaatggattctgcccccatagtctacttgatataaagtcttaaaaaatatactagtagtactatctaggatcaaaggctaatagtattacatctagaagcaccgtatagcaataatgtcaaggagatgaaattcaggtcaggtttgtaattactacattcatatagtaatgataattagcagtttcttaaagcttcatattttatatgatttttattgctatctgtcttttcagagctttattgagaattagcaggattttatgactttggttggtgttagttaaatgaattgcagatgacagtattattaacaagaaatgagaatgatatgcttttggatgttaacagagcaaaacgctggtcagatgtgaattaacatgttcaaaagttttcatatctcttaacacacttaaagctattttgtctatggggaattatctagttattatatttgtgaagtaaacttacctgtgttgtgtttgtgttgtcttacccattgacacatattaacatgtttaaaggtacatgtgagcagttatgcacatagactacaaattagtaaactattttgaagtctagatttcatgacttattaccaatcattctgaagttttgccttctttgcttgatttgtatttttctagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggcaagggagtggctacagattcattaaactgacccttctccctcttttcctttcttacttgctaatctagacagcacaacacagaattaatgaacagactttgaaagatccagacttctggcatccccactagcaaatgtgagacttttgacaagtcatttaatctctttgagccttatttttctaatctatagaatagggatcacagatatattattcactttattacaaggttattgtagtactaacgtttggtttagtaaagggtttaatatatagttaaaccatcagtatatggaatggttattattctcccttcgcataaaaaatctgttgattacacagtaccaggtaagaagtttcaaaacagggccactccagtctagctgcttacaattccatatgaggtgaatatggtaacttgcataattgatgtataaccagataaccttgagaatgccaaaattacttgtgactggaagggaggataaggtttggaagggtgagattcttaagggcaaggctttttaatctttctactcactgccatttttcagcatctagaatagactatgccacagtgatgctcagtgaagcctattaagtgaatgcatgtaaagaagactttatatagtaaatgacacttggattaggtcttaaaatgggttggagctggcctgaaaaggtgagaatgagttattttcttggctgcaaaagtaataaagcaaaggcaaaacccaggagtgtttgaggaatagtgaaaaggccattcagtggaagataatggtatcaaaataggcccaaccatggaggctcctacatgccacagtaaggtctctgaattgtatttgataagcagtagggaataatgggatgtttcagagcaagggggcaacctgattggagcttgttccaggaggattcattttgcctcaccgtgtggaatgattagaggttgggagcaggagaaagtagaggtcagagacacggagaaccgttagagcaacactgtgatccagaaaagagggaaacatcattcaaaagctgattgtattacacaatcactcatccctatttaacgaacggtgctgggaaaactggctagccatatgcagaaagctgaaacaggatcccttccttacaccttacacaaaaattaattcaagatggattaaagacttaaacattagacttaaaaccataaaaaccctagaagaaaacctaggcaataccattcaggacataggcatgggcaaggacttcgtgtctaaaacaccaaaagcaatggcaacaaaagccaaaattgacaaatgggatctaattaaactcaagagcttctgcacagcaaaagaaactaccatcagagtgaacaggcaacctacagaaagggagaaaatttttgcaatctactcatctaacaaagggctaatatcctgaatctacaaagaactcaaaagaatttacaagaaaaaaacaaccccatcaacaagtgggcgaaggatatgaacagacacttctcaaaagaagacatttatgcagccaaaagacacatgaaaaaatgctcatcatcactggccatcagagaaatgcaaatcaaaaccacaatgagatatcatctcaccccaggtagaatggtgatcattaaaaagtcaggaaacaacaggtgctggagaggatgtggagaaataggaacacttttacactattggtgggactgtaaactagttcaaccattgtggaagacagtgtggcaattcctcagggatctagaactagaaataccatttgatccagccatcccattactgggtatatacccaaaggaatataaatcatactgctataaaggcacatacacacatatgtttattgtggcactactcacaatagcaaagacttggaaccaacctaaatgtccaacaatgatagactggattaagaaaatgtggcatatatacaccatggaatactatgcagccataaaaaatgatgagttcatatcctttgtagggacatggatgaagctggaaaccatcattctcagcaaaccatcacaaggacaaaaaacgaaacaccgcatgttctcactcataggtgggaaatgaacaatgagaacacttggacacaggaaggggaacatcacacactggggcctgttgtggggtgggggaaggtggggagggataacattaggagaaatacctaatgtaaatgacgagttaatgggtgcagcacaccaacatggcacatgtatacatatgtaacaaacctgcacattgtgcacatgtaccctagaatttaaagtattatatatatatataatatacagccttatgaacatatatatatataaaggaaaattaggcaaaatagcattacttgaggtactcaatagcctggcagagcagacattaagggtaagagagactggacttgaatttcagtttggtacttgactttgggtgggtaattagcctttattagtcttgattacacatttaaaaggtttaataaggccgggtgcagtggcttatacctgtaatcccagcactttgggaggccgaggtagtggatcacctgaggtcaggagttgaagaccagcctggccaacatggtgaaaccctatctctactaaaaatacaaaaatgagctgggcatggtggtgtgcgcctgtgatcccagctactggggaagctggggcagaagaataacttgaacctgggaggcagaggttgcagtgagctgagattgtgccactgtactccagcctgggcgacagagcgaggctgtctcaaaaaaaaaaaaaaaaaaaagtttaataatgtccatccccatagggccattacaagaatcaacttttaaaaagtcacacattatcactaaaaaagcaaaatatttttccctatgattatagaaaataatgcacattgttgaaaaaaattcatattttgataaccctattcatttagtatggattttagaatacttagtattgttgataagttgacagagcataagatattcaaatgcccttttagagtgtaaagtctttcagaaagtcagaatttaaaaggagagagatattcagatataatctgataattctagagtatataggaaaacctaaaatggtttctaagtagaagacaccaagatgattttgactcaaagagaaaaatgatgcattttgggccatcttttcatggcattttatttcttgacctttttgctttactttagtagttctgactataatggtggaaactttccaacatttccttccatgcaaagtggatgtgcttaggacacttcattagtacttaaattcctgaggtcattcattgactgccatacatcagaaatagaaagatgggtgtccctacaggtatgcctttgacataaatttggtggttggctataaaaactggtggttattcttatgttttagtatgtaattcagattttataaagaaatagcatttagttttatcactattataattttgaagagtatttctgatttggggagcattttatgtattctttggatatttgtagtaatgccattttaacctgtcttgtttagaagacacagtatgctgccaaaattctggtcattgcataggagttctagcattctaattccatctaataggaggggaaagtcatgtgtggggtatatttaatatgatgactgtatgcctagtcagggcttttgatagagaatgggaactagaactaggcaggaagttttcaagctgaacatgaggagacagtgtgcctttgaagccatttgcctcctggagagagacacccagagggagagtgtttagtaaattaatccactgagccaacagactaagctgctgaattatggtcagactcaaatggatcagatgtggagaagcctgtatttgaactgctggccattaggaatggtgtttgttgctatgggaactggtgctaaggaactatactgagagactctgattaaaagggggagggggaatggagaaaaaagcctgagaggacataaaaataaaaaagcaatccagttgttgtaaaacaaggctcaagccacatactgatggctgtgaaccatatattcctatagagtttgcataaataaattcatgctttccaattaatttgaggagaataaaatattgccgagggactgttaatttctatgatatttcaggcaaagaaccaaagtgtaggtgccgttttcatgagaattttagatatgcttgactaggaagtcattacatcacatttatctgtttggatgtgggagacattaacagccttatgaatattcatggtatctggttaattaagttaattgttctgcagaagtgcttgcacttccaaggacattttttttttttttttttttttgcctccatagtttctccctggtatttcatcagtaattctttacatgaactgctacttctgtccttacttttttgtatttggaacattttagcagctctcaggaggaagtggtaggcaaagtttctggtagtgttaagaaaaataactttcaggctaattaaaatgtttaccttgaggtagaacatttatagcttttgtgagaacattaaaattacgccattgttatttatgtgagcagcatgttcttttggcatgtagacatcttttcaaatagagtacagtttcctgaaacaaaatgtaatccatctttcagattatcccaacaaaatatagaacaagctatcgttttgcaattttacatatactttctcataaactttccttttttcttcagagtgtcaaaaaccacatttaaagactaagatacagattaatgagtagtcaatgactaaaataattttctgacttctagtcatgtctgttatcactgccaacttctacagaattagagaaaagttgcaaagcctgagaagacataaacaatttttaaagccatctctagcattctaaaaaaattttgtacttgggcatacccaccgtacttcaaactcacagggaataaatggtctttattttcttaagtcatgatatgtgtcattctctattgcacatgacattacattatgttttttaatagcctttctagaggaatgcttttacggtctactcataattaaccatggtaatggaggaaatgtgtttcatggagtactgtaatccatcgataatcctaaatatctgactctaattatgtggcctcctccaaaatctttaccacaaatctgattgggaagcacaatggattgacttgtttcttccttttctcctgatccattccagatttattagcaattagatggtcaaagggcaggctgtagagggccacaagatcattggaaagaccttgataaagatccactgagtaacaggtttctacactacttgttctcaaaacttagggtccatagactcaccttgtgaacttgctaaaacagagatacctgggtcctccctcctccaaacacattctgagtccatgagttggaggtagaacccaggaatgtacgtttttaacaagctcccaggtaatgatgctgcttggaccatgcattccagaggagtttctcaccaagtcactgtgcatacaaaccacctggggatctaataaattgcagactctgaatcagtgtgtctggaatggggcctgagaggcaacattttaaaaataatatattttttacttccattaatactgctattactgttttaatacctattatccttatttttaaatggacaaaaattgtatgtatttattgtgtacaatgtgatgttttgaaacatgtatacattgtgaaatggctaaataaagataaacatgcataaaattgacataatgatcacatactgattttacattgagaacacttaaaatctcccttagaaatttccaagtatataatgcattgttactaactattgttttagcctgttctcatgctgcaataaggaaatacccaagactgggtaatttataaaggaaagaggtttaattgacttgcagttcagcatggctggggaggcctcaggaaacttacaaccatggtggaaggcaaaggagaagcaaggcacattcttcacaaggtggcaggaaggagaaatgctgagtgaagtggggaagagtcccttataaaaccatcagatctcatgagaactcactcactatcacaagaacagcatgggggaaaccacccccgtgattcaattactcctacctggtctctcccttgacatgtggggattatggggattaaaattcaagatgagatttcggtagggacacaaagcctaaccgtatcaactgtagtcactaggttgtataacagatctcttgaatttattccttttacctgaaattttatatcctggaccagtatctccccagtccttcccacccattagccccagtaaccactattttactcttcgcttttatgagtttaagtttttcagattctacataaaagtaagtatttgcctttctgtgcctgtcttatttcacctagcataatgtcctccaggtttatccacgtgttgtaaatgacaggacctctttaatgccaaatagtattccattgtgtatataaacaggctgattgtccctaatctgaagacttaaaatccaaaatgctacaaaattagaaatgtttgagtgccagcatgatgccacaactggaaaattccacacctcatgtgacaggtagcagtcaaagtgcagtcaaacctttgtttcatatagaaaaatattttaaatattatataaaattatcttcaggctatgtgtataagatgtataaaacttttatgtttagacttgggtcccaccccccagatatctcattacaccaacagtgtaaaagtattcccatttctccacagccttaccagcatctattgtttattgactttttaataatcgccattctgactggtgtgagtgtggttttgatttgcatttctctgatgatcagtgatatttagctttttttttatatgtttgttggccacataaatgtcttcttttgagaagtgtctgttcgtatcctttgcccactttttgatggaatttttttttcttataaatatgtttaagttccttgtagattctggatgttagacctttgtcagatgggtacattgcaaaaattttctcccattctgtaggttgcctgttcactctgatgatggtttattttgctgtgcagggattgttttcttgatttctttttcagatagttgtaagtgtacagaaatgctactgatttttgtgtgttgattttgtgtcctgcaacttaactgagtttgtttattagctctgacaattcattcatggagcctttagggtttcctaaataaataagatcatgcctacaaacaaaggcaatttagcttccgtatttatgatttgcaagccttttatttctttctcttgcctaattgctctggctagaacttccagtactattttaatgacagtggtgagaatgggtattattgtcttcttgaggaacaagacattgtttctcaactcatgagagtaattttaataagcactcaagtattgtcattcctgtttgacagtaggccgtattttgagtaacaagggtcacagcataacttgccttttggtgaatcagttggaaccagtttgccatttagttaaaataaacttttctttgcactggtattactagaagtaattgtgcttatttataattaataataattaaatatgcttattcttagttacctaaaaaattatgatattaatgacctcttggttgataatggctaagctgcctcagcttctccaatttagcaacccaagtacatatcagttcaaagtaacacaaattgaagcaattatgtatgatcacataggaatgcttctgattaacaaaatccagaggactggtctttgccttcataaccggaacacaccacatgcatggtttcacagctcttggctattattggacttacttattatattctttaattcaagaaaaattgtagcttcattcattctgttcttaataattttaaattctctttagcctcctgggaatgggaagggctagctggtatagtcccctgtatctcagatttcagttacacataaacattaaaggggcctgacttagggcgctctttgcctctgtggactggtggggaaaatccaggtgtgtcttaaattctaataatcatgaaaatcagaaatcataatgtttcaaatacaaatcttcatacatgggaaatacaattgaattaaacattttcttcaatgtaggagacatttgtcagataacagaggggattctcatttggctaagagcttacctctaagattcattaaatgtgtttagagcatattttttgtagtttgtagttattttatttttctgagttattatttggattattttctcttttatttatgtatgcatttgtcactgctccccagaggcacctcattttggcattgaagctaaaaacccattcattaaggttgggatggagtgggctttgatatagctagcatttgggaggtagaaaatagacattcgtgatcaaaaaagctgtaagcggttactataaactatttttaaatttctaagtattttaaatattgaacaaatgtgtagacatttgatgtgcatctatactgtgaataagaacttaaacttctaatattcacattaactttcctgattttataaattctcgtttatttttcatctgaacattgaagaatgacatctacataaagtaaaagcaaatgttagtttgaacacattctaccctaatagtgcatgttttaaaattgctttggcaggatctaccaatgtattggcacattctcttcatggagttcctcatgtgataactgcaacattgcacattataatgggtaagaattcttccaaagcagttcatattttataaggaaatgttgatttatataaggaaggccatcttatttccatcagactttaagaaaaggcaggttctttgtctcttagagtagagaaatgtttgactaaaaaaccaaaaggcaatgctttactatgtggattgcctgtcttttcaaaatacttgctttgtaaagagcagtaaatgaagttttattgtaatctgtacagaaaaaaaatattgtagtgtgctcaaaattataattttataaccagatgaagaacattaatgaatactccttaagtatatccaacactgatgtaggactgtaccaagactctaggactaggattatgttattaatgaaaaaacataaccagaaaaaaatttcagccagtagatgtctatagatattttattatccctattggtaaaaagcatataagctcaggtatatgtaacactaaactactgttaaatctgtgtttaccttgcctatctactttaacttcgtttctttgaccatgttttataggaaatagcaataagctgaaaaatttagtactctgtgtttcttcactagtacctgaacaagttaaaaatggtaattattgtagttataggtaaagggaactgaagagaaagtgaggatgttcatggtctacagtacctttagatattctcctataagccaataaatatgctctcttatgtttgctgttttgatacaagtcctactgtactcactgattaatatttaatgtaatattcaagggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaagtaagtctttttcttaaaccaaaaattgtatcccaggttcaatgactgttaataacaaatttcattacattttagggcagaagactgtgaaatatcatttttaccatttaacagctctgatgatgtgcaagaaaggtaggtaaaaactcaatgtaatacagataacctgtatctttaaagcataaaacattctgacaaacaattgatcagacttaggatctttggttatttttctaacatagtagtaaagaatatagaatcacagactcttacaggtcctagtaagcaaacaactactcactcagcctttttctctttttccttccttctttcctcccttccttccccctgtctctccctccctccttccgttctctttttcccttcccttcccctttctttcctttcctttgtttttttccctttctttccttttccctttcccttttcttttgagtgcctactatatgccaggcactttgaatacaacaatgcaccaaaaaatgaacaaaacacacagttttgtccctcgtgataattttggtctagtgtgtaatacaaatattaaagccatattaaagaagggttatagtctttaaagaaatagtacattattattccttataatactagtttacctttaaatgaatcaacacattatgttggcagcaacaaaattgtacgtttttacttactatctaattgaagaaagtatttaacatatataatgatgagttctctaattttctcatatttaatagatttgtgtgtgtctgtgtgtctgtgcgcgcgttatctgttttatgtctttgttttgttttctttcttttaggagggcacagggatctcccaaatctggtgagtcgaaaagtatctccttgagaactgtgccaggttctgttgacattttgttctggtgagggaaaataaccaatcactttcattacctttagactgtaatgatcaatggcaaatgatccagggtcagttcttgaatgtcagcattatggcaattccttgcctgtgttcagtggcacctagaggcttggcacctaataccaggttagtaagcatttttattgaattgttgatacatttcttatagaccattttttttccagggtatccaattaactgttggttagctagaaacttaacaggtagtttatctttgtatattagagattctaagggatttgtcatcacagtaggttgagaacaactgttgaactggaataattatcagataatcattgactatttaacgtcactgaggctaaaataatatttcctaagttttattgatagaattttatgcctactttacttgatttattcatttagttgtggagaacattatattaaatactgatatttcttgtgaatgtctttgctttccaactttaatgcaaacataaatatccttagcatgaaaatcacacatatgtatatttgatactgtattagtctgttttcatgctgctgataaagacatacccgagactgggtaatttacaaaagaaagaggtttaatggacttacagttccacgttgctggggaggctccacaatcatggtggaagatgaaagtcacatctcacatggcggcagacaagagagcttgtgcagggaaactcctatttttaaaaccattagatctcatgagacttattcattaccatgagagcagcacaggaaagacccacccccatgattcagttatctcccaccaggtctctcccacaacacatgggaattatgagagctacaagatgagatttgagtgggaacacaaagccaaaccatatcagatacttttagtcaaaagaaacatttcagttctatttaatgtgaatagtagtgcatatcaatctcctgcccacattttcaattgaataaaatatgagacatcttatatatatctttttatccatgggatatagacattccttctcttgcacattcttcttaatcagctgtccattatggggctgaaaatatttctttcctgaatccaatcctgtagagtgtaggagaaaggatcgtgagtgttgtgaaatataggcaataaacggggaaatattcaaagttagagaagaaaaaagagaaactgcaaacttcgatattgaaaacccagatggcaaggtcctcattaattacatctagtgctaaaacttcaaaggagtattttgaaccttgtgtgatttagaaattgagcctggtggttttccccgacaccttcagaaatcctagatagctgtgtgctttcataatgtagtttccctgactaaacttgaagacgtggctagctgaccaaggagctatgtttggcaggacttgagacaatgtttatctaaccctgtttgtttaaggaccttcttgggagggtagacctgctcttctgggaacaatcgattcatagctccttcaaagccactccataaatgttctgcttgactagaattccactgttgactctgcaggcttaatcagtattaatgaatttttcagagaaggatgactaattagagatttcttctgtggtttataatcacaacatgccatctttgcaaagaccttttgatcaagactcatttgaccggagatttttcagagatgtagcttctgatgattcaggatgattgaacaggagatttcactttcttctttttcccccaccatgataaataataatttatgttagaatatctcagtgcaaattgccagtaggaactaatattcttatattctaagtattctaagattaaatgtgttcatatatgtgagacatttaaagcagtgccagccatgtaagttgtgtttctatttcaagtaaatattgcaaagcaggcataggatagtgcttttaatgtttataaattatgcaattaaagatgcacagtaacactaccatgaacgttttggtgctgtttatttttaattgggaagaagaagcatgatggaaagcatactgagcacctggagtattggtgctgatgaccattttttctctgtgtgcctttgaacaaatcacttaaacttggagttgtcttttccctctacatgaaatgagcgaatgatgagataatctctaaggtcccttacagctctgacttgagctttcataagatactaagagctctttttttattttgttgttattcttaaattaacttcatgtttgcactgaaatcaagctagaagtcatttgtatgtatttctgcaaactgcattctatagcttgatgcatttgtgagtggctgttttggcactaaatcacacctctgaattttcactctcttatattggatggaacagttatgcaagattaaaatgttcagtcatttaactgaacatgtgtggcagcatttgttcactccatttcatccatccaaaggccactttgatttatttcatttcctatgtcacttagaccttctgtctataaataaatatttaaatcacactttagattttagaaaatgttgagctatttgttacacaacttgtgcatattaactcttctataatacatcttttaacaacatagtttcacatttagaatttctaattacattgtattttaaattatgtcttgatatgtgagtaggacgcttgatggtttgctttgtaaaatgctctaatgtaagagcttattgagaaggaagccagtgatttaataaaactcatttgaaagcctgcatcatttaaaaaatagcaagatacggtttatgaattttaggtaaacgtaacatggtgatttatctatcttgtccaatactttcagtaaacagtatacttgttataaggaacagtatgtcataatttttggtataatctcttagtaaatttcttgatgtctaatagaaatatttaatttcagattaaataatggaagtatggctcttataattgcccgaaacacttctcggccagaatttataaaacacctgaaaagatatgccagtgtaaaaaatcaggtatagtaaattctttttgttacttatttgcaaagctattaatcatgtagaaaaagatgctgcaagaattgacatcgaatcctgcctcataagaaggttttattttcttctgaatatattaatcttctttttcccaatctatttcatccaaattttgaaaagcatccgccaggattaatatagattggccttttttgaatgatgaattagtggttatgtatctgtaaccacaaagataaaataggaaatgtagtgttatattgcaatgtgaaataaattaaggataaaattccatactcaggctgttcttcagaatgaaaagaagtgaaatttgagagtttagccttcttgatattatggcagcagactttctaaagttatgatctttagatcttcctgacatttgtttgcatatctgcattgattgaaatagatctgtagatatgtatttaaaaatatgacagttttatacaaatattcattcaaaatgagaatatgtgaagatatacatttccacttaagtgatttgctttaaagagaaacagtaactattacaagccatattattttggcagctgttttgacctgattattaggaaaatgatccttgaactatgtgaatttctgaaattgtgagtctttgaagtacataggtatggttgtaaaaccctatagtttcacactttttctttttctttctttttttttttttttttgagttagagccttgctgtgtcacccaggctggagtgcagtggcgtgatgtctgctcactgcaacctccacctcccacgttcaagcgattctcctgcctcagcctcccgagtaggtgggattacaggctcacacctccatgcccagctaatttttatatttttggtagagacagggtttcaccatgttggtcaggctggtctcgaaactcctgacctcgtgatgtgtccacctcggcctcccaaagtgctgggattacaggcgtgagccaccacgtccggcccacacattcttaaaggtataaaatggtgcttggatagagttgggagataacagacgggaggaggaggagagtaaacccagccaatgactggcagctgaaccttgcttatgtaccttagccatagcaagtctctccatttttgcctcattatattttaaaactttcttaggccatcttcatgaagtttgatctgtcagtaacattatttgatcctcatgtattgaacaactaactgggctgcttaggaacttaaatcataaaaaattacagtcccactttctttatatgtcaaagtagatcagcaggtataatgtaggttgtgagcctacataacagttttatgtatgtgtttgggtggaatatggagatttattgattttcaaaggaatatatgccctttcacattttaataaatttctaaacattaaaaccaatttttaaaaaacccaaagcactatatattcattgctgtttttaagtcagaaaatagaaacaagaaaatgattttaaagcactcaaaattccatgttcctcaagattagtgtcattaccttggtagaattttttccgaatccttttttattaaataaatgagaagtaaagtaagtattaacctcattcatgtacctctatttgagaacttaaatagtattaacctattaatgtacccctgagaagttctgtatttattttggggaggtgtatgttgcacaaattgtttatggaaggtctcttttgaaattgcctatggggcaagtctctcaggcaatttttgtaaacattcttcttcttcatttttttaaatcaatatacctttcttctgattttaaaagcaatggttaccttacacataaagacagacatacagaaaataataaaaatctgtatcgataggaagacgttttctaagagataatattatgcaggatttatcatattttctcatgtactctacgaggcatatcttgcttttgacacaagaaacagttgcctgtgtgtgattcactggccttaactctgatttatttatcaactttcaaaaattaaaatccatgctattttttttttttttgcaaagaattctaaaatattttgcatagtgtatatagtaagaaagattgattcccagggtgactgctttcaagcaatgttaatttgatttgttaattatccacacaggtgtgtttatttaggctctttccttcatggtgacattaaaaatgtgaatttatataaattttgtaagattatgaaaatcagatctatgtaaaaatcatgtctactgcataattcatagcagtgctggtattcaggaaggaaaatgtggcaattcagtttaaggagagtaacatctgcttctctgaaccatttttaccaggttgaataagcgaatgttactgtataacactgtaaaatagattgaaaccaccatgtgcggagtggctcctgttccttccccatctctgtgtaaaattagatagaggctgaacactacccttcaaagtccttgcagctccatcctattgctttgccccccttctcactgtccacacttttctctttcattgtgaccatttttggtagggagtttaaaaccttaaatgtgagtgcttcccccaggatttctttgcagccctctcatcttctcaggatgccgtctcctggatggcctcattgcccctcacttttgaactgtctgaacatcatgcactcccaagggttctgtcatctcgtcttatctgcaggacctctgtcttcttgtatgctgaagaggttctgaaattcaccggcatctggaggccaacatgtctacagccgaccttatcttttcccctaaagttgttccttctgcgttgctctgtgcgggtcaatggcaccactttctacccatccaggttaccctgaactgttccttcttcctcattcctcactaccagtcccctaacttgttctgttggtctcctcttaaatgtttctaaaatttctccctcaccttaattcaaactttaatcctttcttgcttacagtagcctccttttggccttcaggttctctggtcttgtcttccatacctctttttagagaaacttttttctaagacacacattggatttctctcctgcttaattcttcagtgcctttctcttgttgtcagaataatatggaatatcctcagtctggaacacgtggcctttgtatccaggtccctgcctgtgttgcaaccccacctcttattaccaccctccaccacattcccagtgttttggcattttattcgttggctaaggttgccataacaaataccacagaaaagatggcttaaacaaacagaaatgtatttctttcatggttctggaggctagagctgcaagacaatgtcagcaggtttggtttgtcctgagtcttctctctctggctggcacatggctgctttctcacagcacccacaagtgagtggtctttcctctgttcatccccgatgccttttcctatgtccaaatttcctcttcttataaggacaccagtcgtattggatgagggcctaaagacatcattttagcttaatcgtctctttaaagatcttatctccaaatatagttatgttctgaggtatacagagcgaggatttcaatacaggaatttgagggccaaggggcatgatgttgagcacctaggagtcacactgaattctgtgtagttgcttgaccatggtttgcctctagttttgtaaatgcttcctctctccagactttcttctccaggctaaatcttatatgttctttaaggctcaattcaaatgggaagctttcccaacatccatagcctgtttgcctcctcttgtttcctctgttgaactccacacttgyaccatcatggcactcccctgtatcaaaattgtaactgtttacttctcctccccgtgccccaaacataccctcacacaggatactaagctcttggctcccgaaagtcccacttaacagcgtctgtggcttcacagttaaagcatttgaaggatggctagatcttcattttgtgaggagtgcacatgacaactgctgatttaagataatagacttactggtggtggctgtcaattcttgacattccttggcttacagctgcatccctccagtctctgactctgccatccttggcattcttctctcataaggacatcagtcatattggattaggtcccgccctaatgacttcatcttaagttgattctacctgcaaagaccctatttctaaacaggggacattcacaggtaccaggggttaggacttgaacatagttggggtggtggagggaaatataatttagatcataacaggcagttgtgtgttttaaatgaattatcaactaacatgaatgattatgtagataattctacaaggatgaggcatgtagccaaggctttatacccgaggtaggaggtctaacgcagttactgtcaaacagttttgcttggggccctctaattctgtacctcagtcacaacagctgatgccatcatatcatctactgtttaactgtgtttacagtataaactggaaagttggctggaccttggtatctacatatgtaaaatatgggtgttggggaaaatattagttttctgtcaacttttaaaactgtttcattgaggtttacatgtggaaaaggggaaaaactatgtagatgatgtttaattaggaatgtatctcatgtcatttttctgaaaactgaaatgagtagttatacatttctgctcaagttatttggctatattttcttaattatgtcagaaaatacatagtgctttttcagtatagtttccttaggcaaacaagaaaaaacgcaagttgaagtttaccttgcaccattctatagtggtaagtaaacagtgatcttgcagcttgtgtccattgttaaagtgggaatggggcaggcaaacaccttttaaaatccatatttgattggctttctcttttaaaagaagacatacatcccattttatcttcagaagtttagacttgcgttcttccaaattaaattccaagtgtgaaacttgtactagtttgctttatgtcagctaaactaattgacaagttgataatggattatatgtcttctgtatctacaggccagtattaaagattatctttaattgaaaaatctacagtatcactattttatgtaacttctcacagatatgtactatttgtcataaaacaagatttctaggtgctagatctaaaagaacccaaaaggctttggataagagattccttcttccaaaaaaacttggagatccctgttcatagtctcaaagctattaaaatgtcagcatacatgctgatatttacttgtgagagagggctcagtgaactttgattcgcgttagtagctagagataaaccaagtataatgattatttgtatttatttttagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattaggtaagtctatttatttcaccgcttattgtcaaccagtaaacataaatctaatattacaacgaaagctctcttctctgaactatcaaagcaggcagttggttagtttttaaaaaatcagtaaatcagggaagcataaagagacatgcacaaatttcaataaataaaaagcaactttacatttattcaactgttatgtagacccaaggcattttctttggttatgcgtgtctacattggctttctaatttattgttgtgcataaactacagataatgtctacaacttccattttggatttttaaaaatggatcaagatcttaaatcttttagtggagccatctgaatagtaaagtgttagatttttatccttccatcttagtttcctctcactcataattactgtaacatgttttgttcagtaatttgcttttattaggcctttacagagcattcaacttcccttgggaacaattttacatagcaactggtataaacaggtttaggaacctgcaaacgcattcttggtaggcattgtgacactcagtggttagaagaagcatgcaggggtgcccactagacatgggtgttctagaggcataactgactgttttacagaggtaatggagagcattggacaatcaaggaagtcagttaaggaggttttagagcaattattgttgttgatgatttatcaatcagaccttctcagttttctagattacagctctgttgggaatgctgtgtttgttatcaatttgtatttggcattggcattgtgtaccatacttattaggtgtatgtgaaaaacaacaaaataagttgatgaaataatgtattttctttacagattgcatccaagacttatcagtctttatggaggaagcatggaagaaatgattccaaagtaacatgtaattgtttctaaaagaaatgtacaaactagaattttaatataaagaaatgtggccatgctttaaacctgtggtccccaccctttttgggaccagtttcatggaagacaatttttccgtggatgggggaatggtttcaggatgaactgttccacctcagatcatcaggcattagattctcttgaggaacatggcactctagatccctcacataccagttcaccatatggttcgcacttctatgagaatctaatgctgctgctgatctgacagggggaggaactcagtaatgctccattgctctaacctcctgctgtgtggccaaacggatatcctaatagaaattgatgttactaacaattagcctctagggctttaaaagtcaagatgaaatatcaattcaaattctgtttttagatatcaattcaaattcttttttttacaatgtgtttattggacacacaaaaaaactttgcaaccatcataatacatcaatatttaacctagataattctgaaataatttggattctttcatttttcaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttcttaaagtggtagggttttaaaattcatgatacaagtaacaaagtaagttgataacaaatactattttgaactgggcaaaatctagcccaatatgtaattgtgttccccttgtatctgagaggcctgtgttggacaaccatagtactctgctttcactgtgctcagataacctgaaatatatagttgtttctgagtagttctgagtaggaaagaaccaaatgtaaatttccttagagaccatcctggagaagacagttctaaatcggggcttgatttttcatctatgatcctagatgttctcctgaaagaatgactagcctttttataacgatacaaagttttttaaaaatacataaatgtcataaagtttattcctgtgtatacacactctgggttcaggaggttttgtgcttacatttcactactcaaatgccttcgcaaatctcagaacattcctcaccatcactgcaggcctgtgaacagataactttcatcaattaggatggctggctagtggcagggacttcatataaagaaatctttcccagaattgtttttccacattgccttctaatttgatcactccctataacagatgttcaaaattcggccacagctctcttatgaaggcagagtcagataaaatgatattctgcaattatctagatcataagcataaaataaatattacaaaaatgattgtatttaaagaaattttttaaaatccagaaagtcatttaaaatagaacctcatatagtatgaacaaactataaaaatattttacatttca

SEQ ID NO: 4 - DNA, 145347 bp, Homo sapiens
  mutation 132230: a/c SNP in forward strand
attgctatttgggcaacaatatggctccttcagaactggtcgagaatttctgtggtctttgcttgaccttcaagttgggagtttcaaatcagaggctttgaagtctggaggagttcgcagccattaatccttccggggttgtgctaaaggcgtttctagaaagagatcggaaagacccgttcagcacaggcccattgcatcttctctttgaaaacgcttgtctgaatcaagtatcttatacagacccgagactgaggggagcaagagcgcaggtccggctgtggcgaggtgtccaccaccgtacttgtggtcaatgcctggactagagagccgaggccgtccagggcgggctggccagggaaccagaagcgtccctggactggctgagtgagggtgccctttccagcaacccagtggccatggttaaaaggcagaatacaaccgtcaaagaagtccccagctcccacataagagagcgcaaaggccaatggaaccaaggcctcctcgcgagaactagctcgctttgaggacaagatcctggggatggaggtggggactgacgtagtgagagggtctggaggaacagtcgtagctgaaggtcaggacatgaagaattgcacgtatggtagggatagaatggcaggtacaacttttctgtactgaaggaactgggagaggacgatccggttagggaggttggggaactaatctcaacgctgcgtttacagatgaagccgcttttatatggcgtatatgtttgcttagaggggccgacggagattaggagaagccatcctttggcgccaatgatcaaagcgtctgccaaggagaagaagccaagggatgggcctttcagagagggcaaggagtcatgctgctctggatgccagtgtcaggacaagaaatcgaaaggagcgaggactcttcactgcgtgcctcagtctccccgcttctgcctctttcacctctgtcctacttccggcgcgaaagcaggccactcgctctgatctagacctagttaacattagcttttcccttccttccctcaaatcccctcccccctctatccccgtcccttctgccgcctgaaagggttaatctctcctgcgggtaaaaacaggtccgcggagtctctaactggcgacagatgggccactttcttctggccacaaaggggccggaatggagcgctccgcggcatacaaatgggcaggtcacgtggttccaggctcttggctggaccgggaagaccatatggcgcatgccggggaggaaggaggaggggcgggggtaggggtggagggtgaggggagcggttgtcggaggagggcgggagacgagcaaggcgtggggagaagtggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaaggtaattacagttctttcatttttttgccccagaatagaagcaataactgaagactgatgaacctacatattctgtatgtgtgcgtttgcgagagtgtgtatgtgtattgagaccagcatccccctccataattgcccataagtactcacacataatgagtcgtgtcactcaagtaccccctgcaggctttctaatttaaattttaaaaatttgggtttcttttgtggatagcataggagcttcttggattttttaaaagaatgcacggtaactatgattatctgctagtgctgattttaaagtcccaaaagcaataatgacttcactttctcacttcttacagtaagaaaaaaaaatctatgttatcaatatatattttgtgtgcatgtattttacgcacattgggagtgtcaagctgtgttttcagtgaatgaaagggacatggataccttgagtattcacaccatggaaaataaatcaggttcagagatagtttagttgagaggggggaaagtggagaaagggagagggactcactcctgctacctgttaccgctccagaggcggccaagtccccagcagccactactggagccagaaattcagttgttttactaaaggctttttattttccttactagaagcggcaacttcgcggttgccaatcgctgaccattataattactcaatcttttaaagggaggtttgaggcgaactttgaaaagccccaataaagagcgggcggccctttcaatgggctgtttattagagaggagccttccgcacctgatccccggcgcgtgggagagcgctctgcgccgcgcccccagccctcgccctgcagctagcgcttttgtacaaggtggaaatttagcggtgggccagagatggaaggcaagaaaagaaaggcgagggaggggtggaagaccctgtccacttttgttgccaaatgttacattgatggtgaaacaatttggtggaaactatttttcctcctttctgcatttgcttttcagtatcccgtcgatgtaatcttcttaaaaatcgctgccagtattagtaaattacgcaatggctgttcaacttaaatcgctaagtatctggaagccaggacagaaatggaagtagaatgtgtgattttacagcttttttttttttttatggagttgtgagtaactttgaacacatttggataaacatgaagtcgctgaaatgtacagtcatttccacacacattatcctgtcgggcaaccaccataaacacatttaagttaatcactaggatacaaacacatatgcgtgagtggtgtacacatatacatattcactaccctcccccagtcctgtcctcactcctacgtactagcggggcacacgcacgcgccattataaaacactgcatttaactttttctcagaggcattcattttgtaatgggcaggtacttttcgcaagcatttgtacaggtttagggagtggaagctgaaggcgtatctggcttttgaatatagcgtttttctgcttttctttctgtttgcctctcccttgttgaatgtaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaaaccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtgagagcaattgttgcatttcttcttaaagggattctgtttttatttttggggaaagtagttgcttttttgctgagttaaaaaatactaaacactatatgtagaataaaagaaaagaaaaaagtttaccttggcatatgctcttgtctgtttatcttgcacagggagtcaccagttctatgtagataatgaaaagacctaactgatatttcattatttggaatatgggactggacggcagtacaaacagtgtgtttttttctttgttttaagtggcttagcctttaggttttttatttccatttttaaaaatgattgttacatgttttcttctatttctttttttaaaaggtggattttaataattattaacaagcaagacataaacaagtatcctagcttagtttgtctatacatttaagatgtataaaacattactattttcttggtcttctgttatctgtacatttttctgaactaaacagttttatcttgcaaactagtactgtcccagaaaaatttatacacctttaggaagtaccaaagggaaatgagttaattaatttaaagaatccaagagaagtaacattttataattgttctattaacatcttgtgatgatttccatcatttttccaagaaaaagcataatggattatttgtactgaagaacacactatttgtactgtatttaggaaggtgtaattatttcctccccccaccctttggggcactattctgttgtttcatgaacacaactcactggaaaaacttatggatgattctgtctattgttaagtccacttcaaaaaaaaaaaaacagtttggcatttcttttcctctggatgtattgactgacagtcatgattcctagggaatatcattttggcacttgtgccctggctctactgtggtgctctgattactgtcattagtaactccattgtttctactctgattcgggtgccacattggatgactaccccccttcccaagcttgttcctttaatctccttctcattggtgatttaggggttccagaaagctgacctcatttagcaagctgctccagaaaaatgtgagtaatgtaatggacaggaacaattagccatactaataacattgccaatgaggctgcgtcaagctgtgacagaagcagtaaggaatacttcgacgttaaaaaaatgtttgagagcaatttaaaatatattattttaacatgttttctatcagccttcatcacatgacagaaatacttttaagttagtcccaactttatctaaaatgcagcaatctcattccaagtgaatcagagttgttattttggaatcaagctgttgctttctatatcctggattgttctcactgttcttactttaagagacataatactgatatgatacttgaatactaccagccttccagtgtaggaggtaatgaagtgagcattcagatctgatctaacctattaagtagctcaatttcacctgcaattaaaattagacatcttcatgcaaactaaaatctgttgctgtagtgaagagaagaaataaaagaatgccattttgagaattccagcttccaaaatagcaaacagggaaatctagactgtgttcttttgtaaggtagaaatgaagactaaaagttaggttttttttttttttcttcccattttgccaatacaacttcattctaaaacatagggattctttcagtcagtcaaggagtaactcacatgccaccatcttttattcaaaggcaggcacagatgttccttctgcaggggaggatttaatttatgaaaatgatattgtttatgcatgaatgaactgcatgcactctgcataacacatagcacttccatctgatcagagaaataccacagaaccagtgccaatgtcagaaacatattctacaaatttactcacttaaatgtttaatgaatatttggaaggcattttcaaaccataagaaacattttaaattatcttcttttatgaattcctacccatatttaaaagagactcttacagtttttgtaattggctaatgcttatacccagtttgtaagaaaagaacatattttactaaatgaaaaccaaccaaaaaaaaatgctggcaagtttggcttcactggaaaaaatatttcgtttagttttgctgtttaatgcttgtcatgaataatatttgggattctatctgtttcttcatcttgagccacgactattcctatcaaataagatgcttaggtatacttgtttaatgtgaaaatcctatgaatagttatttctagaaaaagctggtatgtaaaatcagggggaaatttcataaagatgaaattgggctaaatattgtaacatgcataattactattgaataggaacacttcacataacatattttactttatataaccaattgcagctatatagtatgatctatctacttttaatcattaaaacaattatatataaattaaaatgaaagattataatatcaagagtgttctactaattttaggtttataatatgttacagtaaaataccatttgaaataaattttgtgttctaatttatcttaaaatctctctgtttttacatttgaaagtccttacattcttacaaaattaatgcattttctgaaagaagctagcaattactaaaatgatatatggatcattagctaacagtttgaatcaagctgttttagttctataattatacaagaaatttaaagtgaaaatacctattaagcaattaataaaactaggtttcaaaatattggctaattttctcctaatgggaaatgtaaaatagcaaaactgcttcttaaactacacaaaaacctcctcacttctccttttctctctctctaacaccacttatttcctgaaaatcatctaaataaaatatttaattccagggtctgatgaagaataaaagagccaatgcaacatcttgtggaacaccaggactgagaactcttgttgttaccattgcaaagaggcgttctggcgtcagatgcacagtgatttgtatggtggcataatcattggctcctggccaggcattatgtttcagaggacactattgtcaagaaccattcaactagaaatctgcactgtatgcactcaaaagttgagatcatctgccttcctatgacaggaagaattctgtgctggcaattgactcatggactctcttcacatacactaaggcttggtccagtggctctgatggaattaactgtgcagccaaactagtggcattgacaagacagggccacagtctctggggacttcaggagaaattgctaattttaaaatgcagagtattatgttaatgctggattaaatcttcagatacattaaatgtggatttggccatctaagcattattatgttatttgcccagttaatttagaggtagatggatggtgacaataaccatctctacagatccacaattctaagagatggatccaattgtgaaatgatatggagagatagagtaagttcaatctagcatatatgaagtaatttggtaactgacttttcttttaacaagatcaaaagctaacctgctttacactttcatgtctaaggacagccaaccagagagatggcttcacacactagcccactgctaagtgcttttcattcactttcatatttcatcatcaaagcaccctcctgccttatttatagatggggaaacttcaggaagttgagatacctagatatttgcattcctgtcttcctttcttcattcaggtttttctttcattgccacttcctcaaagaagcttttactgattcccatttaaaatagcaactgacttcaactccaccaaaatcactgtattgcccctccctctttccagagcatttgcctatcaaatgttatcttatgtatttacttgtatagcttaattttaaactatctatctctaggtcttctgagcacctgagaaacagagacaaagttgtctcttctgtgtgttgctgttcctctggtgcttagaagacctagaggatcctcaataaatattaactttccaagggaactgaagagcactaatgtgatgctaaagcctgttgccttaaccactatgctataagtcaaatcagttgagaatggagaggaccacaaattattttcagtccagcaagtgttataaacattaattctataaaaagaaaacaattgaaactaatttcttattatattgcatggcaccaaactccccccacttcctttttgaggatcatgagttgtctgtcattgtttctttttattgatatcaattggttaaatataatctggaattggaataaaagaaaaactattataggctttttccagaccatgtatttcaatgcatattattttttcctttctgttcattattctttcagtaattgcacttgttctatttttagtgttatgtaaaattactgtagctcataatttctattttgaagggttcagtgtataaacttagcacatcaatactatctttttagtgttcgcgctcaatggtgtcagttaagagatcaccatcacttttggtgacgtcaatgaaggggtattgcaatgcttaagagaactgttaatccctttccactggtgtcactaacaattgtagtgcttgtttattcatagcaggtacgtgactaagtaatgttaacatcaaagcagaaagaggataatagagtgttctaaaaagaaaattcggtggttgggtgcagtggctcacacctgtaatcccagcacttttgagaggccaatgggggtggatagtttgagcctaggagttcaagaccagtctgggcaatatggtgaaacctcgtgtctacaaaaaatacaaaaactagtggtgcatgatggcatgcatctatagtcccagctactcgggaggctcaggtgggaggatcacctgagcctggggaggtcaaggctgcagtgagacgtgattgtaccactgtactccagcctgggtgacaaagtgagaccctgtctcaaaaaaaaaatgatttgagataacatcacttgtcattgtttgttaactgaataatctttattctagccagtgcctaaatacataataaatgatagtacaaatggatataaattataactaaacctaagtagtgatatttatcacaatatttctttactagaagaatttctttgttaatagaggcaaggctacttgtttagataccttaaaataacataagatttttggataaataaattaatgattctttgattctgactggcatattaaaaatattaagcgaagagatctttgcttcccaggttttattttttgtctaattaactactggtgcatttatattaaaacatattgtcaagggaaaacgtatatatatatatgtgtatatatggtgtgtgtgtgtgtgtgtgtgtgtgtgtgtgcacacatatgctatacttggttgagtagtatccccttcccttgcccacctctctcccaaatttatgtccatccagaacctcaaaatgtggcctcatttgaaatattgtctttccagatttaattaagatataagatgtaaattgatacaagttcatgctggattacggtgggccctaaatccaatcactgatgtcctgataagaagcagacagaacacacagacacacagcatacaggaagaatggcatgtgaaggcaaagacagagactggagtgatgtgtctacaaatcaaggggccccaaggatttggggcccacatcagaagctgggaaagagacaggaattctcagcttctccttctgaatccctaagaaggaatcaaccctgctgacaccttgattttaaacttcttgtctccagaactgtaatataatacatttctgttgtcttaagctacccagttgctggtgatttgttatggcagccctaggaaactgataggtatactaaaatctctaatgaattgatgttaaatatatataagtataggagagttcatttaaattcttctgaaaatgtcttcttaaacttttaatgatacagtatataacaaccagtatacgtagttggtatcgggtttgacatttaaacaagctgacaaaaaacagctgtttaataaacatctgaattatataaaagttttattgtttattattcatgtgaatgacttaaactgacatctacatttagtgaagtgtgaatgggcctagccaataaactatgggtaatttttttaaagtctcatctttgaactcacaaaaaattatcaaatatcagctattatgtattcttcatgtgaagaaaatgtcatatttatttgatttgtggattagcatatatattaatagagcttttgaaagaacaaatgtagcactttcccgatttcatagacactcatttaacacacaagttcatattttaaagtacataattttaaaaaaattctagtccaaatgaatttaagtgccatgacttctaaaaattctgtctctatttttgggttttataggaccttgagccagtactcttctggtgagcttaagaggctaagacttcacctttagttatatggggctttcatctgattatttgtctattttgattgctctaaatacaagttagtgtgtatttcatctgaatgtatttcattataagttttggttttatgtagatctggggatctgtcttgtttttaatcttgattggtctgtttgttttgggatagttggtactttcatttcttatgcttgctttctttttcattttgtgcccacctttagtcaggtgaacatcagtaaggaataaaattttatttttttaagccactgaaaaaatttaaaaaccacatcataactctgcctctgctgactgataaaaatgctaacttattaagacaaaatgttatgcaagaagactttattggaatagagaaacatcctttttatgtaagaaatatcaacagagacatgtgcctttcttgtgacaaatgtggtatgtgtgtggattagaggtctggaatgtggcagcatttcagtacttggaggggagaattagagtagggtagaaagatagacggggagcagaggatgattctcacccagtagaaagcagagtgaagaaagaaaggggaattgttttttgcattatattatttgaactgtggattaagtctttccataagccatccctacgcctctaagtaggttttattaacttaagctggtttgagatgggtttttggtcacacacaagaattgcctgatacaagagaggctttgattttgttgttgcttgctcatttttatacactaagatggagaaaaccctggacatagtgaagacgaaattgaggaaggtgttgggtagagtggagggtagaagacctgtaacataggtacagaattacattaaactggaaggacttatatccagatataggagtcagggtagaaagagagaatgttagcagtaagggtaacagagtagcagaagtttattcttaccaggtcctgttatgtgacagtggaggcatgttgaccttctgactaggggagttaaaggagaacactgaaggtttagaataatgtctctaaggatagaaagagaaagtttcatcaagactcatcaataatagggcagcagggcttagggccaagcaaattcagagaccatgatattatagtagtttgtagtggtcttaatccatctaatttttcagcattttctcaatggccaatacttagcagtggtagtgttttatggcatttggacaacagaagtgaaagcactggtaagagagacgttgaagtgaaacaccatggggctcagaaaagcagagttgatccatctggtacatgggcaaggatggtcctgaacaattctgcagtaagttggaagatagaaaaaatacctaacgaacttgtagatctgggtaaggagatttttggcagaatattgtaaggctaattggcttctcttaactatatgagatagggttttacaagggagagataagcgagcataatttagaagaactatagggggtcccaggcagactctctggctggaaaattattctgatagcaagaaattagccccaaagcaaagatgaaaagtagggtacttccaattaaacatgtcataagggcaagcctcaatcaagagtgtggctagaaggcacagctcacctggacaaaagtgcttctaagcatattaggagcatataccacaataacctgacttggacccaaagttgagagaggccagtctcaaaaaaatttgagggaattgcttttgcataatatgatactttatatacatatctgttacatatcatatatatcatattaaaaagaaaaaaaaccctgtttttccttccgttctttcatataacccttctgacaacaaatgtggagtttttcacacactaagcaattctttagttcttgctggacacttcctggatgtcctacaattcaactcgattctcacacaactgcccagagtcagtgcagacccgcagattaaaggcttagccccaaaagactaccccccactttagatgtcaatcacaagtctcaacttcatttacttctgaaggacgagctatacattggaggaaacccctctttctttcaataatttgctagaatggctcacaaaactctgggaaacatttacttatggttaccaatttattataaaggatataactcagaaacagccaaatggaatagattcatagggtgaaaaatgggggagaggcatggagcacaactctctcagcacctccatgtgttcaccaacccagaagctctcagaactccttcatttagggcttttatggagctttatcaagtaggaatgattcatgaaatactggcattggtgattaacttaacctccagcccctttcccctccctcaacattgggggtgaagctaaaagttccaactctgtaatcacagggtgagcttccctggcaactagtcccctgatccttagggggcttctgaaagtcacctcattatcataaactcaggtgtggttgaaagggatgttttgaataacaaaagatgcgcctttttcctttatctttctgagttgtttcaggagctagggacaaaagactaatactataacaacaacaacaaaaaattcaatttttgcttttatctcttgggaattacaaggattttaggagctctgtccagaagccagtgatgaagatcaaaatacatatttcttattatatcacaattcacacatgtacatgatatccgtaagataagtgaactacataaagtaagctcacaaagtttctgtaggagttttgtccatttacaaacagtttgtaagctaaaagtatctgtgacaagcctcagtcaatttagaagttcatttttccaatgttaaggacatgcctgtgacacagcctcagaaggtcctgatgacatgtgcccaaggtgatcaggctacagcttggctttatacatttagggagacataagacatcaatcgatacatgtaagatgaatattagctcagtccagagaagcaggactactgaaagtggaggcttgcaggtcacaggcagattcaaaggttttctgattgggaattggttgagttattatcttaagacctggaattaataaaagggaatttatcatgcagatgaagctttaggtagcaggcttcagagacattagattgtaaaggtttcttatcagacttaaaagagtctgttctaacagtctttaggtctcagtgttgatgttaatgctggtcagctgtgcctgaattccaaaagggaggagagtataatgaggcatgtctgagtcccttttcccatcatggcatgaactagtttttcaggttaactttggaatgtccttggctgagaggaggggtccattgagatggttgggtggcttggaattttatgtttggtttacaagtttaacattaaaagcctctgtacctccaatgttttatggacaaaaagaaggctgaaaaagctacttggctgtaatcatgggccatttcttgctgaaaagaagaataaaatggaggcagaaccaaaagcccagaggctagagccaagagctgctgagaatgatgaattagggaaccactctcagagagcagatctggatgtgagataggaacattttctttctcagggtctatgaaactggcaacatatgctctcctgaatttcagaattgctatggaccagtgactgtgatatgctttctatatttttcccttttgaatgggtgcatctatcttgattatcctctgtctcattattgtatgttggatttgtgtgggacgataacatgtgtttttagttcctaggttcccagaataagaggagcacactcaaagagcgacatttatgagatactggatttttcacttgatatcataattgggtgagacttgaaagaaagtgaacatattttgcaaatgggagggatgttaaccactgacaaccacacccacagggtccactgtattagcctatctgcaaagacggctgccaaaaattccttctgtccatatatacattcccttttttaatgtgactgtttcacctgccagcaactgaagggctttatttccatttccccttgtgacttgtttgactaacagcaagaagcaaaagtaatgctattccaattctagacctgggccttaagaggcatgacagcttctgcttttactctcttgaaactcaatgtcattttttaaaagctcaggctagactactcatcatgagggaccacatgaaaagagataggcccagctagtttccacccattccagccgctccagatgagatgccagacatgcaaatgaagccatcttggatatttcagccccagctgagcttccagctaaatgtaagtacattcagttgatacctcatagagcggaactactgagctgacttcatccaactcacagaatcataatgaataacaaatcattgttgctttaagtcaatacatttaaagtttttttgttatccagttgtagatgaattatacagcctggggggaaaaaggagatagcacactgttagttgcctcatcaatattcatccccaaattctttttcctttttagtaggtctcacctcccacctggaagctgaaaacacctttcccagtctctctggaagctacagcacaggcatgttgcccaattctaaacaataggacatgataggaggtctgctgggtgggatttttgaaaatatttttttttctggttaagaaaaaagaaatgcccaaggaaaacctacaaatgccccttccattcttgcttttggacattttttgggagagggtatgatgcttagcactcctgcagccatctcggggccaacaatagaatccttgttgctacctggtgatagtgaagtagaaagctacaaagctcttgatttcttttcttttttttttttttttaaattttattattatactttaagttttagggtacatgtgcacattgtgcaggttagttacatatgtatacatgtgctatgctggtgcgctgcacccactaactcgtcgtctagcattaggtatatctcctaatgctatccctcccccctccccccaccccacaacagtccccagagtgtgatgttccccttcctgtgtccatgtgatctcattgttcaattcccacctatgagtgagaatatgcagtgtttggttttttgttcttgtgatagtttactgagaatgatgatttccaatttcatccatgtccctacaagggacatgaactcatcattttttatggctgcatagtattccatgctgtatatgtgccacattttcttaatccagtctatcattgttggacatttgggttggttccaagtctttgctattgtgaatagtgccgcaataaacatacgtgtgcatgcgtctttatagcagcatgatttatagtcctttgggtatatacccagtgatgggatggctgggtcaaatggtatttctacttctagatccctgaggaatcgccacactgacttccacaatggttgaactagttcacagtccaacagtgtaaaagtgttcctatttctccacatcctctccagcacctgttgtttcctcactttttaatgattgccattctaactggtgtgagatggtatctcattgtggttttgatttgcatttctctgatggtcagtggtgatgagcattttttcatgtgttttttgactgcataaatgtcttcttttgagaagtgtctgttcatgtcctttgcccactttttgatggggttgttttttttttcttgtaaatttgtttgagttcattgtagattctggatattagccctttgtcagatgagtaggttgcaaaaattttctcccatgctcgtgggtaggaagaatcaatatcgtgaaaatggccatactgcccaaggtaatttacagattcaatgccatccccatcaagctaccaatgactttcttcacagaattggaaaaaactactttaaaattcatatggaaccaaaaaagagcccgcatcgccaagtcaatcctaagccaaaagaacaaagcttggaggcatcacactacctgacttcaaactatactacaaggcttcagtaaccaaaacagcatggtactggtaccaaaacagagatatagatcaatggaacacagcagagccctcagaaataacgccgcatatctacaactatctgatctttgacaaacctgagaaaaacaagcaatggggaaaggattccctatttaataaatggtgctgggaaaactggttagccatatgtagaaagctgaaactggatcccttccttacaccttatacaaaaatcaattcaagatggattaaagacttaaacgttagacctaaaaccataaaaaccctagaagaaaacctaggcaataccattcaggacataggcatgggcaaggacttcatgtctaaaacacgaaaagcaatggcaacaaaagacaaaattgacaaatgggatctaattaaactaaagagcttctgtacggcaaaagaaactaccatcagagtgaacaggcaacctacaaaagctcttgatttctaatgacatcatatgggatgaaccaacccaggaacagcctgactctggacctcttttaatgtcagaaataaaatcttatttgtaaaccactcttagttgttcaggttgttgacacaggcactgaagtgcctccaaatggtgatgaataatgaggcaaaagtcaaagacagcaagtctagtgtcaaattttttgatgcctatgggtaagaagttcaagaaagtgagctattttctttctttttaaaatttatttttatttttgtgggtatatagatgtatacattagtcagctattttcaatagtgagaagggatgttgccacttagtataatgcctttttcatagctatcatagaaaccatatatacatatagtatagaaaatgaggatagatttctgacttaaactgcctatttcatttgtgtgcctggttacacctaattcaagactctacaatacagcattgctagcaattactgtgagaatatttcaagctccctatttgctggaaatacatttcatttttttgttccaagtttatgaatattagaacctatctaaaaaggagcttttaaaaacttgaggaaaggaaaagggagggcctacttttcttgcctgtgttatttcttgttactgctgattgagatgctagagatcatattgggtgagatgtgtcttagaatacagctgagcaattcacttttaacagtttccatctgagtacaaaaaactggtatgtgcagaaaacttgatattctgacttggcgggattctaggatttgttctatttttttctgtaattgttgtagggacatatggccctgtaccttttgggcagcaggagccagaatagcaggaacattctgacaaaattcccactcagcatgagagggaagcagtccccttgatacactgatgatgtgcccacttagcattacaagtgtttgagaggtggacacaactaaaactcacctcactcaaaatatatattgacacggagaaagtaaatacaatttgctgttattaacctttcttctcaccattgagacatgttaaatatctgaaattaataaaggaattaaatttaaaaagtttacttatcatgcatttaacacatttattgagcatctgttatataaatgcactgtttcaggcacaagagatagagccataaataagcagattaaatcactattctcaactgaggtactaatctgatataagagaggagacagaaataagtaaacattataaatcaactacatacttttacatggtgtaaagtgcaattaagaaaatattattgaatagaggtcaattttggaatggttgggcagggaagaccttctgaggtgacaagaagttggcctgggcaccatggggagctctaccatggtgaaaagtgttccagacagagtagacagcaacagcagaggccctaaatgagaatgcacttggcttatctggagagtagaatgaaggccagtgtggtaggacacatactaataataggagaaaactgatagaaaagagggtttgagcaggtgggcaggaattggacaacatggtgtctcatatgtcataatagaagtttggattttattctacctgcagtgagaagttcttaataaaaaaaaaattctataaactggagtttgagaaagaactatgttgatgatagcataagccctcaatcacttgtcacataaactccaaacttcagcagagactcagggagatcaaagggactaccacaggattacccactggctaaaattcagatccatggcagttggtcctgactggaattagacttccttgtctgttgccctcattgcagtgggtctgaatgtctctgtcggctgtgaatttttctccctctatctgtggcactgagaaggtggcccagacttccagagtctgtctcattggcctattacttggggatttgctgcccttcttctggaagtttgggtatttgttttcagagcatacttaaaggcctcctgaaagcaatgttaacaatagcaggatatattttacagtcttctactcagacttggatttttaagaaccagggatggagactgtgtttccagatctagtcaaatcccttccaaacataaagcaacaaagtgccttttaaactaggacctgtactgtttaatgctctggaaacaaatacccaagcttcagccaaaggagggaaagctatgttcaggaagcttcctgaaagttttttgaaagcaattttcatgcattagtattttacatatatatatatatatatatacacacacacacacacacacatatatataaacatatatatatatacacatgaatcactaatgagacaattgatcttcaggaactaacgtgaaataattggggtatcttggtattattgttatagataaatgttgaagaagttcattctttcagatattaattgagcacttactgtgtactaagaactgtgatagatactggggatttaatggtgaacaagataaattctctgccatcagggggcttatattctaacaaacttaaaatttactgagtgttctctgtatttcagtattgttactaagtacactaacttagtggggaagctagacaataaacaaagaagtatgtaataagaattaatagtaagtgctgtaaagaatactaaagcaggttatggtagagagattaatggcagcgtgaagatgtccatgtttcaatccccagaacctgtgaatatgttaccttacatagcaaaagaggctttgaaaacataattaagggttatctgggcaggcccaatgtaatcataagagtccttatctaagacgggggacaaaggtcaaagacagaggaaaagagacgatttaaggatagaagcaaagaggagagatgttagactgctggctttgaagttggaaaaagtgaacatgagccaaaacaaacaaaacagaacaaaacaaaatccacaggtgacctttagaaaaggggtccccagtctctgggccatggaccagtacctgtctgtggcctgtttggaaccaggctgcccagcaggcggtgagtggtgactggtggacaagcaagttttaccacctgagccctgtctcctgtcaggtcagtggcagcatcagattctcatagcagcctgaatcctactgtgaactgcacatgcaagggatctagtttgtgctccttatgagaatctaatgcctccaaaatgctcaccccttcaaactgcccccatccgtggaaaaactgtcttccacaaaaccagtccctggtgccaaaaaggttggggactgctgctctagaagccagaaaagaggagatatattttcctctagagcctacagaaggaatatataggcctgctggcaccttgattttagtcctgtgaaactgattttggatttctgacctccagaaatgtaaaacaatgcattggttttgtttcaagtcactaaatttgtggtaattagatacagcagcagtaagaaatgaatacacaggtttacaggatggtgaattatggagggtgctcaggaatggcctctttgaggtggtggcctttaaacagaaaaatgagcaaagtgaaagaatgaaccatctggtggggagaaaagcattccagtcagagggaacagcaaaagcgaatgctctgagaagggattattcttctcaatgtgtttgaggactggcaagaaggctttgtgtgaatgagcaaggggaaaaagttagtaggtgatctcggagacatagccagggtccagattataaaggacctctcgccttgctaagcattttgactttattccaagaataatgggaagtcaatggaaggctgtgagcagggttatatgctctcgttattttttaaaggcacaatgtaactccaaaatggaaaattggctctgggctggaggtgccagcacaggggaaaccgaaagcagagagctgggttgggagagcggagactgaagttgtccagctgaggggtgcagaagtgcagactgcaatgacagcaggcagaaaggactatatgttctagacagaatggacaggatttgctggtagattggattgaaggcatgagacaaaggagacatggatgatatcaaggattttgatactacagatttgaaacattctgagagggacaggtttgtgatggaaaatcatgagtctggttttagatatgttttagaagcttattggacagccaagtagagatgtcaggtagggagctggacataatacctaaagttcaggagagtggttggagctggtgacatcatttgcagaaccctggatggtacataaagcacgggacagtgtgtggatagatcctaaagagagccctagggcactccagccctggaagaaggcagcttatcaaaggaaaaagaaagaaagaaggaaacacaatccttattacttccatcttcaggacaattcaaagccagtgtttttgacttcctggcttgagtgaagcttgaaaaatggcaacttgcccctttgcaaagctcctaaggagtagccattggcttggcctgtttgcactggctctgggtgagcttttaaaatgccagtgagctctaattgtgttgattgcctaacagctgtgaatacaagatgctgactccagaactgcaactcattctgcgaagggcaccgtccttttccctctaatgactgctgaacagagccacctgaagcctgcatggggtttagcagcagctgcacttctgctctaagaaatagctcactgcagtcagatcaaactgaagctcttccttgcttttcctcgaagcttgggtacttattgtcggagcattaaacagtaagagtcctagcttaactggtgcacagtgctttatgtttggtagggatttggttaggcctacaaaccgtctgagctaagaaccttgagaaactcctgctatagttagctctttctgtgactctgcagtgtgaccaggaatgaggacagaattaagaatttgctgcctctatgatagaactgtttaggcactagaacactggaactagatctacaaccctatgaatttaatttccttttcaactcccctactccttcttttcaatatgatgataatgatcttgtttaaaaaaaaaaaaagccttctgctttacttcccactctgctcctcttcccagggactcactttcttcttgactgcttccccattacaagtactcagctccctgttttatcaccctgcttagagcagccattatcagccttggctgaacattggaattacctgggaacttttaaaaatccggaagtctgggtctcgcctccagagattccagcttagttgtcttgagcgtggcctggacatttgggttttcaaaagttccctatgtaactttaatgtgcaaccacaattgagaatcactagcctccagactctctgtgttatcaaaattaatgagcagctgattttagaaatctcagttatcaggagaaaagggtgaacccccccagggctcttctccttttccaggtgacacttctttatggcagtgcgtgaaagtgaagccctgctgcttgtaatctccctcaagggagtgcaagatccaggcaaagacaagactgcagaggcgctaccttgggggaaagtaggaccctaaatacttacacctggaggcacttacctttaatactgaatttgtcagatgcaaatttgtctatgcaaaccagggccttatctctagcttcccctcaggggttttgggaagtgcgctactactctgaaacagggttgtaaagcgtcacctgtgctctccagggaaccctctggaaaggaggtggaaaaacagaggcttccacccttgcaactctaagtgtgttccttggccagtgggatccatcacctagtattttcttagatatgtggtatctgggggccagtcccacacctatgcaataagaatctccatttgaacaagatgcccaagcgattatatgcaagtttaagattgaggagggctggtttaactcgagggtaacgaaaagtacgaaatcgtactttacaggagaagctaggcggagggagccacttattcttcctcttgcagctgggtctttttgtggtgagtggcgaagcggcgaggctggcaggccagggtgctggactgggtcaggcgcggccccgcctccctcctgggtccctgccctgcgcgccgttgctgtggcagcgctggacgcggctagagctggggctgccgcgccctccacctccttctccaaaggcctccccggacccctggctcgggcccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgagtgcccggccccaagcgtcttcgcctccctccgcgcttcctccctctccccggcccaaggcctacacccacgagcttttgctccaccctccccttttctcgcctcccctccccgtgctcgcctcactgcccggacaggttaccgagtccccaagtcgccgcctcctccttcccaactgggaactcacgcctctcgccccatcccagaacccccagggattctttcgctacctagccttttcccgcctccgagaccttccccgggcaaacgtcacaagcagcttttgctcagagtctcagcagaaaatcttgagccccaaaggggaggtaatttacaaatgtgagaaggtcaactactcctcccctccaagttgaaaaagttttaatccattaactttgatggtacattgaaactataaacatctcacagattatgcctacacaagagttctgaatccaactctcattttgctgacttgaaaatgtaactccagagctttgggagtgtttctgggtttttttctgcccctcaccttccttgccattgtctagaattaagacttcttcaggctcggtctagaaacttttgatttttaatattgaccctagattattggatcacagttttgcgatgcttagttacgtcaagcggtttgcttaacgtttgccttttattgacttaaaattttagttacctaaaaaagttataatgctgtagtttacaacaaatacttcgagtctattttcacgtcttagtcaaatagccttatagacttaacagatattttataaagaccattttgcaagtcttataagtagactttcatatagtcttatttctaagtccaaactcgagaaatactccccattgttgaattagcttagatgtgagcggtgaaagacagatgaaatgggggaggaactacatcaaggttactctacttgcgaggagatgacttgggggagatggaatttggtattcaacctcttttagctaaatacaaatttatgaaattaaaaaaattgccttcccctgttggaaaacaagacacagtgtggtatttatgttacagaatagactcactgtcttaaagtcttgctcaaaagtctaacaaaatgaaaccaactagccagggattcagcactggttgcgattgtgaattctgcctgtgctgcatgtgccatgctcgctcgcttcacgaaaacagtctttgaccttaaagtgttttcaggtgttttaaaaaccaaggtgtagtattttcttgaaccttttaagttaaaagctagggatatagctatggaattatttgtaagtctttcaggcaattcgagttatgcaatatagaagtttataattacagtttggattagcccaaagagccagtttaacctacagtgcagctgaaatgctatagaattaaaatgagacattgtgcaatgagaggtcatacaaaccaatgttgcagtatttgtgtacaaaaaaagcaaacaatgacatgagaaaagaaatgctgttttatattgagtggtgattaaggtaaaataggtttaattagtgcacccctggcagtagagtttaaaatacatcttgacagatttgtaactttaaaggttgcaagtactgattctttgtttaattatgccctaaaaccatttggtggtcttttccttcatacaggtgtaccctttttctttgtaattaatacctggtattcaaaccactttgggcctctaaaattgggggcacagaagcctagagccttagtaagtacttctgtttatggaagaaaccaagagatgttttatttaggtaaaatatagccaggcgtggtgtgtccctgtaatcccagctacttgggaggctgaggcaggtgaattgcttgaacctgggagttggaggttgctgtgagcggagatcacaccactgcactccagcctgggcaacaagagtgaatctccatctcaaaaagcacaacaaacaaacaaaaacaaacactgggaaataagaaggagatattaagagatgatatatttaaatgttagaaatgctctgttgttgaataagcttagatgtgagtggtaaaagattaaatggaagagggagctacatcaaagttactgtacttgggaggacatgatatggtaggatgtggtggggggagagcatgtccattgctggttggcaagtgactggctgcctcagaaaaggatgagggtgggtaggggagatcactggagattattagaacatacgtatgttttcaagattgcttagtttttaaacctcatagtactttgttttcactgatgaaataaaatactatgtgatctttttctaattttccatcttgagtaataagcaaagacattaatgtattttatgaaggctctgactgccaaaattgggacaaattgatggtcttgttggcagggtaaatgagcataaccgtagtaattgtagttctttttattgggttcagggatgacctggaataatggatgtgttattacccttccctgtagaagtgaggctttcgaaaagaggctataagtcaatttgggaggcacaaagtatcagcgctttttggggattttttttttttttaagtagagaaatattttaaatgtgtgatataaagttatgcatgtgcttcttaagcacattaactcaaccagatccaacagctggtctaataactttttaattgtttaaaaaaatttaattgacacattgtaattgtatatatttatgagatactatttgatgttttgatatttacgttgtacaattatccaatcaaagtagttagttatccttcacctcacactttcattatttccttgtgggttagaacattcaaaagactctcttctagttattttgtaatatatagtattttactgttaaccatagtcaccatactatgcaacaaaacaccagaatttattcttcctacctagttgtaactttgtgtcttttgactaacctctctccatccttccttctcccctccccttcccagtctctggtaactattctaatctctgccttatctatatcaaccttttataatagaaaaagattctacatgtgagtgacatgtggtatttgtctttctgtgtctgggttacttctcttaacacgatgtcctccaggcttagcattcacaattgacaggactttattttttaatggctgactagtattccattatgtttctgtatcacattttctttattcatccattgttgtacgcttaggttgattccatatcttggccattgtgaatagtgctgcagtaaatatgggattgcagatctcttcaacatactcattttatttcctttggatgcatacctggtagtgggattgctggatcatatgatacttctatttttaattgttttaggaacttccatgctgttttccatattgactgtactagtttacaatcataccaccggtgtgtaagtgttcccttttctccatatctgtgtcagtacttattttcttttgtctttttggcaatagccattctaactggagtgaggtgtatctaattgtggttttgatttgcatttccctgatgattagtgatgtcaagtatcttttaaatgcacctgttgatcatttatatgtcttcttttgagacctatcaattaaagtcgtttgcccatttaaaaaatcaagttggccaggcacagtggctcacgcctgtaatcccagcactttgggaggccgaggcgggcagatcacgaggtcagaagatcgagaccatcctagccaacatgatgaaaccccgtctgtactaaaaatacaaaaattagccgggtgtggtggcacatgcctgtagtcacagctacttgggaggctgaggcaggagaattgcttgaacccaggaggtggagattgcagtgagccgagatagtgccactgcactccagcctggtaacagagtgagacttcatctcaaaaaaaaaaaaaagtcattattattttatctgttgaattaattttcttatatattttggattttatccctttgtcgcatgtatagattgcaaatatttttctcccattctgcagctgttttcactttgttaatagttttcttcaaggtgcaaagttttttagtttgatgtaatcttattttgtctatgcttttgaggtcttattttaaaaatccttgctcaggtcagtgtcgagaataatttcccttttttcttgtaatttcatagttttcaagttttacattttaaatctttaatctatttttatttttgtatatggtgagagggaggggtttaatctcattcttctgcatgtgaatatctgattttcctagtaccatttgttgaagagactgtctttttcccagtgcatgttcttgacatcttaaaaattcagttggctgttgtaggtgcaaaaatttatttctgggctttccattttatttcatgggtctgtctggttttatgctagtaccatgctgtgttgatatagttttatcgtatatttcgaagtcaggtagtatgatacttccagttttgttctttttgctcagggttgctttggctatttggggttttttttgtggttctgcatgaattttcagattgtaacatttctgtaaagaatggtgttggtattctgatagcaattgcattaaatccatagatcactttgggtagtatggccattttaacaatataattatttcaatccatgaacatgtactatcttcccatttattgatgtgggaagataatttctttcatcaaagttttatacttttcagtgtagagattctttcacttccttggttgtttatttctaggtatctttttttttaaaaaagtactataaatggaattgttttcttgatttttcacatagtacaatattagtgtatagaaatgctactgatttttatatgttgattttgtgtcttgcaactttactgaattctaacagttcttttgtggagcattttgggttttctatctataagatcatatcttctgcaaacagggacagtttgacatgcttctttctaatttggatgctcgttacttctttctcttgcccagtttatctggctagaactttcagtagtatgttgaatagaaattgtgtaagtggccatcctttccttgttattgatcttagaattgatctcgttattggtcttttcccattcagtatgatgttagctgtggatttgtcatatgtggcctttgtgttgaagtacaaactttccatacctaatttgttgggtttttaatcatgaaattatgccacattttgtcaaaggcttttaatgcatctattaaaatgatcatacagtttttgtctttgttaatgtgtatcacatttactgctttgtgtatgttaaaccattcttgcatgcctctgatcccagtgatgaatcgcacttgaatgtagcaagttatctttctaatgtgctgttggatttggtttgctaatatcttgagaatttttgcacctatgttcatcagggatattgtactatagtttcctgtgttgtattgttatctgattttggaattagggtgatgcttgactcatgaaatgagtttggaagtattccctttgcttcagttttctgaaatattttgagaggaattgatattggtttgttaaatgtttggttgagttcagcagtgaagccattcgtttctgggcctttctttgatgaaagactttattactgattcaatttcctcacttattattggtctggtcagattttatgtcttcctaacttaatcttgataggttgtatgtgtcggggacttcgttttttctatgttatcaaatttgatgaaacttgttgaaaaccaactctaaattttgttcatcttttgaaattatttttagtctctatttcatttatttctcctctgagttgaattacttccttacttctaccaactttgggattagtttgttctgttcttttttttctttctttctttttttttgagatggagtttcgctcttgttgcccaggctggagtgcaatggtgtgatctcggctcaccgcaacctctgcctcctgggttcaagcaattctactgcctcagccttcctgagtagctgggattataggcatgtgccaccacacctagctaattttgtatttttagtagagacggggtttctccatgttggtcaggctggtctcgaactcccgacctcaggtgttctgcctgccgtggcctcccaaagtgctgggattacaggcatgagccacaatgcctggccgattagtttgttcttaattttgtagtgccttgaggttcatcattaggctgtttgtcagaaatctgttgtcttttttgatatgggcatttaatactataaacttacctcttaaaactgcttgtgctatgtttcgtaggttttgttatggtatattttcattctcacttgtctcaagaaaaattttaatttcctttttaatttcttcactgacccattggttgtttaggagcattttgtctccatgatttgtgaagttgtcagtttttctcattgttgatttctagtttatttcttttctttctccttccttctttccttccttccttccttccttccttccttccttccttccttccttccttcctccctccctccctccctccctccctccctcccttctgtattgctttgtctcccaggcccaagtgcagaggcacgatcttggcttactgcaatctctgcctcctgggctcaagcaatcctctcacctcagcctcccaagtagctgggactacaggtgtgtgtcactgtgcctacaggtgtgtgtcactgtgcctggttaaatttgttttttgtttttgtttgttttgttttgtatgtttagtagagatggctttcgccgttttgccatgttgcccaggctgttctcaaattgctgggctcaagcaacctgcccaccttggcttcccaaagtgctgggattacagccatgagccactgcacctggcctgatttctagtattataacgctgtggtcagtaaagatacttgatattatcttaatcttttaaaatttgttaagacttgttttgtggcctaacatgtgatctctcctcaagaatgttccatgtgcatttgagaagaatgtgtatctgcagctgttggacggaatgttctgtaagtgtctgctaggtgcatttggtctatggttcagcttaagtccaatatttcttgatctctctgtgtgtgtttgtgtatgtatgtctagataatttattcattattgaaagtgggctgttaaagtctcttactattattgtattggagtttatctctttaggttgaatatttgctgtatgtatctgggtacttaggtattaggtacatgtatgtttataattgttatatcctgttgttgaattgatccctttatcatattatgaccttctttgtctctttttacagtttttgacttaaagtctattttgtctgatatgagtattgctactcctgctcacttttggattctgattgcatggaatatctttttccatttcttcactttcagtctgtctttaacggtgaggtaagcctcttttaggcagcatgtagctgagttttttttccagtcctgcagctactttatatcttttcattagataatttatttacattcaaggtttttattgataagaacttatttctcccattttgttacttgttttctggttgtcttgtagattctcagttcttctttctctcttgtttacctctgtggtttggtcattttctgtggtcctaagctttgttttccttctatctcttgtttatgtatctgttgtaattgctttctttgtgggtaccatggggctaacataaaaagtcttgtagttataataaactattttaagctgatagcaagttaactttggtcacataaaaatactctagacttttttcctccgccatccctaatttatatttttgttgcctttatttctttagtatgtgttccctagccattgtagctgttgttgtttttgaccagttgtactttaaaccttcatctagaggatcgacaggtttacatagtaacatgatatcactggggaattctgagttggatttatacatttacctctattggtgaggtttatattctcacatgtgttcatgatagttatcattttttcatttacagctgtagcactcctgtaaacattgcttgtaaggctggtgtaggagtgaattccctcagcttttgtttgtctgggaaggcctttattctcctccaggatagttttgctggatatagtatcttttgtccttggccgagactcgtttttttttgttcttttagcatcttgaataaattatccctttctctcctggcatacatcagtaatttaatgttactgatgagaaatctactgatagtctaattaggattcccttacatgtaacttgatgcttttctcttgcagattttagaattctctgtcttcaacttttgacagtttgactataatgtgccacagagagaatctttttgggtttaatctaattgggaatctttgtggttccttcatctggatgtctatatctcccccaatatttgggaagtttttagctattatttcattaaataggttttctgtgcctttcttcaacttttctccatctgccagttctataatgcaaaaatttctttgcttagttttttttaaactttgggttatttcacaaaacctattttcagattttgaaattctttcttctgcttgatctggtctattcttgaagctctcgattgtgtcttttattcactgcattcttcagatttctgtgttttaaatgatagatcttgttttaatttctcattttataactttcctgatttcattgggttgtttgtattctcttgtagcctgctgaatttttttaagatcattatttttaattttgtttcaggcattttataaacacccttttctttggggtctgttactagagactcactgtgttcctttggcagtgtcgtgtgtccttgctttttcatgtttcttgtgacatctgcacatctagtggaatagtcacattttccagttgtatgcagtagctttcacagggagagacttttcctgtagatgggtcctagagtgttggttgggtatggtacattggctttggtttggggtggattcagtaccatggtctctgtgtagtttcgtcagctgtaatcttcacagcaatgtctgatttcctcagtggcctaggctgcaggagtttttgatggtggtatagttttgctagggacaggcatgtcatgctagttgtcaggctggacacttgcaggctcggagggctgacaagctgtcttttgggctccccagggaagagaaagtatgattttccagcttttcttctatgtttatttaaaactttgttgtctggctcacagtgttctttatctaaagtctagccagtggtggtggtcatattgcaatcattattacagcttcagactttctagaccttttccattttagtgaccttcagccttcattcgcttccattcatgaccacagaatagatgtagtcatctctattgaaggcaaacccatcccatctcttcagcttcatctagaaatttgtttcatctgttacactttctttctttggtttttagccttcattctctaccagctctttcacttaagcagagatatgttcaagactctcccattctaacagttccctgccttgatcctacaagcttttctctttagctgctaccttgctttttatttttatttttttctcacttgctctgataatctcctagaaaaattggcttactctgaccatctccattagttcacctcttaattattcttcaaccatctgagacctggctttgttctttctctactgaaactcttcaggcagagattagcagaagtcttctaattgctcaatgaagtggaaattttcagtccttattttctgtatttctccttcatttgactttgacttaactctcttggtttttgtaataccaccagcacctagtttatcagtctctcatgggaacttcattctatctgcctgccaaatggtggagtcccaaggactgtggtctgatctgctgttcctcattacatgctttctggtcagtattgcacactgtggttctcatctaccatcatctacctccagaagtgccatatatttagtaagtttacaagaaaagcaactttccttgctccgtagactaactctgatcttttgttccctatcatggttatggaactcactaattattcagcatcagctgtcagaatgtttaactttgctatttaggtttgtgtaagttatgggacaataactaggataactagaattagcttgtagcttatgtgggttagataatacaattgcatatgtaagtagtgaatattttggcttaataagtgaaggagtatttaggaagctatctggaatgttatctaagtcaggattctgaaggtaactctagcctcactgtcccttactcactatttctaaacacccaccaatcctgcctactttatttacttggtatttctccaatctgccatccttctctgtccgaccaatcactaccctagctcaggccttcaaagtctctcacttgacctactccttcacctcctttgaacctgtgcacaaatgttagcttcttagtaaggctttctctggtcacctgtataaaattcccatctgctacatacttcctggttccctgtattgccttatattcctcagtggcatttatctccttgtatactatataatttctgatctctgtcctttctattaccaccccacttcaagatggcaaggatttgtctgttatattagtgactgtcctaataggaaaaaaaatggcacatttatattagagtaacttgagaagaatttttaaaagtcagtatttataaagctgtagatatagagatagtgaagtactcttgggactagtaatcattgggcaggtgataccatttttaagcccaaaagggcatagtgaaagagcaggtgcctgaacctggattcagagagactatgtagaggaggccactaggcaggagctgtggcctttgcctcagcttggctgattacctcactaatcctcactaatcctaaattacccaagttccttcttttctggcccatttcacagtccaaagccaactttaagccagagggcaaggggagcacttgatgcagtccatgcagtatggcctcccagtgaacagggcaggtggaggatagaaactaaatctagatggaggagagggaagatattcagaatatgttttttctttactgtcagcaccttgaagagtgcctggcatatagataatatttattgaatgaatgaatttgttactggtttactggcctcatgaactttagttttgcctattctattataacttggtgactacattcctatatacttgataccaactcctcattaactacaaaggcagtattcccctctccccctttttaaacatcaaaactcttttttaaaaaaaattcttaaatgaatcgccagtatataacacataaaagtatgggtgccttgattggagtggtgggtaaatgatcctgagtctgtctgtttgggttccctctttgcctagcaggaatgtgactgtcttgtttaaagcccactgaagtagaaaacaggatgagagacacactcttcaacatggcataagatttccatgcttggctcctgcctatctctgcatcctcatttctcagtagtttcctcatattttaccatcctgtaattgaaagaattacaaaactagttctctacacaagctttcttgctgttccagctgctgggaattagcttcctttgtgcttttttttatttgaatgattcatgtttacattcattaaaattaatgaagattcattacagttgttttctctttaggcataattggatctcctatactgagacattgaatgcaactttgattgtttttttcccccattatatgttaagctccttgaggttcttttcaactttgcgttattccaggatttctatcgtaagagttaaggttcatccacttctctgatgtgaggttcatggcaggaaggttccatgttgctcagctgcagagtagaaaatactgagcagggcttaaatagattaggatgctgccattataatataaactgtgtttacgaaagagcatcatcaattcagaaaatatctttttcattgactacagtggtgcctgatgatctttctattacaatcttaaattatggtcattttaattatagaatcatacatgggtttatttatgttaaaataaggtaattatcaagctagctgtgacctatgagaaaaatcctgaagaaatgatgaagggatcaggtgactgtttttgaagtcaagtgtgaaaggtcagaccactctgggtcatgggaccctgccaaggcagagcaggtcaagtgctgtgcccagtggggccaacccccagtatggtgccagggactgggtgtgagaagtcaaaaattaagaatacacctcagaaaggggacatggacagatgccacagacttatttgcgtatttcatgatttagcccttagcttgtgctgatactggatcagatattttcagagttcagtattttcaaaagcatcgctgatcacctgttggcattgttttacatctcaaccaaggaaaaacttttgggacatctgtttaacaaggggtaagcttttatttgaaatgttcgattaaagcagaagagtcaggcatttttttgtgcctccccaaagaaagatttgtttactgtcctgtgtgaataaatataatgtcattatttcccgtaaaggaaaagctgatggggagagtaagtaatgggtaagattaggcaatgttaagctcatatattagtatgtttaagagtgatcaatttagggatctctgtgacagagatgccaaatgctcacagtgctatctcatgttggaaacatgtgtctcctccacttttcctcagtcctctgaaatgacggccctttagggattgacagatactatacagatttctgtgctgatatgtgatttgtctaaaacaaaagtttcacaaaacaattcttaccattgccatttaagagtcactctgatatgctctgtttccattgcaaacaaatgctcattatgatttgtgaaattaacttcacaatttcctaatggataacaccttgaagtatgaaaagcactacaggatcttttatagcttccctcctccagctctctataatctgctcccatctgtggtgtaggaaagatttcagcagtggccgctgaaggccctaagatcttgtctcaacagatagcaaggtgcataacagactttggacaggttgtttaacatgtctgagttactgtttattcactggcaaaatgaagggcttatattatattgtctctaagtactatcagttctgaccacctatgaactttcattttaaagaaaatacctatttctatggcctttaggcattagggaattttgtcaaattaaataaatctcagtaaggtttgatggtcaatggggcccactgtctggtgtgtgtggaggggtgttgtattttacatcaggaacttcagagccctcatgaatttctaattagaggaaccacctgggaaatataagtcaaagccctttgctcgccttactcagctttagggcacagtgactagaggtgggcaatcgctttggtgtaggtattgtcattggaaaggaagaaaccattttctggaggaaaagaattggttgaggctagctttaagcagctatttcatgatggacaaaaggactagctcatccattcttcattcgtttctctgtatcctctatcaaatttctgagtaaagattttatacaatgcttgattagcattcaaatagtatgtttcaaagattttaaaaaaaataaaactaggcctttgaatcataattatggcttataactctatttttcatatacttactatctcaagttacaaatttcatgttatgtttttttcaaaagagtattcctgccacaactcagagctcagctgaattagagcagtgactagaaaatctgagaaggctgagcttcaaaataaggtctggaaagtgtttcttattgttacaagagagtcaaaatgattttcttgagctttaagtttatgtaagtatttacttgacacttagcagtttaaaagataatgtgcaaaaatatgaaaatgagaaaaaacaatttcaaaacaagagttggtgattacgtgagacttagtagagcaaagtatattctaagtattaatctgtctaagctgtttgggaacagatgtacgtgaaatggataccgggtgttctgttgtgtacaccccaagtgagacatctgttggtagactgtgtggtcagaaataatggaagcaggggttaaaccccaatatgacctattactcatgtgaattattgaaggactaattactcagtaaaacatgatgctttgattcatcagtctacacgttaagaaaaaagcctctttagaaaaaaatttagttctgtttctaagctgtcaaatttgaggaaatttttaagatgtatgcaaagactcaaatttccatagtaactgcaaatactatctgcttataaagttttaaaatgttttgacaggtctactaatttatcataaaaatagcctcaaaagttttagctttttgttagggtaggttgggtctcacagaaaacaaatgtagagtgaattttctaaagcagggctgtccagttagacttcctgaaatgatgggagtgcactatatctgaagtgttcaatacagttaccaccagctacatgtggctattgaacagaaacatggctagtgtgactgagaaactgaatttttaattatatttaatttttattaatttgaattcaataactgcatgtagcaagtggcaactgcattgtacaacacagctctgacacatggagagttgaaaatgtttgtttactttcttcccaagttttcattttagtctttgtttctacatagaaaggaagatatagcttttgaaaaatgaacctgaatgtagaactgatatggttatgcaatttgagctgcctatttaaagataaagcaactgagtttagagatttcaaagtggcagagtcctttaacatatttcgtgggctggccacggtagctcatacctgtaatcctagtactttgggaggctgagatgggaggattgcttgagcccaggagttcgaggccagcctgggcaacatagcaagaccccatctcagggaaaaaaatatgtgtatatatatgtatatatatatatatatatatatatatatatatatatatatatgcatacacatatatacatatatacacacatatattaacatattttgtgtgtacaaaaaatatttttattatgtgtagattagttggttactagtaaagttgaagtcttgtctatagaaatcattgtatttttcatggtcattgtgatacattgtttgaactgaaatttggcaaattcaatctgtttcttactacaagaatagtacatagatttgaaatggtaactctcttagtctgtgtactctgaccctgtgaacgtctggagactaatgttattcctaaatatgctatgtccacatggcagcatctgaaggcaaacactttttaaaactgatctacttttgtggacccttcctctctctctttcctgcatcccggatggggccctctggggctggaactggcacagaactattcccctaggagtgggttcattgaagccaagggacacacaaattgagaatcagatagactggaccaaggtcattaaaccagagagggcaatccagatggggttgtccaaagtaggaagttctgaagtgaattgcagaaatccaaacatggcaaagctaaaggaatagagaaccagggcaatggatatagagaacagagcaattgggtatgcaggaagatgctattgcctagactggatgtttttgtaccctctgtaatttgagaaaatggaccgtccttgttgaaatggtcagggatgtagtagataaattcattgcagttgtgtaatctcagcactagaatactgatcataaccatatcacttgttatcccacctagcctgccacttgattgggttattagattacatttcagacattgacaagtctacaagcatcattaaaatcctaaacacagacttctgaccgtattcctacccaagttttagaagcactatgccaatgacgggggtagtatatgctgagcaggtgagttttgattgtgtgtgtctacatgtgtacgtgggtgtggtgagcaacaggaaggaactctcagccatgactctaaatgctcttgtgttggccaaaattggtataagctaggaggagaaacacaaaggagagagaggcatgaagttgaaggacattaaaccatttgcaaacttttggcatgcaaaccagaatatgaggaaacttagtgtaatgggtgactgaattcagaggtagacaggcaatcaggaaggtataggcaccaaaaatagttaccattggtgagcgtttttgtttttgtcattggcatggtgttatgaacttatgttaagcctaagggtaagtctaaaataatgtaccagctggcatcagggaattcccatgtacattcctagattttcattagaaacagtgttctggaaactaccactgctgctacacagcagtgcccagtgcttgactgaaaatagtgaacacttagatttgtttactctgccaggttctgtgctaagtatcttatcttgtttaaccttagcaaagaaactatgtagtctagatagaatttttatccctagggcccagaggtgttaaataacttgcccaaggtcataccagtaatttcagttgctggggttcaaagctaggcagtctgactccagagcctgcactgtccccatttggttatgttgcttccccagttaagcaagcaagagtctatctgacatctgagttggtggtagtaaagcatcatggtctgaaccaaaataataaaaacctttgaaacaacattatctgacttctttcaggcttttaagacagttccatcatcaacagcttattccatttctctggccacttccagtttctgaacaaatgaagaaaatgggagtgataaattggagtttttaacaagtttttttaaatctaattttttttatggaaaccaccaaacatacccaaatgtaggaataattatgtaataagtcctcatgttcaaccctaagaggggtgaagctctatgtgacccattactgagtttaaacagttttcaatttatggccagtcttatttcatctatactctacccacatcccttcttcccctggaatgattgaagtaattcctaggcatcatataatttcatctgtaagcatctcagcatgtatctctaggagataaagattttctaaaaaatcatattactactcttcaaatttaaaataatctttatagttttacatatccagttagtgtccagattttcctgatattttctctattttttaaatatgtcaaccttgaaatgaggtccatattatagctgatggctatgccttttaaattttctcatccacagattcttcttccttttttttcctttcaatttatgttttgaacaaactagtttggcctatagtttctcatgggcaagaataaccttcagactgggatggccatcactctgatacccgtaaaggggatgaggcaggttggggaagggagagcctcagaccatgatcagatgtcacaagatttttgcttacctagggtgaggacttgggaaaaagattgcccattaggagtcctgccttgggcaaaagtggccaaacttcagctgtgctgtcacaggctgtgggctgccttggaaatgtaggacctcaactcctctgaagttgaggtggagcttgagggtacgaatccctggtggccattataatgactacactcattgggatggcatggcaagttcatcctcaaagatggatcctagcatccaccatgaccaatgaggtttttttattgttatgatcactataaactcaaggatttaaacctattaaatgtttttcaattcacagcaatgattatttttactgatcttcaaattgtcacattttggatttttagaccaatgggagccccttcatcttgacttctgagttcttttgacattcactcagctgtctgatagcttccctgctttctggaatggcaagatattccaggttcatcttgaacatttcatgcttgagatatggaatcaagctcatcatcagagggtcctggttccttttactggatagtggtattagagacctcaatttgagaactaagcaacatcattgctaaaacttcccctatgtgtaccttgttacttaggtttttcaaagaacagagctagaaaatatgttgggtttttttgttttgtttttaaagaaaaaatgtatcataggattatgctgatacttccaattcaagtgcaggcctaagcttttcacattgtctcttttctcctacccttaaagtcctgattcctaactataacaacatcattactcatttgctttatcctgcattatgtagacacaatagagtaacaacaccaatgctgccaatcaaaagtataattactgaaacccacttaagatagtcctgcaatttttttttttgttcatagagtgtacactactagggaggtgtagtcaaattactatgttttaaagacacttggaataattcatatctgtgaagttatacccccaacttatttgttttttgtattattgtttcattttgcttttgatgtttaggcatttcttttttaaaaatcaattttataattacgtgaaatacttatatggttccaaaatcaaatctactaaacaaactatattctaggaagtatagcttttatgtttcccttctatgcttttccttccttcctgtaggtaggaaagcttatttgttcctcaaagctctgggttgttcttttattttatataaataaacatgtgcatatattcttttcattacccccacagtacccaccgtcttaaacacatgtacaatatatgtgtttttctaccttgatttctttcttacttagcaatatgcccagaagttcactctgtagcgctttacatcagcatcaaaatccattatgtactatcgtttattgacctctctgttggagaaatttggattgtttctagtcatttttgttatcgcaaatagtggtttaataaaaaactttactttccgttttttgtttttcaatgtgcttttaggatagatgcctagaagtgagattgttgagtcaaagaataaatgtgttaataattttgctcaatattaccaaattctttcaaaagggttgtgcaattttgctttttaaaatcattattgtataagggcatgtatttcctgaaaatttctccagaagagtttattgccaaactttaaaaaaacagcctgatacataataaatgatatctcagcatagtttaaatttgcatttttcttgttaaatcattcatgtttttactgtagtcctcctaacatttagggagcaccaattatggggtctctagaaggttccaggattctgtaatcaatttgacatgatttctgtcttcagatattcacaatcttcaggaagatatattgacaaaagaataactacatgatctattttgtgtgcaacttagtacttacagagcattataaatgcacatggaaaaataggtaaaggagaaaatcattctctgttgggcgggctgagggggaagtcaggaaaagctacagagaggttcgagggtaaactttaatgtgggccttgaagtatgatttggagttagcaagacagacaaaggagcaaggaaaccattctagaaaaagaaaattttgaaaaatctccagaaaaggatgctttggcctatttggaaaataacattgtcttatttatgggggagatgacagtgctttgtttttagtcagtagtttatacaggactttgaatagcatgcaaggaagttggcgtctcaacctgaaaattgaggaaggtgtgacaaaggctgggcattaggtgagatcaagtatttctgtttttttttttggtaaattaggtagcaggatagattataaatgggctccacactgaggagcccagtgtgatggctgatccagcagatcagggggcagtggctgcaaagctgggagaatggcaaggtaagcctggatgcaagggatattgtcaaagacaaaatttgggggatgtgaggcttaaaagggaaataaataatggtgatggtgagatttctagcttgggcagtgggatagatagtagacgctgcgcaaattcgtttttaaatcagcagaatgagaagcatcttatttgaaatatattctaccaaatcttagcatcaaatgtgctagtgactagcaaaatatgtaaacagaagggaagtagcttgaaaagtacacaaactggagaaattgctcctgaaggactgtaagttgaacccttttaagcctaagatctgtatttcctatgagccctaggctctttccttgtgtatcctgtttcttattagagtagaggctacttaaaaataatcatagtttaaagcgctctattttcagaaaacattattcattagatgttagtaaataatgtaatctttatacattcataatatttctgcattattggagtgtaaaaagtcagtgaaatagtcatttgtaaagatgtcagtttttatctgtggaaaatagctgttcataccattttaagcttaaaagttcttcatttacttcttaaaatatccatgttggtattattttgtctaatacaagtaattaatatttaccccaaattaagcttttaagtttactaaatgttacaaacataattcaaagcactgtttagtgtccatctgtgcaggaaaaataagatcaatacaattgagcagctgttagcatgtattggtttccttatattttaagtatgttttcatgttttgaaggtgtaaagggatgacagtatgttttgttgtggttttcatcatacagataaaaacttattacagttgaaatcttggtgaacataatacattttaaaatttccattcctcacccatttatctagatatttagacacagtaaaataaataacatggatacatttttgtcatgtgatttatgttttttaaaaagtagaaataaatttctctaaaagttatttttattttttaaatttagcatttttcatatttgaggaaaaaacaatatgtcttggtaccctagcttctgaactaataacacacctgtcattttacaggttattttaatgtttttcattgggatcaaacctactctggaaatatctcatgggtgagctttatttttatgaaatgttcttggcacttgaagacctttgtaggtacatgccagactcatcttacatccagttcttctgcatggaaaatatgtgcattgaaattctaagtgccttttcaaatttgaccttcttagagaataatatgagtcccaacaattaggaaaactatggaatgccttttggcctttacttttcaaagattttcagtcagtaatgtttaattagcattcattgtgtacattgtccttttttgtgtgatatggctagttccaaaggaatattctagaagatctcagccttctgctattgaaggtgataatacactactaagttatgtgttgctttacattaaaataatgttgcagcagttacttattgcttaactagcgggtataggacatcaggttgaaataactgattttgaagtgaagagttcttgtttatatcttaaactaaccaagtatgttcattaactttgagaataacaatgatctttttcattattcttgagtagactggataaatcagaaaacccatgttagaggtccctgtaaaaacttcagtcttatttggtaagtccctttataagagtttcaataaaatcaggtaaatttaaactctgaaaattctacgtactgtctatcatgttcaatttactgttaaccagtactatgcactggaaaaaatttttttcaccttaatgagaccactggtcattactgctgctactgatgctcttttgtctgcacatactgttgcaacataatgtgttgtgcatttgatacggatattatcatattgccataaggagctgctattattttagacaccaactgattccatgatagtgtcagatttctttaacatatgcttatgtttttgtacaaatgaccccaagaaacatctgctagttttgtggtggtatctactgtttcttttttagaatttgacctgtcagtcactttttaacgtgaatctacaatatttgagttgtattcctttctcgtttttatgctattgatattaacaaaattgagtcagttttatggcataattcagagagaaaccgaagctgtctatggatgttattttaaaaatacctttttcatgatgattgtgcctttaaatttttgtcattgattgacactttaaaattgaaaagtgcccttttaatggatcctttaggttccaaaatcttaagttgaaaatttctgtctattggtcctgaaagtactctctgaatttgataagtatgtagtagttgtggtgtatccttggtcagtttatatcctgtgctaattgctaatcttacttagtttctttgatgcgtgtgtgaagacaggcaaagaaaaaggaagtggaatttctacaaaactgtgaaatctttactttatggagactagagaaatttctaagtaaaagaagacactcattctattgtagttaggatcccttcttttacttgcttttcatgatcttgactgaaaagcaacaattgagatttccattgcccgacgctttctcttctgcttttctttttgtttctcttgcatttttaaagacagctatttattcaaaaacaatatgaacttttatttattggacttaaacctggaacatcaacaaaacaaagaacaaacaaaactacctttccaaatttattttattagaggatgctatcaatacaattttgtattatgttcacacttgataccaaacctaaacccaagaaagtgtgtcctgtgttacagcctatccctctgtttaagataataactagaacaatttacttttattttctactcatctgctttctgtgtatcagctgttgtcctccctcagcctcgaagcatgtcatcatttccatctccgtgctcattcagtcatccttgctgctcttagtcccctttttgtcccttgggtgacttatgtcattaggacaaccttctgtccccacttggctgaaactgagctgaggcccttgccagttgcattaggtgtggcacctttcatggctcagtttgggcctctgtgatatctgtgtgccttctactccaaactccattctgccagaggtggcagggtgactggaagctttagtttcagtgacaaaacccaagcgtggctatgctgagtgtctaagtagctttcatttaggcctgaaataggagagtcaggcgcctctgtgtcccctgagaaagagagatttccctcagctctctgggcccagcactcaaccatttaagtcagctggttagtataatttccctaaattgtggtttagtttccctatgagtaggactggagtaggaccaagtaaggaaagtccctagtgacctttctgcctcctgaggagcaggccatttactttgagttgtagcttcccatctgtctgtccccactaccctatccaaggccctggaggagccacaggatgagggaggagattcatggaaaagcgccttcaggtactgggtatgtctggagtaacatttaaagtttaaaagactctttaacaattttcctctgatacttactactgcctatacttgtttggttttagtacagtaagttttgcctatcgtgggggtgaagaaaatagaaatattcccattaactttgtatggtgcttggtatgacaccctgaacaggtgcacccgtaattgtttacttgatgttctttttaataagtcaattatatcatcggaaattgaagaatagcaaagttaatttgtttaatcattctatgggaactcttgcatgctcgttcactagaggaacattgcgtttctcccttaaaggacaaggctttgttttgtttttaataagacacactctttataattaaaacaaaatcccagtgttaagggatttctgttttaaataattggatttctttcctttgttcctctaatccctctatatgagaaaaaaatctaatggtgtcttaggataaatatttttagattaaaaagttctcttaaccactgaaatttaataatacttctcaaagtttatggatgatatagaatgtaatgtaaggttgagaattttagatttggcaaaggcaaagatacaaaaactagtgaaaaacaacaaactggaaacacttttaaaatactgatgtatttatctttgcaataaattattcagaaatataaataaactcactatttacatagttttatttaaatttgtcctcaaaatactaaatttagtactatatattttcttctttcagataaatgctttcctgaaaatggtattttaatatctacagatggtttagtttaacaatggttggggtaaaaatgacatagggaaaagcaaaatgtgacagcccagcttggttacctttagagaaactcagaataaactctattcccatttccttctctttcccctttccatactcgagagcccttttctgagactcttaagtcatgtttgggccttggagaggataaatagcagggtgggtggtaaaaggggagagtgctttgcttgaggcaaagttttcctccatatgggaccttcctcaagccctcccttcaaaccctttaaatgagagcatgagctcctaggacagaggtcatgtggaaagcagcattagcatgaaggggggtgctgtggaggggtgtaaggtgcaaaaagcagcattagcatgggggaaggtggggtggaggggtgtaaagggaatgagatgtgaagtggttaaagggccatttttctagttggcctctgggctttgatgaaccttttccagtgtgcctgtttctccacttagccctgggctaatcttgactcttaactttccaggtgtgtatctatgctgatttctcctgggtttggaagctctgagaagctctggttctagttcaatcacaagacttttaaagaaccagaaaaataaaacaattttttaaaaagtaatgaagaaaagacttttaaagaaccagtgaaaacctgggagtaaaaatatagaagacttgagaaatttcatctttacctttcaagtgggcagcatgagaaattcttgtaaatggtgctttcaaatcttacacaaggttctcagttacctttatttgtactccctagactgtattgcatcccttgctatgttgactaattcccacctaaaataattcaatggcctcccaatataatctggcattctaattaataagctaagaaattatttggtttttcactcattggcgttaaatattcttcagtgcccacatttggaaatattggaacacagaaatgaaaaaagatacaatcagtttctctgcttgccatgttttccttgatatggcaatacgacaacaggtcaccctttgaagaaaattcagagatgctaaagtagaaattaaaactgaagataagtcaaggcaggatagtataggagtctgctacagctgccatagcaaaatactacagcctgggaggcttgaacagaaatttatcttctcacagttcttgaggctagaagtccaaaatcaaggtgccattggggttggtttctgaagagggttctcttcctggctttcaggtggccaccttcatacagcatcctcacgtggccttttctttttgcctgcatggatagagatctctggtgtcttccttgtaagaacaccagtcctattggattaggaccctatgctatgacctcatttaacctaattaccctatttaaggccctgtctctaaatacagtcacactgggggttagggcttaaacatattttaggggaacacaagtcagtccataacacgtgatttgctatagttttcctttacctaaatcttttccaaccttgagagtggattttggccaggtgtggtggctcacacctgtaatcccagcactttgggaggccagggaaggtagattgcttaagcccagaagttcaagatcagcctgggaaacatggcaaaaccccgactctgggggggcagggggagtgggggaattagctgggcttggtggcgttcacctctagtcccacctactcaagagggtgaggctgaggctggaggattgctacagcccaggaggcagaggtcacagtgagcagagatcacaccacttcacttcagccctgggttacagagtgagaacttgtctcaaagaaaaaaaaaagtgggttttattcttccccttaaattcctattaatagtgaggtgaggcttcttgtgttttttttttttttttccaagacaatggttaatgtgtgattacttaaaaatgatatataacactaagaaataaagaattgttaagtgagaaggaacatattaaaatggcttggaaagatgggtaattttttacattttaagtaggttttctcaactctaactctgtggaacttggtcaatctaatcagtctaaatatagcacaaataataatagttatatggacaggagaaatagtagccctcaaagatagtgaaatacatctgaatatcactaacaatgtcatgaatttgcttgttctaaagttttctgaaagtatgaattcataactgagtttttttttttttgcctatgactactaatgtttgaggagagagtagtgtcagaaccacccccccatttattacatgtttatttcatattttggtactgaaatcagtgtttattttgtgtcttcctgataaatcttgccaataagtaattaccttccatactgaaaagttcttaggattaccaggttgctgggggcaaccttaaaaggccatgcagaacattgacttaggtggctattaccctgctttattcaggtctgagcatttactttcctactacaatcagaatactgacctacatttaaaagtgcaacactgccctgttatctaaatccactgtgttcctgagaggaaataccagaaaagagggcaccaatattatttttctgctgttcttgatcataagtgattacctttttttttggttaggcattctgcttctgaaagataactgaggttgaagttaatagaactaagattcttatataaaatcataggaaagataattttcaggattattgaatcatattgaaaaatgatataattgtgttaaaagataaggactaaaatgagttaattcaatttggaaatagttaaattagaatttgcttctgtttttgatgaatactgctttttgaaaaatcttctgagtatttaagcttttactactctagtcattctctctaaagtagacatagaagcgtgttcttatcttgatttggtaaggctctgaaaatgcaaagcaacagatgttgtacccagcataattatatgtatcctggaaacacatctttattgagtgggatttgttcttggggaaacaaaaatttggcaaacaaaggacattaacttgctgatctcagcagtaattacttgggttagattataataatcttgtgtaggtggtaactgcatgcatatattacaaaatctaattctaaaatacgtacattaaaaggaaaatgaacttgcgcaaactttagatcatgtatccccttgaagagcagaaaagatctcaatttcattatttgaaagttgtttgaacagctttttggaagaggtttccaggattccaaatcctaatatgtgtattgatactgaggctttggactaatctttgggggttactgccttttttatgcccactgaaaatagagcatttcaaacaaatgaactgatctctgatctttaagcatgccagtaactctttggaacaaatccatagttatttttaccaatgactgtattaaaacagtactttctgtattatctcttccattccaaggccattttaaaacaccctctttctcttctcccaataggtaaagtacgacagagctccttaggactgggttatggagaattatctggaggtcaatttgagaaccactgtgcaaaccatttcttaaataagtagctacaaggttgtccttacaaaaatttctgaagttgatggtgttgcgttttggagtctgaagcttaaataagagtttgtcagtggtcatggtctaaatagctgattactaccaaggtcatctaatttttttttaacacaaaaaaatgttctgagcacaaatgaaaccttcaggacaagacatttatgttttgagaatgttcttaaatgattcctgtcgtgtatcttattttacatatcttaatgatcagcatgtattttttgttgttgatgatgattttataaatgtgctatcacctagtttctaattcctaacagctccttcatcagtagaatattgctgtagcacagttttgccatctgttaagaaaagatggtgactaataagagtggcacatttcagggctggtgtgctatcgcaacatctagtgttttagtactgaggacagtgatgtatgcagtgttccttacagccatggggtgtgggaatgttttcctcttcggcaaagtctgtgtatttctatagctgaactctcaggatccagaggaaaaccacaagatgatgaaaccagatgattgtcatcaaatttctattccccactacatgattattagttttcgtcaaaagaaatactcatcctatcctgggttggaattggtaaagaattttgcattgtgactaggacacctaaaagtttttaggatgagtacaaatggaatttgatagatttccccaaaatgtttgggaaaagatttattcctccctaggaacagcaagagtagcagcatcacatgaggcaactcctggtaattttttcttcttgctcttatttcaatgatatcttttcattcttttctgtatctctcaatttctatgtttctcctcttaatgtatcctgtaaatttcttagtagaacctttttactaatgagggtttcctagtttgctttaggaggcactcaggatgcccccttttgtaaggcagtaaattgaaaataagaacttggtgaaggtccacgtgacggttagtttccattctccattgtaccaaactgctacagggaaagaaccatatttaatcaacctcaaatcctcaatatttaggtcagaaaacacttggcatagaagagacactcaaattttgcagctaaatagattattgatagaaaatatgtttcttgcctctacaagcaatatgaaaccaatacaatctctaaatatcttcagactactaggggcaaatactgtattataagaataattcttcagaaaggaaaatccagctactctcatatcacctctctatgttgaaagctagggaagataaactggcttccagccagtgagagtccatgtggacctagtgctggctggagatccctaatccaaaggcaagagccagatactggttgtctgctgaaaatcagaagatgacctctctggtagtaaggccagtgactcatccctgcatcttttatcctcttctgatttgtataaggatctctcctttttccccagtacccactctcaagaattgctttcctttttaacatgatcataccaaaatgtatctaacagtaccttgatttcctttctgaggaatttagggagcatatttactttgtcagactcattagaggtttggcttcttggtcgggttcttaaatggacaacttgtttgggtgatttggcagagaataggagaagccagtcccctctgatagagcaaacctggggagctgtggttgacccacctgctaactgtcctgtacaattaggcatgtggcatcagtgggtgactgaccagagccaccatctcaatggcggctgttctttccttcctgtgccttctcagatctcttttttgttcttgttactccactatattggtttttcttgagtttttttcaagcaaatatcattattcacttctactgcagttcctctgttgttcgctttttctcttagtcttcattgttttccattttgaacattcagagatccatcaaaaaaagtaaaataacaggaagggagaggtaaacaccagtcaaatgaagtattataatagtgtattactatactctttaaagtaattgaagggtggttttttggggtcagaatatctgttagaatttggaatttgccactcttgagactggggcaagctatttaaactctaagcttatctgtccttcctcacaatctgtaaaatgggatcataataatggcacccagtttatggtgtagtgagcattcactgacacaattaatctaaacttatttgcactacatagaacagaatttttgtctattaaacaatatagcgttttaggcatgaaagaaactttagattaaattaaatatcatttttcttaccacagggtaagtttctgttttgtttgcccctgtttctctaactcctagaatagtttccagcacatagagattaaacaaatattcgttgaatgaatgaatgcatctattctaatcctcttgttttaggaatgacccgtcaggctcaaaagtgaaagcatttccctcaagattggtgacagagttggggactaaatctaaggctttctcttcctacaccagtgtcctttctgagaacacgatgccattttctcaatatttgtttatttatatggtaaattggtaggaagctgtgtggtactataagaggataaactttgataatgaggtatacttgctatcaaattctaacattctcatttaaaacatggcataccatttgtcttctacattttcatatgtaaagtgaggtgatttctaccttatagaactattgtgaggattaactgaactaatctttgtagagcacctggtcccatttattttttttttttgctcaccccaccccccaactttctagctagataacttatacattcactctgtttttcattccttcttgaatctcctgtggccagacttgacccctgtcactctacagcttactcgtcaaggtcagtcctcatctgacttgacctactaagagtctgacaagtagtcacactatgctccttgatacagctttcttcacctaccttcttggatgtcattcttttggttctcctcctaccccattgggctgctttttcccagtctccattcttgggtattctcattttcccatgtctgtcctctgacttcttattgtctctgtttctgttttctctggttggaccttctctagtttctggcttcaaatactatctaaatgctcatgtctttcaaatttgtaactctagtctagacctctcctctgaattccagttttataaatcttctacttaaatattagaggtctaataaacttctcaaacttatgttctacaacaaactccacattttctcctgcagcctctaaatatgtacctcctatagattttcccatttcagtaagtgggaacttcattattctgattgtccaaaccaaaaacacttggagacttgctacattccaccctttgtctttcattctacatccaacctatcaacaaatcctgttgcctcttccttggaaatatatccacgcttgagcagcatcattgtcaccacttggtgttatacactctcatttctcacctggagtattgtatttctcatctggagtagtgtctgtccaacgatgtcccccatcagtctgttctccatgtagcaatttcgtttttgtttgttttaagattgggtcttactttcgccttggctggaatgcactggtgatcatagctcgctgtagcctttaattcctgggctcaagtgatcctcctgccttagcttctccagtagctaggactacaggcacacaaccacacttgactaatttttttttttttttaacttttactagagatggggtctccctttgctgcccagtctagtcttgaactcctggcctgaagtaatccttctgtgccagcctcccaaagtgttgggattataggcatgagccaccatgtctggcccagatgttaattttaaagtgtacattagagcacatcgttcttctgcatgttcagcataaaatccaatgtccttaatgtagtctatattaccctacatgggctacttgtgcctgatccctctactcttatgtcttatccctctcctgctttctcactagcaccagccacatcttaccgttccttgaacacaccaagtatgcatttgccacaggaccttgatgcttactgttccctttgcccagaaacccttggaaccagctatgtgttaaaattcagatatttactgattttagagagctaaaatggggtatatataatatattacataacactcacagctggtttgtggtagcatttcataattaaataatatttctgaatgaaacattaagaatgcccatgctaagagggatgagtaaagactcaactctcattgtcagttcagctgcagaatgaggtcagctcaagatttgctgccaaatgacttaagaaaaaaatgtttttggagctttggggatttcagaattgcagatgagagattctagacccgtacctacacagcatgctcccttattttgttccaatctttgttcaacgattatttattgggtagtcaaggaagatctctgtctaaaaggcttctctgtgtggaacaagactggcatgtggaaggtttccaattaacgatattgaaagagtgaagctcaaatcatttttcactcaaatacatactatttagaagacagtggccagtttaagaataatcattattggaaacaaagtactatttgattagggatagttaacacaaacacttattagtattagggatatgtgaaatacttaatggatgagtcatgtgctgacataaaacccattatccattttagttcctggtagcctaactggttgaactctgttttattgatctattattgatttggcctgtaacttcaagttacattttaatgtaatttcatccttttctgatcaccttgtgtcttcaagcatttttaagcagttgatagatagttgaaagatattatcactatttcaatctaaaagatattatcactattttaatctacttaaaatttttactacattcattttaagtatgacttatggaacgaatcgaaaatacaagatagtgaaaaacttgtgaggatcacctgaaattttagcattcactttccttacatagaggaacttagtctctctaaagaattatgagtaataaagtatcataatgatatttgtcttagttttggttaagtgtactccacaggagaaagttaggcatgagcaggaattattgtagtcccacattctcaaacagttctccagtaagaaagattttatgtgtttccagaaatcattttcctcctcttcagagctttgggaccataattgtatttaaattgctaatctgttttaaggaatcataataaattgtttaacatttatattcaatcaactttgtaatttgtataaatttttcagggtgacatttgaacaatttttaagaaaatgggaaatacagaagtattcttagttttaatatattttaaaaagatgacatgtgatctactgactgaaatccttcaatcatttttgtttttctccccaagattagatagaatggatgtgattttatttttaatttgcattatggagagtacttttggggggttttatgaaaaagacttcatttattttgttagtggtacttcagttgcataagaaaatgttcttttaaatatagtggtcatttgtgtgcagccttcaagttagcaaacatgcctttgagtagtcactatttttgaaggtctttatatctgattgcaatggcttatattcaatagtcctcctactaaatgaaataaaaatggatgcctcttctgccacagaggcacaggtggacatgttggtagcaagccccatgcggtgtgacacatggcacagcccaacatgggggcaaagagcatgcggcttgagctaggagtcactttatggctactttagtgtagatttgtgtttttctgtggaacagccattattgaagacatttatatagtatgatgtttgtttttcattaaatgctgattgtgatttcttaaaaatagttaagacttgattagcagaacctatttagaagccagagttcccctgcttcacctcttgctatctatataaatgatatttttgactctgtcctttataatgttggcaccctgtgcatattagatgtaatcagggctgaaaggaaacttgaatccatctggaagcaataaacttttctaaaagactgcacagtgttatttaatcctgtgacttcttactgtgagtgaaattaaggtttgatgcagttgtgtcacatcgtattgatatcaaatttatctttctaaaaaaaaactgacagtattacagcacagaggagaagatggcttgctgtaatcctgtaagctattttacattgattacatgctacataatgtacctaagtatataaaatacttgatctagaatgtttatgttttctccaaaattttctcatcaggtaatactttctcaacttcacctttagttttggcttcttatcatagtactaactatgcggtagtaattgtgttatgatgaaaggcatggagaagaaattataattttaaaactattataaagtggagacacacttgtataattaccatctatgtagactgccaaggtataaacatttagcttattttagtatcagactctttgaatcaatttaaggctttttcaataaaattggcttcctctaatttctactccaaaatggttaaaattttgttttacttcaaatacgttgtagggtatcatatttcatgtgactaggagcctaaactatatcagctgactggcataatttgtgaattatatgtgtgtttattaaaatttaaagtttttattaagacttacaattttattaagacttaatttttttccttacattttgagtaagtccaactgaaaataacttagagacttaggaaatttgactacattttataagtaatttccttgtaatttttctttcttgtggaaacaattcttactgatttacttaactcttttttcaatggcaaaaatgaaaaccaaatatatttgtcaactatattcttttaattgtggaaatgaaaggttcatatcccccatttgcctagcatattaaaaataaacatgacctttgtcttgaatgttgttaacttggattttaaaaatcaaaccaattataagctatattaaaattgcttatcaccttccctttgtcttcagtaagtctgggcctaaaaatactcatcatatgaataaataaagttttacaaatactttttagaacatcttgaattatatgtgtgtttgaagcttacttttggatgttcggtcaacaaggcttctgacagtttctttttatcttccctctattccctgccactgtgcaccccaaagtgatccctgaccacagtggtcccattgctggcatcaggaaggtagactgaggagttcaggtatcctagaggctgttaggtgaatctcttctacctctttcctggtcctaggaccactggacacttcaagtaaaaataacaattactttaatctctcaggtaaagtttcttctcccttccagcaacacagatctgcctgtgccgagttcaaatactctgaactttcaacagttgttctgaatacttttttgtcatcttatgatcaaatattgagagcattgaggggataactgaatgggcatggtataaaagtcagacttttagtgtttctaagtagcagaaccctttggacaatttagagggctgtgcgatatcctcaccgtgactgctgggaagtaatgggatctgacctgcagaggtactaccttggctgacaataatgacaaaagtgagagcaaagtacatatgactatccttgaggtcctcaggaaaaaaagagtattagtgagttgaactgtatgtaagggtctttaccaataaggaagcccatgcccagacataatccttacaccctggcaatagaaaccatcattgtggtttacatctcatcctgttcctacagtccagcaagttcaggccacaaaaggtttaagcactttttcctttgttctcatagcaacagttgcccatggaggttcagttacactaatattaacattttaatatacacaaagaagtgcctcgaatgtagtaggtattcaaacttgttaaatgaaagaagtaaactttcagacttaccttgaactactacagttttattctttctctaacctctcccactactaccatcttaaaaccaccatttaattagtattttataacaagttattaaaggctttcaaagacctttgaaccttcaccctctggtaagttaataacttctgatatgcgattaaatgtcaactgagtagtagtgggccctaagagctcagagggactgagaaatgaaggttattgtttagaagagtggctcaatgtgcttcgacagttggttaatatttgaaaagactagagtcaagaaagccttccatgtgctaggaaatgaaggagcaaaggtccagaggtggaaatgtatacagtgtgattaagggattttctgattgatagtaaatacagtcaataaaaaacttttattggaagcctagcctgtgtttgaagcattaagctaggtgctgggatacagagattagagatgaagataatgatgaagatattgttgaagtgaattgctgagaagctggagaaagggccaattaccataatctgaggctcaggaggaattggtgcaaagatcatctggtatgatatatatgaactgtatatacaaactgatctgtgtagctgaactgataatgccaaaaaaaaaaagactaggtttttgattaagatgaatccattaaggtcatgttttctgttggtgccattcttggagacctcccccaaccctatacatttataaatgtttttcctgagggactgagatggaagtggacatataaaaggaaaggtctgggcaaatacataagtaggtagtaaaatcaaggaacaaatgatctcaacaaaattgcccttcttgaaatgaatgaaaatgatgaaagccaatcacattgcatgatgaacttggggtatagaatatgaaatatttaaaattgctttatttcatgatgtttcagatgtagtaggaacttgttgcatagatggtgtaaaaacaatctagtaataaaatcttaggtatttaatacaaggtgaagaaagatgcaatgcataaatcatgccattttaggcttaattttcataaggctatgcctgtctttataagactatataccaggagttctcaagctttttggtcttggaacccttttatactcttaaatcgttgaaaaccacaaagaccatttatttaagttataaccattgatatttgttgtattagaaattaaatagacattaaaaatatttactatttaaaaataaccaaaaagatgggcatggtggcccacacctgtaatctcaacactatgcgaggccgaggcgggtggatcacttgaggtcaggagttcgagaccagccaacatggtgaaaccctgtctctactaaaatacaaaaattagccaggtgtggtggtgggcgcctgtaatcccagctactcaggaggctgaggcacgagaatcacttgaacccagggagatggaggttgccgtgagccgagattgcgccactggactctagcctgggcaacagagtgagactctgtctcaaaaaaataaaaaaaataaaaataaaaataacagtaagttcattgcatattaacataaataacatatttgtattaaaaataactattttccaaaacaatcaaaaaagcagtaccactcttctattttaaattttttcaaatctcccttttctaaaaaaaaaaaaaaaatattgtgtaagtttaaggggtacaagtgcaattttgttgcacggatatattgcttagtggtgaagtctgagaatttagtgtatcttcacccaaataacatacgttgcacccattaaataatttttcaacacccacccccttctcactctcttgagtctcctttgtctatcattccacactctgttcctatgtacacattatttagtacccacttaaagtgagaacatgtggtatttgactttctgagttttttcaactctggcttaatagaagacagctgaaatctcagaatgcttcttcatccagtctgttgtgaatatgttgctttgattcaagtatctaaggaaaatacagttttacacagatgtgcagctgaaaaggaaacatcttttaatatgttcagataattgtggatattgtcctttgatactatagcaaaacttatcaagtgctaatttcttaaaggctggttataatttgaaatctgaaaacatatctatttaattgtagtttgctatttgaaaatttattggtctgtcttgtactttgaatggatattttgcccacgtatgattttataacatcctgtattggccttttggaaaatttggtttactattatacagtttctaaatgttgataatttttattataatatattttaaaaagtctaatgtcactgccagtctcatcagaaaattctttgagattagaaagctgttaagatcatcatcacacttacaagttttacaaaattttaattttactcaaaactttatattttatcattgacaaagctctcagttgctttgcttagtgactgactcactttgttcattttccagaaagtgtttaccaaatgctgctgcctcaataccagagtctgtattgtcagttgatctttcaagtaaaaagtggtgttctatgaaaaacagctagttcagctgcgactgaaatgatataagtgtttctcctggagcaaaccaccacttcgatttgtagcagaaatgctgtatgtatactttccattgttattactcataacatttttaaaaatatactcaagggtggagatttttttaaaaataagtgttattgcttcatcaagaacagttaaatgaaactggattttttaaactgagtttgagttaatgaagaatgcagcaattattagtaaaatttggtgctccaccttgattcatactgacactccaggagttttacccactatttcttttgtacctttagtgcaaatgttaatatggtaggaatggtaaatgacatctttagtattattataaaaatcgtttttaccctgtatactctttgagactacacattgagaattgctgatgaaggtgttttaatttatcataagcactgaaaagatttacttaattcaccaatttctcctgaatatttgtttatataaaacaagactatgtgtatacacctacctttttattaatggtagagatctaggaaaattaatttctaagaactagccaggatatttggaatgtgaataaatcatatatccagaaaaaagctttagaagattgtctatgattgaaagtcaaacagctctcatttctattatactgttctttttcaaagaatttaccaattttatgtggtatttatgattaaacatacaccatgtaatttaacatttttaatgtcacttttacatcataggtattaaagattagcatttttattgtctgtattttaaagctcaaagaataacatttaggctgggtgcggtggctcacacctgtaatcccaacactttgggaggccgaggcaggcggatcacgaggtcaggagattgagaccgtcctggctaacacagtgaaacaccgtctctactaaaaatacaaaaattagccgggcatggtggcgagcgcctgtggtcctagctacttgggaggctgaagcaagagaatggtgtgaacctgggaggcggagcttgcagtgagccaagatcgcaccactgcacttcagcctgggtgacagagtgagactctgtcttaaaaaaaaaaaaaaaaaaaaaaaaatttagatttttgactgtttcattgattcatcttagacttcacatgaaaatatctgtatatcctcaaatgcttacattcttaagaagtatctcagccatttacacatgatagaaacaactaaatggaaaaaaattgcagttggaaattcactattttttatttgatccgataacaatgtgacatttgcgattggactgtaattttctgtctttctctctgaaaataagttcaaaaatttccctctaattcttttactagataagaagcctacttcgttgtaactcttgatatatgtatgtatttaggaacttaagcttttctgctaataaatgttatgtcataattcttgaggatagtattatattgtgatgggttttcagtaaactacaggagcagccctatttgtttaaaccctagtttaacctgattattaacaattaaattgtgttttcttctaacaattaaagtgtgtttaaatttattggtcccttgcttcacagatttatctcagtatgtggtgtattcaaacagaattttgtatttttaattaggggattagataaccaattctgaagagccaaaaaaattgttagacatcacattgcttaaccatctaatataccataagtgtgtgtatacactatgttgtgggagccatctatcaggcaggcctgtttttcaggcagtattttaaaaagtggacatgtgcagaaactgtgagcacaattagcgccaagcagataaatccagctctaatcctgtttacggtctacatcagacagatgtgccaagattgatttagacaagcccgaggcttacagtaatatttttaaaagtgccattcgctgttctatttttgttaaacctttgctaaatattcttaagtcttgttggttttgctcttcttattaaccaccgtaagtaacctactttaagcaggtcccgctttgctctcatggtgacaaggtaacctgccaggagaggttatctttattccctgtaattaagttgacttttccccccaaaaaaatacaacaataggaagtgggtgctgaattaaataaatagcatgatacccagtagatgtatacttaagttccttgcaagaacagatggtccccagtatctctgtaagtaatgtgagaggacagttaatgttctgaaacaactagctataaccagtatgatactaatgaaccagtagatttcaaataataaaccacatgccgccaagcaaaattatatgtcattcataaggatttaattatcataacttgcaaaaaagtgtcaatagatgatttctatatttttatctactgatatcaaatatcaatttatgaatagagtttcacttcatattttttaccaataaaggtatgttttaacattaaggtagaattaaagttatatttaaaatacatgccccaaagtatgtggtgatttttttttaactcctcttttactatactgtctgtatgtattgggctgtatatggaaatgtagcttttacatacaattaggaaaacaattgcttttatttctagcagaaacttgtactataacagaagtggctagcatgggaatcagagtagttatcttgtagatgacaactgaagcagacataaaagatgtaatattttttcagcactcaaaaatttataagtaaaattttataaacaaaaagcagtatttttgtgattcatatggaaaataaaatgagtctgagtcattcttaaggtgataccgtaaaggtgtatagataagaagtccatttttaaatatacccaagacaacagttttttctctcagtatggtttgttttcccttttttctctttaattatgtttcccataagtatttgtatattctaagaatgtccaaaaaataaatgttttgcagtgggggttgaaaagaaagaaagacctttttagatttcagctgatcttatcagatgatctctagaaccttgaaccttcaaccttcactgaagttagctggagggcttttcacctggaaacctgagaaacctcagaagccttctgctttagctctctctcaagtctaggaagccagtggcctgcgaccccacagagccagctggtccactcctcatataagaacttcggtaacaatacaaagacatagcaaagcaccatctaatctgataactcattaaacaatatttagatggctcaagactttaaataaaaacattttaagcttgtttatagaatactaacaagttttattcccaaagactatattcagagtgagaaaacaattttccttaaaactaatattatatacatgttcatatatgttaggaactagttatatgcaaaatcaagtgactcttgtgattagaactggtcacatttattcatgtagcataaatggttaatattgccaaaatgagtaatagatcagattttctatgtgagatattgacacctgagagatttacagtgtttcactgttgtgaaaaatggagtgctgaagaacatttgtctattgttatacatttgtaaaagaattcacaaattactaatttcaaataagaactaaatatttcttctaagcctatagtttttctttttaatttcttctaagcctacagtttttctttttaatttcttcttgtaacattggcaaaaagaccattcgtgtgaaaacctcagattttgatctgtacacaaatgcaggagtagagattggaagcttgagctggaaaagcaggaaatactgctcagagccttacaaggattttcagaattttcactgttgggtcctcctggttgctgcagtctaacctcgcatctccttgaaggcagccccagtttctgatgaaatactcttcagttaatttatacatatgctgtcttgctgttttcctaaggactgcaggcagaactgtggttcacctactgttttaaatttggctagatttaaaaacagatgatctcacttatatgtggaatccaaaaaagtcaaacttatagaagcagagagtacaattgcggttgtcaagagctgggggaggggaagcaaggggatgatggttaaaggtataaaatttcagttagacagaatgaataagttctggatctattgtatagcattgtgactatggctaataatgtatacttgaaaattgctaatacctgaaaatcactaagagactacgtcttaaatgttcttacaacacaccaaaaaaaggtgtgaggtaatgaatatgttacttagcttgattttaatcatttcacattgtaaacgtgtatggtactgatcttgtacctcatttcattttccatatgaatcagaaaaatactgctttttctttataatatcttatacagcatagatacaatttttagtggtcaattatattgtaatatatacataaatatatatgattttcattggtcaattatactgtaataaaacagcaaaaaataaagttgtaattaaaaaataatttggaagaaaaaattagcaagtggttggagattgaggaagatgggaccaataagtcctccaaggagagtcatacattagttttttttaaaagtccattattaatcttataatatttaatatgtttaatttcttgacacttattaatccaattaagtatgagaacactgtggataaatctaaaaaccttaaagttgagtaaaataaaccagatacaaagaagcacatactttatggttacatttatatgaagttctagaaaaggcaaaacttagctatagtaaaaaaatcatggtcctgagggaataactagagagtggtatgagggagctttctataatagtgggaaaattctgtatctttattgggatagtggttatgtgagtgcatatacttaaaaaaactcatggaattatgcccttacaaatctgtaatttttgttggtaatttataccttaataaaaaacaaaacagatgacagggttagtgattgtttccttgaagaaggtctttacatgggtctgttgttaacgagttgtagtaaaaatcatccaaaatgcttggattcaaatcttagatctgttcctaccagatgtgtgaccacagacaagttacttacattccgtcttcagtttcttctcttttaggaaaaagcatctagtttttgttgtagagattaaattagataatacaaatgaagtacagagaacagcgtttggtgtgtaacacatgttcattattagctacccttattttttagagaatggaaatttttaaatttaaactaatcaaactattttaggataagcaagtgaaacaatctttttttcaatcgatcacagaaatattttcactgaagacaaattagacatttatataagcaaactacagtgtcattaccattcaaattttcatatgcatattcatgcttacatgcatatgaaagcattacacatatgtattctataaatatatacaaaacagtaatggaaatgtgctgtactattttgaacatctttctagtcagcccggcattttatttacttttgagacagggtctcactctgttgcccaggcttgagtgcagtagtgtgatctcagctcactggaggctggaggtcctgggctaaaggaatcctcctacctcagcctcctgagtagctgggaccacaggaaagcaccaccatgcccagcttatttggtttattttgtttgtttgtttattttttatttttttgtagagatgaggtctcactatgttgcccaggctggtctcaaactcctgggctcaagttatcctcctgcctcagcctcccaaaacactgcaatcacaggcattagccactacactgacctctacattttaatagctgagtagccttctgttatatgaatatacttttttttaacaaaaccaatactccattattgtacatttaggttgtttccaagtttcactcaaataatgcttgggtaagtaagtatttttatttattattattatttttttgagatggagtttcactctgttgcccaggctgaagtgcaatggtgtgatcttggctcactgcaacctccgcctcctgggttcaagcgattctcctgcctccacctcctgagtagctggggttacaggtgcacaccatcatgcctggctcatttttgtatttttagtagagatgggatttcagcatgttggtcaggctggtctcaaactcctgaccctgtgatccgcccacctcagcctcccaaagtgctgggattacaggccgtgagccaccacgtctggcctggataagtattattttagctaaattgtgcatatttattcccttagagtaaattcctggaagtaaattgctggatcaaaaccaggtatattttaaagaattttccttttctacattaaaaataattataattctgattacaagaaaggaaaattatggagcttcataagaaaaaattagtctcatatttcatacctcatattgcatatttaataggtaaccagtgttaaatttgttgtgtgttttccactgggatttctttttatctcctttaataaaagcaggatcagatccctcagattactttgtaacttgcttttattctactttttcatacctcttagcatgaatgtctttccagaccagaatacagagatttcacttactcatttatgagctgcagaagatgactatgatttattcaaccattctcctattgaagagcatgaatattgcttcagatacttttgttattataaatattagtgcaattaacattttaaagtcttttgatacatattcccaacttgttctccagcaattaccatttttgcattcccaccagcactggggctacttccctttagttgcaccatcatttagcattatttttgatcttgtgccaatctaaaaggcaaaaagtggtatcttgttgttttaatttgcatttctttgattactaattagattgaactttttcatttgttcattggtcaatttgcatttcttcttttgtgaaatgcctgcttgggtcttttatgtactttaccattaaagtgtttttcttgattaaatagattatgtaactgtcatatgttgcaaatatttctgtccatttggcctttgcttatgactttttatgagtctttaggacttttgaggtctttattaggtattcaataattttaatgttaaatatattgatgtctgtcttcctttgtgtcttacggcttttctatttaaggttacgtaaatttctaatatacaaatattggtgtatattatgaaatagggccctatttttctttacaaaagattagtcagttctaaatcatcctttgctatttctagcggcgcttagatgccaccattatcacatcagtgaatttttaaatgtgtaattgtttcctgatctattcatttctctattcctagatacttctattgtaatagctttaccaaatatatctgatagggtgtgtactccccctcattacttcatttatttatttatttatttagagacagagtttcagtcacccaggctggagtgcagtggcatgaacttggctcactgcaacctccgcctcctgggttcaagggattctcctgcctcaacctcttgagtagctgggattacaggtgtgtgccactacacctggcaaatttttttttttttttttttttttagtagagacagggtttcaccatggtggccaggctggtctcgaacttctgatctcaggtgatctgcccttctcggcctcccaaagtgctgggattacaggtgtgagccactgtgcctggccccctcattgcttttaaaacattttcttactgtaatatatttattccaagagaattttcaaatattttatgagattccttgtccattccttacatcaaaaaataccacggagattttgattgaagttctattataagtagttacttggggtggggggaggggggagggatagcattgggagatatacctaatgctagatgacgagttagtgggtgcagcacaccagcgtggcacatgtatacatatgtaactcagctgcacaatgtgcacatgtaccctgaaacttaaagtataataataaaagaaaataaagagaatactggcatggaaaatatgtaatcttggaacttgttgtatctccacttattcaatcctttgtctctcagtagattttgaatggctctttatcccacacgagtctagaatcattttgctaagtttattcctagatataatatgctaattgatatgggaattttttttatctccattataccttcttcttgggtgtagacatatttgtagccagcttcctcactgcatattttttattaggcctaatggcattaagtttattattttggattttacaaaaaaaattatgataacatctttaaatagttagtttcaactcctcctttccccttaaatccatcaattactgtcttttatttcactttccttatgtactgactagaatgcctagaataattgaatgctatgagtaataataggtattcttgccctgtttttggaaatccttctggatttcagtaagtgtgatgttggcttttggtttagtatctttaaatttgcaatttacaagatattttacattggaatagtcattgagttgttaagtaaagcacaaacatgttaaattcagactgaagtacaggacttcaatgaaaagttaaaagagtttatttcatcactttcattttttctttccctcagtggctgtttgtcccctccccccaccccgctccatcccccagcttccttcctttgtgctcttattgttctaggtttgactacataaaaagagactctcaatttatatgtgatacaagaccataactaatattataaaattagtctagaagaagttatttgcaacctatataataagggactaatttcaagattatttgaaggactttaaagattggtaagaaaaaaatagacaaccgtttagaataaggcaaagcatgtgtagaggcaactcttaaaaaaaaaaaagtgagctgggtgtgatgatgcacacctgtggtcccagttactagggaggctgaggcaggaggatcacttgagcccaggagttcagggctgtagtgcaccacagtcacacctgtgaataaccactccattctagactgggcaaacataagaagactctgtgtcttaaagaaaaagaaatgaaaagatattcagtttcattaattgtttgactagctgatttttggaaaatacccacaaatataaccaagcctacaagttattttaaggtgggtaagagatacatcttatctatatgcattcacctatgtgaagcggacacccagtaacacccccgtgtggaagacaagcttccttaaacttcacaggacagtatttcccatgtagtccatcatagggtgaggatttttcaggacctttggtaagcctgcttgctttcattcttgagggtagaggaagggtgcaagacttccctggtctctcccaagcattttggggaccctggccataagcctacttgctcaacaggtgcaaatgactggtaatatgctgaccagatgcaagtgtaccaccaatgatttgctgtgactgagtttggtttcctttgcatatactatccagctttttgtttctaatatattcttccttaagggaaccaggacttcttggggaatccagatgagcttgaaacactgtttttataagagaagggctgttttcaaaaacatctatagttcgtaacaaaggagttagattgaagggactctcactgttcagtctgtgacaagcatgagtgttaaaatggagacaagaattttagttaattgtaatgttgaatttgtaaaaggctataacttcataatatgatcaaggggaacaagcaatctaaaatgtgttaaagtagcattttcaaagtgcggtccagggactctcagggttggtgaggtcacaactgtttttataatattgctaagaatgtatatcactctccttctctccaaggatacggtggagttttccagaagctatgggatatgtggcgatagccttgccctaatggagtgtgtgctttgtgctttgcatttttgtcctttaaaaatgcttggttttaattttgaatacaataattatagatagatataacctacataaaccaaagttatttgcggccctcagtctttaagggtgcacagtggggcctgagactaaagagtttgggaattgatgttctagagaaaagtcagtcttactgatgagggttaatcaattagtatttactgaccgggacaggacaaaccattcattttataaagacacacagagcatttcactaaaatacttttactctgattaagtggtgattttagtaatagtaatgattgtttgattttctgatacctgaaggaaaaagagcctgttgaattgatactttgagggtgttgagttttaggtcactgggtgactgtagaaatggaccaggagaagaactgaaacttgagccttctaagaaatagaagaccaaaaaatgtttagtgttaccctatcccatgaccacaataattgagaaaaaggcctttccgttccctcttccctaccctcccccttctcccctaccctctcctcccccctcccctccccctcctctcccctaccctctcctcccccctcccctccccctcgtctcccctaccctctcctctcccctaccctcccctccccctcctctcccctcccctctcctcccccctcccctccccctcctctcccctcccctccccctcctctcccctcccctccccctcctctccctccccctcttctccctccccctcctctccctaacccctcccaacctttcccctccttctctgtccccctccccctccctccctgtcttcctcccaccccccactccctgtcttcctccttgtcttccatcctcccttccttcctttccttcctgtctttcttttcctttctttcctttttcttctttccttcctgtcttccctcctctccgtctgtctccttctccttgtccccttctctctgtcttgcctttcctttccttctgtctttttctttctttctctttctttttcactcttcctttttttaatttcccttttacttgccttctctctttcattccttccatgctttcttttttttagtggtatgtatactttgtgagcaatcagactatagcttgcagaatagttgggagaggccaaaaatgcccctgagaatgcaagcaaggaacttcttagtgagcatatgaacatcctcactccaatcggaggataacattgttcatacttcaaggactaaaaagctgagagagggtctctgctttctgttacttttagcactcgagtcatttctgcatgtatttctactgattactttttctcctattttggttcatatgttttctgcttctttgcttgtctagtgattttggattagatgagtgacattgtgaattttactgtgcaggatggctgaattttttttctattcctgtaaatatttttttggcattgttctaggatgtagttaagttacctggaaaaagtgacatccttttgagaggcttgcttttaagttttgttaggtggaatcacagcagtctttagccagctcactaaggaccaatactcttctaaatacttaccataatgtcatatgaatttccatgtttttccacttcagctggtaggaacacctgtgtcatctctaagcattgtactgttaattcttctagtagttcttatctggctttgtacatctgctgatcaatactttcagctaaagtctcaaggggacctctgcaaatctacagtgttcactgttcagctttctcttctgtagtaaattgcacagtgaactctagtccccttagccttcctgaacccccagttctccttaactcagggagatcaccaggccccaccaggattcctgtatctgccctgtgacctggagattctctgcaggcaataggttggggcggtcgtagggtccactttgttttcctcctcttcggcttcactgtcctgtgttacctgatgtccaatgtctgaaaactactgtttcacgtatcttgtgtgcttttgtagttttaggtgaaaggtaaaactagtttcttattattccacattggccaaagcagaagttttggaagtctttttttaaggtctaaaacacttctactttgagagtcaattgaaatggtcttttccacaataattattttctgacctatggtttaaagataagtcatgaaaattttatgccactatttttttttaagtctgattatggttaaattcagggggctatttcctcctagattgacagagtttataatgtttcctactcacaataattgtacttctgcttcctctttgcatgtgttactttaatgggaatgtatatttccttttcgttaaggctgccttcaacaatttgtcataaagtcacttctgttagtgaattctattttttctgttactttactctatccttagtaccaaagagctccttatgtgacaccaatttattactaaaatgtcgctttgtttatgttcttggaattcttcatacattgactatcctcagatgtcgaatgttgtaggcctgtgtggcagggactctcttccatttattctatttttaatctaattcttgacaaaataaacccaatttttcttttcttcccctttccatctcacgtagggactggcataaagggcaatccataaaattacaaatgatgaatttttttggttttaactattattcatacatttaagatatggtcacaatttttatttcttactagtaattcattttattttttaacttttaggttctggggtacacgtgcaggtttgttatataggtacatttgtgtcatgggggtttgttgtacagattatttcatcacccaggtattaagcccagtacccattagttatttttcttgatcctctccctttgctcactttctaccctctggtaagccccagtgtctgttgttcctttctatgaaacacaatggttttaattggaaaatttatttttttttcaggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggtaagtactcctcatgggaaattttaatcagcccagtttccttgatatacatgattaatctagacatgttttgagtaaaaacaactttagtgatgttgagatagtttccttctgttcctagtttttgtcgtgagaaagtgttgaaatttgctaaatactttttctacattaattgagataatcatatttttccctacatcctgttaatgtggtatcttatattaattgattttcatatgtttaacatccttgcattccaggaataactccccaatggccatggtgtataatcttttaaagatgctattgaatttggtttgttaatattttgttgagtatgtttgcatcaatattcataaaacatattgttctgtagtttttctgtactgtttgtctgactttggcatcagggtaatactggcctcatagaatgagttaggaagtaactcttgaatgactattttcatgaagaagcttcaataatctgaaataaaatacttaaataatttagttcacctgagagttgtttttagaagcgtatttatttttctattaatgtcttttttgaactatataagaatgtattctccttccactcacacattgatggcaagtgtgtatttgtactctgtggcctgaaaataagatttttttgaataatcttaagaggccatgctttatactctggtaattgagaattacctatttcacagtagctttttctaaaggttaatttccagagaaaagagaacatgtttattaggatatatctcttaatgaattcagtgtatctgaaatttctaaatgacattttcatattttgcatactaaataaaattcataagtacaaatataatgcaattcataagtacaaatataatgcaatttggatttctagaagttatctagttaaaatatgatcttaggatttattttttttgtcttagatttatgaatcttgcttgtttttctgttaattcatttcttcttgtttgctgcatcagtcagatcagagtagaggcagcttgtatagttgatggcacagtttagggttagatggcacaggatagaaatgggtgctagacaaagagcagtcacagaggcatgttagaaatttccagttccagcatcattgatgaagaaaaccatgaggacccaagttgatcaaaggcagccagccaataaagctatgctcatgcgagatgagctgaagtgacattacattaaaattggaagaccctcttactaagtggctccatgcttccctgctagcccctttgggacttccaagaagacttggttatttcaagaagacaagaacccacagaggctgtagtttagtttatctctctggaaacatagagaatatgtataattaaataaaagcactttaatagtgaatcctttacagtgttatttgaaatttatgtcaagtgatttaaaaagtaaaaatgaaaattaataatttcagtggaagtaaattgattaacatgaccaggaatacataaaacttgcatggtcttgtctataaaataaggatatgtcatttaattaggagagtcaaagctcattcttgcgcttaaggtctgaggaactcttctcccatggggcttatgaagggctacactgaggcaacttcctcaatatatctcagccataaaaccaagagaaagtaagaagcagaggacatcacaacaaagctcaattcagtaaaagcaattttataggagtagagggacttgtcaaaaacaaaaacaacaacaaaaaacaatgtccaaatatttattcagcttaatgagtgatgtttttgtttgatctagggttaaaatctagacaaattacagagatgaataaactacatatcctttagtctaccatcctctgaaaatgttactttttgaaactttgattttgataagagctggaggcactcagggagtcattctctggcatggtctttgagtacagagtgattttgctgattaaaagcaaatagattgacttttaaaatcaactcatacaaacaaactgttaaaatcctctaatgagagtgaagaaacctaaccaagactgactgatacattactgctccatctctgcaccaaagtggactcagggaggcctgtaggagatgccaactccttatcctactccccacaaagacagttcttggctatcttcatcagacacaaatgaatggttgaggctccaaagctctctaccaattcttgtgttacactggcacttttaaaaaattttgtttattttttatttttaaatggagtctcactctgtcaccctggctggagtacagtggcgtgatcttggctcactgcaccctttgcctcccgggtttgagcaattctccctgcctcagcctcccgagtagctgggattacaggcacccgccactacgcctggctaatttttgtattacttagtagagatggggtttcgccatgttggccaggctggtcttgaactcctgagctcaggcaatctgcccaccttggcctcccaaagtgctgggattacaggtgttagccaccgcacctggctggcacttctcttaaaactaatatctcaagaagttttttctttaagaatcttctttcaattgcaggtccatgtagttctggtattcattaaagtgcctatcccaggggttttggtatgttgtgtttcaattttcatgtttcaatttttttgatttatgcattaattttgttttttcagaattcaggtgcaggttgtttagtttccatgtatttgtgtcgttttgagaattcctcttgttcttcatttctaattttatttcattgtgacctcagaagacacttgcattgattttgattttttttatcttattgagatgtgacttacgactatgtggtcaattttagagaatgttccatgtacagatgtgaaaaatgtatattttgtgttgttgggtggaatattctgcagatgtctgtcaggtccatttggtcaagagtctgatttaagtccagtgtatacctttgttagttttctgccatggtgatctgtctggtgctgtgagtggggtgttgaagtcccccactattattgtatagctttttttccccataggtctagtagtatttgttttatgaacctgggtgctccaacattgagtgcatatttatttaggatagttaaatcttctggttgaattgaaccctttatataatgccctcctttgtctctttttgatgttgttggtttaatgtctgtttcttctcatacaagtatagcaacatctgttcttttttaattttctatttgcatgctagatctttctccatcccttcactttgagcccatggttgtcattacatgtgagatgggtctcttgaattcagcagaaggttaggtcatttaaaaaatctaatttgccactttatgtcctttaagtggagcatttaggccatttatgttctaagttaatattgatatttgaggttttgttcctatacatttgatatttgtgtattgttaagtagttgctttctagtttgaattgtgtaattgctctataagatctctgagccttgtacttttgtgtgcttatatggtagcaagtattgttcttttgtttccatgtttagaactccttggagtatttcttgtatggcaggtgtggtggtaacaaattcccttagtgttttcttgcctgggaaagactttatttctccttcatttatgaagcttaatttggcagattatgaaattcttggctggcattttcttttttctttaaggaggctaaaagtaggcccctgatctcttcttgcttgtaaggtttctgctgagaagtcctctattagtctgattggatttcctttataggtaatttggcccttttctctagatgcctttcatattttttctttggtgttgaccttgcatagtctgatggactatattccttggggatggtcatcttgtatcttgcaggtgttttctgaatttcttgtatctggatgttaacctctctggcaagattagggaaattttcctgaattattgcctcaaatatgttttccaatttgcttacttcttcctcttctccatcaagaatgccagtaagtcataggtttggttgctttacataatcccatatttatcaaaggctttgttcatttttcagattctttatgtttgtctaactgggttaatttgaaaaggtggtcttcaagctctgaaatcttgtcttctgcttggtgtagtctgttgttaaaacttccaagtgttgttttgttttgttttgttttgttttgagatggagtctcactctgttgcctaggctggagtgcagtggcatgatcttgactcactgcaacctctgcctcctgggttcaagcgattctcctgcctcaccttctggagtagctgggattacgggcgagtgccaccacccccgactaatttttgtattttttagtagagacaaggttttgccatgttggctgagctggtctcgaactcctgaactcaggtgatttacccatcttggcctcccaaagtgctgtgattacaggtgtgagccaccatgcctggcctgcttccaagtgtattttgatgttccctttagtgaatttttcaattccaaaagttctatttggttttatcttaatatggctatctcatgtttcatatcctgcattgtgtttctggtttatttgaaatggattttaaatttctcttggctctcactgagtttccttgcaatacatattttgtttttttagtctgtcatttcaaagttttcaacttggttaggatccattgctatagagctagtgcaattctttggaggtatgaagacactctttttgtagtgttggagttcttgggcagattccttcttatctgagggagctgttgattcttatttttgaatttcctattggttgggcgggacttaaactttttttttttttccccttgagggtatgactatggtgtatgttgtgtgtgatcattcaactttgtttctgggtgctttcagggggccaaggctctttatggattccttgggcgtggtagctttcttaaatgctgcttattgtagcaatgtattggatttgtgagctgacactctatctcatgtggggctgagggtgcagaagtctcaggaagcttattttgtggagtagtgctaagcctttctggtagtgggctttttatttgatagtacagttcaggctgcaatccagtagatggcacttaaaaaataagaaccagcttgccctcagttaggctgatgtccagtagaagcacctgtcctgacaggggagtgacaggaagagattctgttggtgtgtgccgaggcctttggggtcgctggttggggggagatagggggaggtgcactagctcctcatgcaggaatgtgatctgcttttctatcataccccatcagagggctcatgaccttcagttcataaagattttttccttgggttcccagccatagtctgtctgtaggttatgcatatgcccctctgaaggcaaccaccaaaatggtcttggggcagagcctcttcccccagtctagggcagacaactccatgacttgtatgtcctccattgctgggacactgctgctctgtgtagggatggggagttgggccccaccctttatgtaagcctaagtggcattctcactttcagcaggggtggagccatcttgaaaaccatgaaaaactctttcttcgagtacctgtgctggcccccagtgggaagaaccactgctgcgtcttcaacagcgtgtggggtgggagggtattgccacagatgaccccctctccatatccgttccttgacatggtgttgccccctttagcgattggcactgtgcccacctttcctttgtcccaaaggggttttggcaagttgtgtccctctcccttataggtggcctacactaggggggttagatctctagaggttccatagctccctgggaacttgctggccccctgggcttttcaaagtcagaacaggttatgaggtatgtttgctggggatctggtgctacagagactcaagggtagagaatccctgggcagagcagaggcccaccactggtgcacaagcaatatggtgaccaccatctcagtttgtgtctgaggggagtatgggaacccctgcaggagctggccacccagttctctatccctgggaaattcctaaattaccaccaataacattgccctgggtcacaagggtggggccttgaattctttgggggttgatctctgccagactctagctacttttcctttctgcaccccagcttcttcccatgggcactccaaaaggtcctggctctctttccccagttttccattagaaacttgtccatttgacagtaactttgatcttctttctaagaagagctggcatccaaggtctgtggtcagctatgttggaaaaaagaaggagaaaaaaactagtttgtattaaattctgaaagactagtggcactggttaagtctttaaaggattgttaacaaaagaaaatctttttaaaccaaactcctaattttatcagaattgtaactgaaaatataaatgtatgaaaacataggtattatgtaaaatttgctcaataaaagaataggaaaaactactatttatcttggactgatagcatgttagtttgagatttgaaccctttctactctagtaagtagtggtgggaaaaattcactgtaggagtctgcagacataacaaactatcattagactgccaagacctccacataataaagcaagcagagaatgtcaaataagtatgtgaaaaatgatcaaaaaagagaaattgaaaatataaatagggtgctattaaaaaaggatagcatttatgttatgacatatgtacacatgaatatcactttttagaatttcatccttcttaggacttattcctgagtccgaggattgagaggttctgataaaataagtctcagtgggttccaggcatgggctttctttaaaagtctctccagggattctaatgtgttgccaggaccaagtaccatggacagccaagatctcatcagcacagtttgattgaatgaacttatgtagaaccctgaatgccacacttaaccaaagaaacctttccagggattaattataggtgacagaacatgctatattcttattaaatattattaaaagttaagcaatacccattcctgattcatgtaaaattctcacttattttccaagagttttactgtatgactggtttatgggatgcttggaaaaggttgacagacatggcaaaggttcctgcagtgtttctctttgtccatcaacagccctagctcataacctctaccctttcagctaaaagcaattagctcttcagaagtgattcattctatttatacttgggataagtaacatcaggcagtcttccctagggcttctcacgggccctggtggcatttttattctaagagagggttatatttttacatgtaattggtcataattatactaaaaacaagtaattggtgtcttatacaagaaaattatatttctgctttagtcattgacagagtatcctgagaataagagttaagaagtatattcattgtcatcttatttctgatatatttcaaattcttttgctaggaagaagcccttttgactgtgctttgtgtaacaaaacttcttcggagaaacaatttagataaactttgtcagatcttatgtgattatattcaaaatgctaattgaagattctctaaacattttcagtaaaatgttgaattgttttcatgctgttaaataagttaacatgtcttcctttactaaagtcattattataaaaatgtaaatcctaatgataatagctgatgtttattaagcatttagtaggttccattttttgatagcaacttttatgaattatctcattaaatcttcataataatagcatcaagaactacaaatatgttttcatgtaagaagggaaataaaattatgagttttgctgtgaggtttgaagaatgaaaacaatgcatgacttagaaaatagtataattaagtgaattttattatcattatcatctcttagtttataaatgaaaaaactaaggcttacataatgtaaaaatcagttaacaaggttaaacaaccggtagatggtagaggaggagctgggaataaatctgtacatgtctgaatctggagcaggaacccttaactgatgtgtcattctagcaggtcatcagttactctacaatacctattaagtatactttatttactgtgtttagatttatagtagatttagactctactgtaaaaacaaggacttcatacacctgctagaaagtatccatatcatcttgtttgaaagttgtcccgctctagtgttcttttctaatcatgatgattcagaactccaaactcttgaagcagggcaacccgtagggtcagcattcataatttctcaatacttaaaaaagtttcctcatgactgttgctattattgagatttctcaaatgtcttggcctgaattgggtgtgcactatgaaaaaaaaaatggcagacatttctttttgttaaaggaattttaaaaacacatataaacacactgatttgtgacagattaccaggctttatgtttagcagggtttcctaagcaaaacacaaattctgtaaatctacagaattagataaaacattgactcaatccttagatgagagtataatggattatcacttaataacttctgtcactgaaaataaatgatgtaaaaagtaataaagttctactctcacagtatgaataaataggaaatacataatactttaaattaggcaacaaatcattaagcccccagcattcattagactatcattaatgataataaaattgtgtggtatttatacagatattatatgtaactccaggaattttgttataattgtgtatgaatatatttgttgtttgaggcaggtagatggatatttgcagcagctatgtgctgaagcattctggtaatagttttcaaatcaaccatttttttctccttgtcgatcatctttaaagcaaaagcaccgttttttactatattttttgaaaaaaatacattaggtgtaaaattatatattttgaagaagttcactttctgtttttactagtttcacacctttgttattttttcagtggaaggagcagagataggcaaaggcgaagcctgtgtgtgtggtcaggttcctgggcccttcatagcatctgatgccaagctgtgttctcttttgtgtcattgccttcccacttgctaattacgtgacagagctagggacttccctctgtctagaatgccccccatctcttgtttgcctagtgaaatctggtttgaagttcaaggtctgatacaaaccaggtgatcctctgcaaaactaactgtacctgagcaaaccaggcacttactcttttatatgttcctggcactgctgatactctgatagaaaacatcatcacttaatgctaactgtgggctcacaaaggggatacttctactgtaagaagactgtaactcttcttagcacagagattagtaagtacttgaaacagagtttcacatataataagtgttcaataaattttattttttatttctaacacttggcacactgcatagctcagtaaatgttggtgaagtgaactgagtattctccttatctattatgtggtaggcattattctagttgcttctgttataaaccaactcatttaatccttatcacagcacttttattgtggtcaatattttttaatcctcacagatggctaaggaatcagcactctgagagattggttgacttgctttgggtaaggtgcttataaagtggtagaacaagattcctatccaggccttctgattcaaaaatacattctttttttttttttttttagtagtgttttctggaaaggcagggtataactgactatgctgtgtatttgggactaagtatattattgtcaagtatattaaaaatgtcgcaacactggaaaggagtccatcaatgggctatgcaggttgagggatttgtagatgagaaactgataaatttggttagcaaggaaagccatcaagctgtgaaccctttatattggcaaaagagagggtcctttgaaatctaagggaacagaactttcctgttctccaagtttggagcagaataggtaagctctaggcagtctaatgcccaacttttaccagtggtgttttagttttttttttttttccaaaaggaaatgatggaattctttatatacttctgaattgtctatcttttcaaaaataaaaattttcattttgcagtacatacagaatcaaaagactttcaagtcctaactccacaaatgtttattttgaagctctttaaactgtttaccacggatattagtaaatctgtcagaaatgaggtgacttacttatccttgtcccaccagatatgtgggaaggatgatcacgctagatagcatggatgggtcctctatttatctctttttacttgaatggaaaacacatcattcagattaatcaattagtcattgtgactgatagaatttttatatggataatctgggtttggtccctagctttaccacttacttggggtctttatgtcttctatggtctcctatctgtaaagggaagttgataatgccaatctagctaggttactgagatgcttaaatgtgtaatgtatgcaaagcagcaggtactcaataaagggtaactcttactattattgtatagctctccaggtatgtattgagcttctatagaatccatagccccaaactctttagccctttgagaccaagattaagcattgtctttccagaggagagggtgagagagattgccattatactaatagaattcatcattatcaccgtcatcatcatcatcatgatttcttggtgtgtcatggaatgtactgtgtttcacattaccaacagatgttaattttcacaacatccctgagacaagaaactatgattacattttacagataaggtcatgcagctataaagttgtgaaattgggattcaaactcaggcagtctgtccccacagtccatgttcttaacccaccatgctctcctgacacttgaaaagttaggaggcgtactccatagcctgtaatgttgctgcagagagaatctaattttaaatccagtgaagcatattagttgctgtctttgatatgccattcagattgtgctatccttatgatgcctaccttggttgtatatgtaactgggcgtcaaatatataaatactcaaaaagtgataggtgccaataaaatattttatagttaatacttatgtaatctgtgttctctgtgtttgagggctggttctaaaatactgctctatatttgacttctggttaaaacaataaactttgctcatattagttatatagttgataccattctcatgttgctaacatgtctgtaagtaacagttgaaattgatctggcaattttagagctgtcagacccaggagatgagagaaacatttaaaatgtttataacattaaatcagctgagtcaagagagagaaagagaaagatgattcagatttcttgtactggtggatgtaagtgcttggaactgaaataaaggagaaggtgtagggagggagaaagataaagaagtcttccctttatacaagttgaaattgagttttctttgagatatagaggtgaagacattttaagaaacttcttaaaactctctaatgtggcttttcaacctgtttccatcaatttggcacatctcacttttcggcacaacagaatattctaggtttatctcacaccttccttgccccagcccaggaatcagccatttctctaagaaactcttgtttattttggtggggaacagtattgggaaaccaacatctgggagctaaatatactcctagtggttaggaggtcataccttgtagactcttgtagctgacggagttaggacatatttattagaaatcataagtttatattgatcttgctaggatctatccaatcctacaagattcttccctgtgtctctcctttgtatttgtgtatcctttcttccatattaagaactgtggctcccaacaacaaggcatgtgcccatttgcccaatcgtatgatgtataaaaactactttgagaaaagtggcagccaaaccactaagaaaaataaacttgctgaaatgagttcaagatttattggcagctctttttttggcccctagactgaaagtatatatttcaagtattgtgttcaaaaattatttgggttagctttttccacctttcataatagtaatattatttacttgaaatacagttggctttgtttctatattcagtttttttctctctatcttcattaatttcattatatatatttaatatgtaggacattaacatgtttccaaaagaagaaaacactccttcctgtatcatttccacctcatctctcttaccccttataggtaaccaattgcactggtttctagtttatcttacttatattcctatttgaaaagttacctcatatatgtatgttttttaaatttttatacttttttacacagaaagtaacgttcagtatgtactttgccactttccttttaaacttaacagcgtatactggaaatcactccatatcgtgtcacagagagcttccttatattttttaatagctgtataagacttcattgtgttgtctgtaccatattttattcacttccccatgtgtggacattttgactgtttctagtatctgcaattactaataatgctgcagtaaactttgtgcatatcgtaccttggtaaatttctagacatagatttctgggttaaaggttaagcacatgtgtagttttgttagatattgataaattcctttccatggggtttatatcatttttaaaatatttaccagcaacgtataacagcgtccattacttcaaagcctcaccaacagattgtatgttttaagtacttttatgttttagaatttttccaatgcgataggtaaacaatggtatatcaatatagttttaatacattaaagttcagcatcttttcaagttcggctagtctcagggctattcttaatatcttgtgaattatcttcatattattttcccatattccataatacttttggttttttttcctcctcaattctgacaagttctttatatttcaggaatattagccattttatttgatatgttacaaatatttttctcccaatatataacttttctcttataacgatttttttttcatgaaaagtttttaattaaaaccttttatgggcccaggtgcagtggctcacacctgtaattccagcactttggaaggctgaggtgggcagctcatttaaggccaggagttccagaccagcctgaccaacacagtgaaaccctgtctctactaaaaatagaagaacattagctgggcttggtggcacatgcttgtgatcccagctactcaggaggctgaggcatgagaatcacttgaacccagcaggtggaggttgcagtgagtcaagatcgtgccactgcactccagagtgggcaacagagtgagactctgtctcaaaattaaataaatatataaacaaaaccattatgggccaggtgcagtggctcattcctgtaatctcagcactatgggaggtcaaggtggttgaatcatttgcgccaaggaactggacagaccagcctgggcaacatgggaaaaacctctctctaccaaaaaagaaaaaaaaaaaaattagctgggtgtggtagcatgcaccagtagtcccagttactcgggctggtcacatgagcctggggaggtcaaggctgcagtgagcagtgattgtgccattgcactccagcctaggcaacagagtgagaccatttctctaaatacatacatacatacataccttttgtggagttaaatttacacactttttctttattggctctggcttttgcattgtagtaagactttctttacactcaacttatagataaattcacccatgttttcttctagtacttgcatagttgaattttagatctctagtccatttggagtttattttttgtatggtagaaggtattgatcctattttttcccaaatagttgttacccagttgtcccaaaacaagttattgaaaagtccatctttgtcccagatagactggaacaaaatgaattaaagacttaaatatgaagatttttacttgtgtatcctttcttcctagaaagaaaacataggcgtaaagcttcatgacgttgaatacttcatgccattggtctggcaataatattactattatgaaaggtggaaaaagctaacccaagtaacttttgaacacagtacttgaaatatatactttcagtctaggggccaaaaaaagagctgccaataaatcttgaactcatttcagcaagtttacttttcttagtggtttggctgccacttttctgaaagtagtttttatacatcatacaattgggcaaatgggcagatgccttgttgttgggagccacagttcttaatatggtagaaaggatacaccaatagaaatatttatatttaagtctggcaatcatttttaagatgtgaacttgaacaggcaacaaaagcaaaaataggtacgttggattacatcaaacccaaaagctcttcacagcaaagggaacagtcagttgagtgaagagacaacctatggaatgggagaaaatatttctaagccacacatctgacagagggttaatatccaaggtatataaagaactgcaacaactcaatagcaagaaaacaaataacatgaataaaaaatgagcaaaggatctgaatagacatttctcgaaagaagacataccaatggacaacatgaaaaaatactcagcatcactaacaatcagggaaatgcaaattaaaaccacagtgagatatcgcctcacacttgttagaatggctgttatcagaaagataaaagataagtattggtggggtgtggagaaaaaggaactctagcccactgttagtgacagtgtaaattagtatagctgtgatggaaaagagaatggaggttcctcaaacagtttaaagtagaactaccatatgatccagcaattccacgactgggaatatatccaaaggaaatcagtatattgaagagaactgtattttagtgattattgcagcattgttcccaatagccaagataagggatcaatctgagtatctatcaatggacaagtgataaagaaaatatggtgtgtatacacaatgggataccattcagcctttgaagagaaggaaatcctgtcatttgccacaacgtggttgaacctggaggacattagctgagtgtaataagccagccaccaaaagaaaaataccacatgatctttcctatatgtggaattttaaaagttgaactcaaggaagtagaatagaatggtagtgaccaggggtatgcgataggctgagggatcaaggagatgttggtcacgggatacaggatttcagttagataggaggaagaagttcaagaggtctattgtataccatggtgagtatagttaattataaagtatacttgaaaattgttaagagtagattttctgttcataccacaaaatgataagtatgtgagataatgcatatgtaaattggctcaatttagccatttcacaatgtatatatatttcaaaacaacatgatgtacatgataaatatacagtttatttttaattaaaaattttaaactctctaattggtcttcaacatatagtacacaagtcttttcacgactctttataatggaacatatgttcttggaatgctaaaaattattttttttggaggccctgcaaataactaaaaatttatcttaaaagccacacctaattacttacatatgatccagaaaggatactttgaaaaagctttttaattgataaaatcattaaggtaaaacatattcataaaagtgttctctaataattttataattttctagttcatgaaggattaaatatacaactatcatttgaattggattttttatgaggttaattgtatttaaatgctaattattttaactaattttgtggttgacttctatgtagagtagggaaaaagaatttcctaaagccagttacgtatatctctttttagtctggatttttaattaggaaaagtgatatagttaaataggtctactctatagcatcttctaaaatgagtaaaaattcattatatcaggataaaaaatgataaagatatatggatgacacatttggctgaatttttcttcttcgctgttctcttgctctctatttaaatagtcttagctcttttatcatttaaattctgaagtattgaggtgattattccggcagcaggtgattctgctaattactgttcagtcagttttagctattagaaacagagatatgtttacattgctgggctgcatgtaaatttagaagttacatggctttgtttttactttgacttacggcattaaaattattttcatctgtgtatgtaaagatctgcatctataagcttttgtggataataaggtgaaattgatgcattttaatataaattgccaatataaaatatctctaactcagacctctactggaaagttgtcaaatcttatgtaggaaaggcttttaccatcactgttacacattaactgggcatagtttaatattaatagctcctgagacttgtggttaactgaggtttctatttcctgtgtttgggttttatctttgcaacaacttggttgcttttctgtgtaaaatagtggtgaatatacacaagagtatgacaaggttctgggctcttaactttgatgaacaccatgccatttccatcatgctgcactcaaaacagcacagatgtgagtctgggagtggcgtccctgccgctctcatgagcctttgtttggagaacaccctgattaacccccacccttcacggttcattgactcactgatagatcaagtttaaactagtatatattagcacatttgttaccaacagaggaacagttggccattctgttttacattgctggttcattgcaaactggcgtgctaaaaaggtctgtactctagagtatgaattgggaagttaccaaaggactgagaaccaagtcagttgcatattaatgttgaattatacctatattttaatcttggattgtctacttgggggatgcttacactgttgtcaagttatgaataagtgataattaccactttgaaattcatctttttttttcaaggagtttaggggatttaggtgtctcaatatagctttcatattaaacagtttgtcataattggatgagagcagagcaaggtcatgactacctgatgccttgtgttggagcattttaaaaatgttttccagagagttatttgtacctaatgactttacataagtccttacattatactttatttctaggtcacctaaaaatgttaattgtttagtcaagagggttaggatgtgtgtctgttttctcatgaaaaaaattaagctgttccctttttatcaattttcttgcaatctaaaggcttttttttcttaccttcctaacctagtgactaaggtcatcttattgttacagttcctttcatgggagataggtttactgcatcatttggcagtttcatagggtgaattttgtcttggcttcatctttccttactggttgtcatcccctgggccacctgcttttttgcattttcctttctcttgtgagatgatgaagctctgtgccccgatggggatgagagacagcactctgagttcaagtctaggataaggcaatgggcttgcttttcaaaacaaactagtgtcatacgggctgctgctttcaggtccactgtctgattttatcactgatgacttgtttctggaaggcaaactgatttaagttctgagcaaaagggtcggtgtttattttcaatgctactattaatttagagttttaatttagaaaagattttttaccagttctcaaatatgatttttctattgactttaagtttgtagatataaggagtagacatgagatagagactgaattgcttttttgtttttaaaacttggcagtaataaggggttgcttgttttttcatgctaaatattttttctaagggatctagatacctatcagaaaacttaactttgataactctggttctttattaagtatttttgtcttattttaggaattaatagaaatagttgtaattttagacttcctttataaaataccaatttaaagagaagctttttgcttaaatgattgttttgcagtgttgtgcttttgttttctttaatgcagttgaaatcgcagctttataacttattttttaatttggggtttttaaaagaatattagttatttatttatatttattgggcacctactgtgtgccagacactattctaggaactagtaaacatagcagagagcagaatcatgaagttcttgacctcaaggagcttaaatcctagtggtagagggggaattcaaaaaaatcaaataaatgtatttctattatgtcaagtgatggtatgtactaccaggcaatcagatgaaaatatttcctcttctatacacagtgggcaaggaaggcttcattgactgtggagttttagaagaaagctgaaagtaatggggaaagagagccatatcgatatatgaaggaaaacatggtccaagcagaggaaacgaaaagtgcaaagaattgagcaagaaagtcatgttcaagtggagtcagcaggggaaagagtaggtcacaaatgcggctgagggtgggtcatgaagggccttacaagctttgtatgagtttttacttttattctgaaaaaaacaaaaacaaaaacaaaaaaaaccggggagctatttggggattttaatagaaaagtaacataatttccttttaaaatggatatgtggccactaagtggagagagtggtgtatatatgagtggatggaataattgatacaggcaagcaggagacaggttaaatgaaaaatggattaatccaggcaaaagatggtgacttaaattaagctgggagtgggagagatggtgagacatgcttagactttggattcatttttccagatagaactggctgacagagacatgtcatttaccaacatagacatggcagattttttttttcttttctgagacaaggtcttgctctgttgtccaggctggagtgcaatggtgtgaccatagctcatggaagcctcagactcttgatatcaagtgatcctcccacctcaacctccctagtagttgagattacaggcatatgccactgtatccagccaactttttttttttctgtagagacaatatctctctgtgttgcctagggtagcctttaactcctggcctcaagcattcctcctacctcagcctctcaaagtgctgggattataggagtgagccaccatgcctggccaatatggcggttattaagaggataagtcaaagattacatgaatattctgttatgaaaagtgtcaaacatatagaaaatataaacagtattccagtgggcacccatatttttatcaccttgattctacagatcttaacatttttctgtatctgcttcaaacattttattctgccaatgtgttctaaagtaaattgttgatattgtgatagttctctccaaaatgctgcagtgtgtagctctaaaaatagatatttttcagataaccaaatatcattaacctgccaaatcaatgaatgataattgcttattaacatttaatacttggtccatagtcaaattctccatattttccataatgtcttttatagttaacttttaccaactagtgtctgatcaagaatcattcatttaactaattacatttaaactgtaacattacaacatgttttttcgtatgttttattctctctgacattgacttatggaagagactagattatttgtcctgtagacattttatcatacataagagttactaggagagctctgattactagtccccactctcagaaattttgattcagttgctctttccagtgagctgctggtgatgctggactttcattctgaagaccatactttgagcactactgctgtaccactatccgatggcttctttgtgatatcgtttaacttgttgttctgttgcctgtatttcctctaaactgaattttcaatctaaaggcttactgagattcatgtttgatactttgggcaagaatacttcataagttctagtgcttaatgttaggtagcacttaattctgactatttcactattcatgaggctaagctaaggaggtgacagcctgatccttctattgtaatgtttcatgtgaaactactagataatttgttgagttggggggtgggtagggaagagatatctagttttcaataaatatttcacctaatggttttaacacacattgatcatccttgcctgaactaattatttaattagggatggcaacatggagactttctaattcaatctttttttttttttctaaatgaatggccttgtttttatttttaaatggatgttacttcgcaactggggttatttgattacccagaaatatagcgcatattaaaaaggtaggataaatgcttagttaactaattaagcaatttttaattaccagttttcacagtaaggcactaaagtttctgacttgagcaaagataaagtggaaagataaagtggtcgtttagtgagatgggcaagactgtggataggtagactaggtttggtgggaaagtcagaatatcagttttgaatatgttaagtttgagatgtctattagaaacatatgttgacgaggccaggtgcaatggctcatgcctgtaatctcagtactttaggaggctgaggtgggcggatcacctgaagtcaggagttcaagacgagcctggccaacatgtgaaaccctgtgtttactaaaaatacaaaaattagctgggcttggtggcatgcacctgtaatcccagtaatcccagctacttgggaggctgaggcgggagaatcacttgaacccagggggcggaggttggagtgagccaagatcccgccagccactgcacttcagcctgggtgacagagcgagactccatctcaaaaaaaaaaaacatatatatatatatatatatgttgacaatatttcagttgaataaaataaaatattctagctattttaggtagaaaggcattttataccgatactactactaaagggtaagaagatatgactgtagtacattaaatatgctgatggcctacaactgttgctgtgttgctttttcctcttcaccacacatatgcagcctcatgaaacattttccatgaccagcacactgaaggaaataaaaggaacctagtttagagatggttctgcatgatacaacaaaaatgagctgctaaagcattacaatcccactcaagagtattcccccatcaaatagtggggctggtattttaatcagttgatactaattgtcaaggtgtgatggccaagggattgatgtttatcagtgtatggacagtggttcagagtttggtgaattagtcgagttgaaagagaaagattggtgacaaagatgtatgaggtggaaagtatactttcacagaataagaacagaaaatgagatttatgtttttttgtaaacgttcaacaaagaaaattcattcagaggaggaaataggtaggcaagatgccctattctacagatgttagtcagcatcactgcaaagcaacctcagggcttatgcagtggacacttaaaatagcactggtgcagggatgggagaaataaatggatttaataagcactgctgcttaccaaggttgattgaattgccactattgccaagtgttctacctgcaaacagatcaaccttgagccctggatatggcaccatgtcccagagcaaccagccagccacctggtggcaggttgattgcattggatttgctccattatggaaggtcagtggtttgtcactgctgcgatgaatgcttactgtacgtttggatttgcattccctgcccaccatgtttctgtcagcaataacatggccttattaaagccttattcaataatatgacatcctatataatattgcttttgatcaggagactcattcacatcaaaataagtgaggcaattggctgtcaactacaggattcactggtcttaccatgttcctgttgtagcatattgtattctacctggaagatgaaaccttgtgacattaaagtagtttttagttccataaacataatacaggggtctatgaatcaagaagtggaggtagaagtgttgtcttttacttcacatctaatcacatgttcaaaatattttttcatcttgcctctgcaactttgaactttgctgacacactgaggttttagtgtgaggaaacaatactttcacatgggaacatgatagtcgttcaattgaactggacatttagaataacctggccacattactgaactgtataactgaaacaacaaatgaaaaaaatgaagatgctacgctggcaaagatgattaattttgattattgggagaaatagtattgctactgttaggaggaagactatatgtctagaaactaggaggaaacctgggttgcctccttgtagcagggtaaaatgagtgagtaccttgtctaagaaagggaacatgaccaaactgaacccagaagacataggaaatctaaacagatcaattaacaccaaagaaacgggcattttttggtacttctaaaaaagtaccagactgatattttcacagagatgttcgttatacccttaaggaacaggaacagaaaacttctatactatttaaactattttagaggatagaaaaggaaagaaaactccagattttatttatagaacttgcatgaaattgataccaaattctgacaatgcaagttcaaaaaggaaaactagagatcagtgttacttatgtcaaacagctcttaatagaatagatggatatggttatcaacatgataaatatgtttatcacattttaaagcctacatggagaaacatttgaggttttcttattctagaactgacaggaatgtcctttattatgagcactattagtcaaatttttctggtggaactaatgtaagtagactgctgaagaaaatgaatggtatgaacattggaaaggggaaattaaatgattattatttacagataaaataattgttaagctggaaaatccaagtgaataaagggaaggcctacaattaagcagttaaggaaagggctaggtatagaaatcaatagttttgatatatgcaggctatagccagttaggagatcagttaggggaaaaacacgttgacagcagcaacgaaaagctgataaacctagaattgttcaccacttatcttaaaatgtttaacatggtactgagggacacaggagattatttatgtggaaaaacataccatgtttctatacagaaaaattgaacatcacaaaagtattatttgatcttaagataatttatatttaatgcaatctcagtgaaataccaggagaatgtttttaagctagacaaacttatttcaaagatcatatgtaaaaataagcaaaaatagatgtgaaaaattctttaaagtaatgagagaccagtcttattgactattaagtcattataaaactataatgtttaaaagatggtactgacatatgaatagatcagtggatctcagatgggcagtgcagaaagagatccaaacacatacaaaaatttagtacctctaaaggtggcatttaaaatctgtggggaaagatggattttccaatgaataatgttgggataggtagatagccatctggaaaaaatgaaagtcaaatcccaactttttaccttttatcaaaatgaacttcagatacaattgaaaatataaaattgagaccataaaagtattagaagaaaaatgcagtttttaagtctcaaaaggggactcttaaatatcatacaaagcccagaggccataaaagagatgattgataaattcaaatataggtccgtgtaagcgaaaactttcagtatggagaaaacataagttattaaggcaaatgacacactaggaaaagcatttgtaactcataacaagcctagttttcttactgtgtaaagtactgccataattgacaaagaaaatatgaagaattggcaagtgacatacatagaaagttcatggaaaaaataactcttaaacatttacaaaattttacaacctctcatgaaaagagaaatggaaattgaaattagagtcacatacagtatttcacttttcatttgtcaaagatcaaaaagtttgaacatactgtgggtttatgtttataaggatgtaagaaaacaggcaatctaaattccttgtagagtgtaaattggtagtaataagagaaaaatttactgaatactttgtgccaggtgcttttctaagcactttacatttaattatctcaattaacttatccagaaagtaccattatttctgtattacacgtgaggaatttgaagaaaagttagacaagtaattcaaagtcacacagttaataaatgacagagtgaagatttgagaccatttcctttttctcaagtgtccacttttggtcgcaactctgctgtttctgtagtgagtgatttaacactatatgataaaaccttaagagtacgtactctttgatccagtgattctacttccagaagtttgtccattttgcatcaaatagatggagaatagcattcattgcattgttatttgcagtaaaggaagattggaaacaacctgaacatttatcctcaaggactcatccatacaaaagaattgaagtaaattcatccagatgaatatgaggcagctttagatagagtgagatggcatcctatgtagtgatatggagtcatctttaaaatacagtaaaaggaaaaagcaagatacagaatagcatgtagggaagctgctgtctatgtgaaaagctgtagaatatacgtgcatttttgtatatgcatagaatattcctagacaaggacaaacatggtggttcatacctgtaatcctagcactttgggagactgaggcaggtgattcacttgactccaagttcaggatgagcctggccaacatggcaaaaccccatctctagaaaaaatataaaaattagctgggtctggtggtgtatgcctgtggtcccagctacttgggaggctgaggcaagaggattgcttgagcctgggaggcaaaggttgtagtgagccaagatcatgccactgcactccagcttgggtgacagagcaagacaccattcatctctctatctcttttctctctctctctttctctgtctacacacatacacatacccccccacacacatatatatacacacatatatgtgtgtgtgtatatatatgtgtgtatatatatacgtgtgtgtatatatatgcgtgtatatagatacatttctagaaggattctcaaagtgatatcagtgattgttgtgcaagaaggaaactagatatcagtgaatgcgctaaataaggtgattttgaattctgtagcatgtgtatgatttacctatagagaaagcagtctagcatgagcgtgggtttctcaaatatagaatgtttgcagtgaggtcacttggtgaaaagtatagccatgtcagacagatgtaggttcagattccaggacttccaggactgctgaaagggaaaggggctttggatctccttcagctccaggcagcattgctcctttcccagctttgacattagctggagggaagacaagttcttagagctctatgtgcttgggacaagaccccttccccctactgccttactcgccaaccataactgctgcaaacaattcttacctcttccaccccatgtcactgcctaaaacccttcatcacctggcctcccatgcctctaagtctctgtacatcccctagcctgatactgtccccaaccctcctcaactccagacaccattttactctaccctctggaattgtccattattagcaaaatctcctttattttcaacctcctttctaagtatttcccccacattcttgttgtaatagagacacagctttcccaggactgtatagctttccttgcagtcctctaaagtggtaactggtttctctgccatacatttcataccactggtcctggagatattgtcaatatcttaatgtcttccttccatctcacttaaattttgagaccataattcctttttcctctcttaaaagttctcagtgttgaagctcaatccattagatacctctagctggcactactagttgcagtcctgtgcagactactgagtcattttctttactccctgaagacttaaactctatcttactctcactctctctgacattactcctattaaaatgttatgtttctttagctattctttcagtttttggtctcctctccttcaacgaggatgatttctagaatgttggttctcaaaatgtggcccctttgcagacatcgtcagcacctgggaacctgttataaatatgaatctgcagaccacaccccagactactaagcccaaaattctgggggctggagcccagaatctatgttttaagaagcacgtcaggtaattctgatgaatatgccagttccttagatcttgttattgtcattactgacaactttctctgagaccacaatttgaatctaccaatttttcactagtactcacccatcttaagtccttactttccccttaccagccagacatttgaatattccttgactcttctctttcacatactatatccaaagagtcaacaaatgctgtcagctataccttcaaaatacatgtagaatctaacttttaacctccactgcagtcacttcagtccaagcacaaccatttcccacctggagtattgcaactgttcttgtttggtggcccttggccctactttatctactttccgcaaagcagccagagtgtttctttcaacacctaaggttatatggcttcattgattgaaattcaccgtgcttcacctctttctctacaaaagccaaagtccttgtaaatgcctgtaaggctcgagggtgatctgaccttccctggcctgtcgtgtttcggtaaaagtaagctgagtctttcatagttaaaggacagcaatattgtcctgcatgatattttaaaaacccaatcaagaatcacacattgcatttaattttcatgcctttagtctccattaaaagtgtgccctttgtattaataattggagtgatgagggacagagtttaagaatatataaatattttgtccccaactgactgtcactggatggctttggcacccattggtgattcttacctgaatcagtaattattgtgatgactgaaaatagtgatttttctcactgtataattcttctatatttattaattaccttaatattatcctatagaacagaatgttcccttctcatcttttgtttgtttagtgtcagtattactcatgaagttgggtgtttagaaaattcaatgttgtataatactgttattattcaatattgtattttctcagtttgagtcttccatctgcgtcctttcatgtaaatagtataaagatcagtaatagaggaacatagagtaaagtgtgagcagagaagccttactctgagacaaacttcagagaggtgaactctgttgctgattaagaaaggcttcactgaggaagtgttgtttgaagtgagctttgaaaagtcataaaattttgacaaaagtggggatggggtggagcttaaaggaaaaactgtctgaacaaaggaaggcccggcagactaggaatttggcaataatacagtggttttggaccttgatgaggaagttgaaatggaacataaaaaccctctgcatttagctccatttatttgctcaggcagctctcactgcctaaaattttcacccctgctgttttgctcaggggtgggatgaggggtaatgagggaggaaattttagggggtgaaaacagcacaagccaaaaaccctgctcagatactcccttctcttgaagccttttccagatccctaataagaattaaccaccctctctcacacactctgttgtactttgtccttctctgttaaccagcctctgtgttttgtgctgtctgtatttgtggatacatcttcctcctttaaagcacgaatcatatcttaatcccttggcccttcttcccagtacttagcacaagtgctcaatacatgtttctttaacgcgtgtaacagaggaaggcgaggagagtgagtgggattgggagcaggaggattctgaatgtcattttaaggggtttgggctcgctcttcaggcagcaatgagccatagccgcctttgaactgtgcagcactgaccagagctgtgatgccaaaggatgcagtggaaggggaggacagccagcatgcctgggcatggtccccaagtcagaggacatcagtgggagaagggagaaggcatggaagcaagtggctaccatcttatgaatctgagcactcattcaaaggtggcaaggaaaaaggaaggcattgagcacggttttgaggtttccagcctgggtgattggaggctgatgcaggcttcttaccaaaaagggccctaggcagtttcaccaggaatgtttaaggagtttatcatgaccctatctcttcctcgtctaaaactctccctaaaatcaaaacagtatgtcctgttgaaatactttattgtatcaaatataatgagaagtaaaatattctctctacttgatgtatgaaacactgacttcttgtagtggacaattttcacttgtctttttagtaatggtttttattaaaaatagatgttaataactgcttgtttaatctttaaacgtggccctctgagagcagcttaccgtaaaagaaacggttgtcagctttctttttgctcctcagtccctcctgccccttcctaacaacagaaaatttgctttgcacctgctccaactgggttcgaagagataagcatcttgcaagcccagaaaattgtagtatcaaatctcagccccaactgtgaggcagcactatcattgaatccctgctgagaggcgttgctttcccaattcccaaaagagttctttctcccctggccccttttcaggcttgaactctgaccgaaaccctctttttaactcccagcatgcactgcacttggtactgacactgacccatccctgcttcctctgttctgcactggactcatcagtaggtcaggcgttggtagccctggggtcactggggtgcccaattccaataatgagcacatttagctaaggagaggaaatgtacccttctatttgttacagtccattgctttttttccagaaacaaatgctaaaagaacatttgatatattgtggtttggtaaatacacatagcactgcctaatattcacaaagttgcctcttttttttgcatcttccttcataaattaaatatattgttctaactcatgatttattttaagagggatatacctatttcacagctaggaaaatgttttcaaataaagttatattcagaatactcttgcaagaatttcaaataaaaatagcaaatactatttaaatgcatataacattctaacagacttgtgtgtcattttaaagggaaagaaaaaaaatgatgacaaggactttacaactttgtctttaaaatttcttcttaggctttccaaacagaccgaagtcattaaaaatactccttaacccccaaagtcacaaaaaagaagctacccaggtttattatgagaaggttgaacctctgttgaagcttgcaggaataaaaactgatgtaacaagtaagtaattttcagaatataatttcaccatctacaaaaacatacaaaagcaaaataatctgaatttgtccttaatgcaaacttgggaaactacttgtaatatctatagcatttttacgtcttcataacctactgcagccagctcgagggttataatttaattatttttgttatttttattagaatattaatattttctctttagaattttttcagatattttttcagacttaaacaattgttagatataattacaaaggaagctgtatacttgtttacatcttcatggagatgtttgctacttacacgttaattttgcagttaggcaagaaattgattttttgctcacttatatagttgatgtctttccatggaattcttccttgggttgttttcgttctgactctgacccctggtggttaggtcaaaactaagcactgaactgctggttttattaatagatgaatttagagatgctagaagcttaaatttgttgtctaaactaagaaatgtacttaggtttgtgccaaggaaaatagaaacttgttaatgctaaacttaatagatgattagtaatatcctttttgatttttttaatttggtagtcacatttctttgtttctttgagacttattttcgtatggtggggaactgagtagaagagtcgatgctatggagaatcgcaaccttcctagctttatttctatgtggcttcgctaacagtggaaatttgcaataaattttaattgatgaaaagtattataaaataagcctactcaggggacaagcccagagtgcaattggaacttcctagtcccagttatagattcctagggaagggattcacagtgatgtggctttactcagctgtaaacaaaggagataagtttcaagatgttaataatatcattgaaacctacacctagtgatctgatggattgaggtagaagaaagttcaaaaaaaaaaaaaaagcaagttttgtaggaaggtcagcccccatgaaatgtgcctataactatagaggttcgagagaaactaccatgaaaaactcaagaggaatttttgaattaaaataaagttatagtgaagaagttaacctttatgtttgtgaccttcggcttatttagaggtgatttacaagtaaaagagaaaattcagatttatgttttctttctactgaagatttccaaagattggctgaaggaaaagtttgagatttgtattagggtgagacaattaaaagttgaataaacatattggcatactcaatgactattttgttcattgcttttacatgtgaatactacaaagcagcttaacatggatattgctatatagcattcacttcaggaatctcattgtatgcttgctctgtgttcaacatagtgcaggatgcgagatgaataagctatcatacttggatgactttctacattattagagattcaaaaaaatgcttaaaaccattataactggggtatacataaaagaactttgatgtctcagaggtgatattttgatcggaagattcaagaaaagcatttgaactaggcagtttttaagaggcagacaaaaaatgagggaaggaagtcaggctaacaggcatgtactgtaaaagttgggagggggggcggagagagagagtgtgtgtatgtgagagagtccatgtgtgttacacccatacatctggagagtttgtgccataactttgctctactttcctcagtttttacattatctgaaatcttactctatcatcataaaatagctgccagtgaatttcatcctttcttattaatatccagtgggatggggagaggtgtgcatatgtgtgcaagagagacccaacatgctttaatcctgaagatgaattaaaatttccttttttaagtttgggcacagatactgtattagcgcagtcaatctggaataatcatttatttaaccatcaagactcttcccaggggctgaggacagatccccttttcctgatgactgaaatgcctcagctgaatctggattctgttagggagaagaaagggcaaaatgacttctaggaaggctctcaacaatgtatactacaggaggtataattccaggttatggatggatccttaagctgcactcagcagtttactcatcgtgtattgatccacagttggtgtaaatttttttttatcatactgttgcaatctggtttggcaaagatgactccaccagcagaattaaaattaaaaaggaagagagaaaaagagattggagacaagaaaactgatatacaaggcctgaactaaggcagaggaaatcatctaaatgtgctttccttcttaattgtattggagacaaaactattatgttctaggatttttttctctaaatttgtaaatattactaagtaccatatttaaacataaaacaatagaatattccgtaaagcaaatttagaatttacttacatttgtgcagaatggctaattattagctgcctaacactcctcctacaggcaaatttataaaattacatcatttgcttataaaaccattttagtatgcatattggctcaatatttatgaaaaatatttcttgaataaacctgtgaatatttgaaaagttttagtcttcctgcctatcttacagtgttatttttgtagttgaaataatatatttgaaactttgtatattatactacagaaaggtggtcataatactgttagtttcagtttcaaaaattatgtcatagtaagatcgaattcgtactttatttgaaagtatatggaagagtaaagcagaaagaggacatatcttctgcatgtccagtgggacattgttttaatgtatccttgtgtgaatgggtgagtccaaatggaattggaattacaaaataaaccctatatgatgagttaattaggaaatagtgctatataaatatgaagtataatatgaagaattacagctagatatatacactataaggtactgtaattttttcataaatttattttaaaaatggatcttaccacattaataaaaacacacttctttcattttgggttgtgctgaaatcctaactacttctgaatatagatcagcatcttttgaaatatttgtgctaaagttgcatccccactctgctaccaccaccaaggtagtatcttatctaatagcatcagaaaaacttccgggagaacctggaaagaattattttttcctaattacctattcgtacacaaatcaaagaagagtatgaacgataagcccatgctggcatatgatatcatttctcttgcttctgaaacaaagcaagttttagagattgtaccattaaaggtgtgacagatattttgaggatcagagatccataggataattcatagtacaatagagtgaaaaagttaaggcagcagagaaatcagactgaaaagaactttcgaggccatatggttcaatttttctccttgtgggtggagcacaggtgtgtggcactcaactttggcttggccacctacactagaggcagagtacgttgttactggacaatactgtttgacattcttatgaatgttcagagttactgtacctttgggcagattagaaaaggcacctcctctgtgctgacttacaaaaaggtgccctttcttccagactaattcatcctttgcttataaaaccatttcagtatgcatattggctcaatatttatgaaaaaaatatttcatactttcaaaatattcatatttcaaaaatattcagcccaaggtcactagattcagcctaaagtcatttgttagattgcaaatccgtcattcccgttagccaagtacctttgtgctaggcataaactgtacaaaatgagaacttgtcagctgacattcgcctctttgtaatttttatgtactagagttaatgttatctcttgtagtaatatgaaataaatgtgccccatctattgtataggagtcattgagatatttgaagagagatatcctgtctgcccctcatctcttgttcacgataggtacttccatcgccttcagttactttttgcattaacagagctgctagaccttatcatggtcattatcattatcatactcaaagacatttatctgaaggaaaccttgatctctgccagctcagggctcttgggagtgcctagtcaccagataattttacctcctgggcagagttgtcaagaaagtggtgtttgttatcattttccccttctttctcctaaaatcacgcttctaacatggctgttaacaagcctcttcatagtgtttctctggttgtttatggctctacttgaagccttccatttcttggaaatgcctcttgcctttctaaatctcacccagcagaaagctaggccatctaatgaaactgtgtcacaaaagattccagtagcctgaggcatcactccttccaattttacctgcattttaatacaaaatctgaaaagtaaatgttcatgcatcatatctagctagagagaaagataattctgtgtaaaagattctttttgttacctcttaaataattgtgggtgtatatggccagtcctgttcccagcattcagatgtgagttaggaagttggaactttatacctggggacgatgaagactcactaatggggtatatacaaaaaagtgatatgattaaatatgtatctgaaaatggttattctggctagagtgggggagaggtttgagggagacaagataaaaggctattgtagtacaggtggagtatcccttatctgaaaggcttgggaccagaactgttacagatttaggatgtttttagcttttggaatatttgcattatacttaaccacttcagcatctctctaatttgaaaatcatggacacaggaaggggaatatcacactctggggacagttgtggggtggtgggaggggggagggatagcatcgggagatatacctaatgctagatgacgagttagtgggtgcagcgcaccagcatggcacatgtatacatatgtaactaacctgcacaatgtgcacatgtaccctaaaacttaaaagtataataaaaaaaaattaaaaaaaaaaaaaaagaaaatactccaatgagcatttactttgaacgccatgtcattgctccaaaatttttagatgttgaagcgttttggattttagatattctggttacagatacttaacttgtctacacatgaaagatatttagtgatcagatcaatcagctaatttagggaattagctgggagaaatggaggaatgctatggcataatttaaagacagaaacaactggccttggccatggagtggttctggagagtggaggaaagggacactctagaaagaagtcattttcctgtcttggggtagatgatggaacacaaaaagaacaatatatttgagagagaatatatttgaaggtatacataatggattctgttttgagcttactaactttaaagtacctacaggacaggaaagaaaatgacatttcagtatcatatcccacactagaattttatcaccaaaccaagaaatgtttccttatgtccaaatcaaatctcacctgattttatttcaggtgattttctcatcaacattgaatatcaaccttaagactttcttgtcttcctgaggaagttgcatttgcaccaaagaggggagggggaaattcccagcagtgagaattgtgttcaaagacctgtaaactgtgaaggcttcacatctcctatttagaaagagcacaggttggcaatctcataggaaaaggcaaatagatgaaagaagaggctgggttacattttttgaaattacatttatctagcaatcctttctttgtttgtttgtagggggatgatttgaatctggctgtcactgattccagggcccacaatagcctgtctaaatacatatttggtcctttctactatatttaaatagtaatccagatcactctttatccttttgcctaacattgttttgtataaccacctattacttcatattataattcattatttcattagcatatattgtctatctccagaatgcaaattcctgaggccaaagactaattcattttgttcattttgctaatatattttatagatgtagatagtcaggttcttttcattttgtttctttgttctagatctttgattttattggacttttgcaatgttacttaaaaaattgctattttcaggcaggttgcattagtgtataatcaaattccacccacaatatcaaaaaaagactattacaaattaaaaaaataaaaatagcattcaataataacacagttctaaagctcattattggatctgaaaaactttaccaatgtaagctttggtataaaagtaaggcttggtgaactgattcttagcataaatattttttcatgatattcttatttttaatgtgtatatgtaagatgttttattttgcattttaaggttgtaagtacttgctgtagttataaatgaatgatcagcacacatcttctttgataacctttcaactttattaatattaatgtttcatatgtagttttattatggctttcttctgattggaatttaatatagagaggttttattcatgtgagtgttaatggcattttgaataagctatgggagaattacaatgtaacactgctggatacagaatgattcttttagacaccaagactaataatttttaacaatatcgaaaaacattgtaggaaaagcttgaaccatgctggcaccagggacagacaagcatgaaagattaatgtaatcttgcatataatgacacacattcttacacaaaaaatccatctgcaatgtcatgtcagtcagcagaaatctttgatgggtggatacagctgggctgtctcttctggcagagctgccctggaaaatgctaaatgtggttgtgatgcttggtgccatctgcagtgtgcccgtttatcctgtcttcactggcatttacgatactgcatagggcatcagtgactgtggagacagcgatacagagtgacagattcatttcctcggagggtctgagctctggtgggcctgtgtgccaccctccttcttgggtctgggtctcttataattggtgttggctttactttgtattttcacatccaactcttcctctttttagtctaacagttccagtacacattcttctggtttgtaaatcttacactaaccttttgactaatttattcatgtaaggttgccaaaccgatttaagattgactgttcaatgccagctaatatgccttatttccaaaatactgctcctcctaagcctctgatttaaaggacatgtgtcttatttagggaatactaaacaggcaccaggacaaattgggtaaccactatgcgtgggatattcccaaatgactttatgtagttgaaacaaatatatgaccttctcttacataaagctataaaacatcaggccagtaacacttagtcctcttgcccatgattaaaatataaatattcaagaataaatgctgttttatgacttgaccatatgtttatcatattattttgccagaacaagttaaaaagtgtgatcattgtttaaaactgtcactttgtgtatgtgtgtgtgtttttttaatagtaatggaatatgaagggcacgctctgtcactgcttaaggaatgtgaactccagggatttgatgggtaggttatattattaatcaatatatgttatatcatttatgtattaaatgccttcactagttttagctacatatttggaacctaacatttaaaaatatttgtagtgtatgtactttggctctatcttgttcatatctatgtaataataattaatgataatatgacatggtcatctatctctcaggatctggcataggaaagcaaaaagaggaatctaattattaaaatactgggaaatgacagtgtactactctatacttactaatgtgcatacatttgcatctataattatttgcttttaccatatatctagagaagcactaatggaagatgttatactggtcacatggcataactatatgatgatcttcttttgcaaattaattgataggtttaatagctacccattggttaacttgtctgtgatagattgagggaagatattttataaatacaagtaaataaatacattatttccagaaacaataagaaataattttaattatctcataatgtagtgactacaatttaggtatgttattcacagtgggcatcggaaaccattgttcgcaatacattggagtgtacagagattgttcactggcatgcaaacgttagaaccaaggcaagtgatataaatttcattgccattttttaaaattaggtgaaccaatttgctaaagtgttggactgatgtgtaagactaaaacatattatattcctttagggaagttctttttacgtgagtagatatttgagaatttaaaaagttgacaagtgtgtgaattatttgtgttacatggtgatgggcagggggcaaagacccataaggtcaggaaagggagttaggtctgtactttcaccaaagtgaaaggcattaaccttcccaaagactgatttgaatgtgctggggagggaagtgatgcaatcaaaatggagtattggcagggctgtttttcagaaatgcttatttatttatttattttttggatgaggagaaaacaatagctgttgagaaagaaaatgtggtaagtaaaacatgatttttccaaaaggaatctaattgagggaagtaaatctagatagcaatattatataaacattgggaatcaaaaatatggggtaggagattacttcagaactttatacttagaggtagacaaaaacattaataggcttcatttagaaaattgtcttacaagtatacaatttaagaaaagtccttgtgggaatcatgcataccaactacctatttgaatatgctgcatagtccctcactagacctcatgagtacatgaaggtagctgcattgcaaatgagtacctgcttcaaaacttgattaaagaatgagaataaagatatcacagatattaaacttgttcttacacagcagcattacagaatgttctgctgaatgcagtatctatcaatatgttttactggtatttgtactgggtaaagggatgaaaagaactttgcagaatgaagaaagacgattgctgaagtgtagtacaataatatttttctctttacctgaacatatttaatccttatttatttttcatggcaggtgttgttatttttcagtgtagagctaaaagatgtatagatttttcagttattatattttataaaccaaatagtttggcctaaccattatatgaattgagttatgtaagtgtttctaaactctatggcatgctgatttatttcagacttacaataatttcaaatttctactgaaagtcatcttccgtgttctaagactctttaaatcaggggtccccaactccgagactgcagatgaatatcagtcagtggccttttaggaactgggaggcacagtaggaggtgagtggcaggagagggatcatttccgcctgagctccacctcctgtcaggtcagcagcagcattagattctcacaggagtgcgaaccctattgtgaactgggcacgcgagggatataactggtcatgcgagggatctaggttgcgtgctcttgatgagaatctaatgcttgatgatctgaggtggaacagtttcatcctgaaaccatccgtctcccaccccaccctgcagtccatggaaaaattatcttcccacaaaaaagtccttggtaccaaaaaggttggggaccactttaaatagcttatttatttttgtggggtcagttttcccagtagaagctgatatggtagttggagtaattatcttaataaactggcaattttaagtcactgtacttagaattacatagagagatatatgaggagaataatagaaacatagtttcttcaggtacttcaaaggaacaattctcttgcaagtaaaattgtttgaaaatggaatattctacattggtgagttttctattcctgaacctgttctaaagagtggctaaaggaaaattttgggggaaatttatagaaaaggtgcagagatgagagaaggttaaccccaaaatgctatggcattttgatgagagacagactcaaatttctttaagaactttggcctgaagcacctccgtctgacactagtggaactattaatagggagtgattaggaaatcacctaacagtttggtttctagatacaggctgaagaagttaagagccaagaaagattctatgtatagtatttagtaaagcaaaacaatttggtaagtaatgtttaagaaatgctatttcctaagattttggagttgtatttattttttttaatgaattacatatgtttctatgagacatcttgtgacatttctaaacccaacagaaacagtgtatcagcacttatgacagctagttctccactgcagtgtgtcctaggaaacactctaagatccactgttaaaccttatgagagcttcagattctatattgctccctattttactgggcatgagtaggaagttttaggaaggaaaataaaagaatatcagctgcatagacttgaagcagtaacacttgcatttataagtgtgagtatagttttaaaaatctatagattttatgcaattgtaaatatatgaattcctcgctattaatatttgtttcagaatttttaaaaaaattgttgagttacttttcttttgttcatttcaccattaattagacccataatgttgtagacattatttggattatattgacattttatcagattgaacatatctgtattacttagtaaggtaaaaagcaaaaacaaaaacaaacttttccagaaagaaaaaaaactgtgaatcaaaactacaacaatatattgaacatttcatagatgatgggttcatagataagtataaaaacattcattaaaaaaatctttatcactctttgaaaaaggatatattatcacccagtgtttcttttctagacagaataattctgtttggagccatggcaaggagtttacttattttaaaaacaagatttgtcacatgcaaaggattagttactctaaggtttatgttttagagtgacacaagtgtgattaactcactataaatgattgaatactttgctttttgcctttcttgtatatttagactcttgtgatatttttgtaagaagctgttgatgaaaaaaaccaaactgtaaaatatttaaagaggtttattttgagccaaatatgagtgctcatggcctatgataaccccaggggggtcctgagaacatgtgcccacagtagttgggttacaacttggttttatacattttggggatacagaagttatagccaaagacataaatcgataaatgtagggtattcattggtttggcccagagaggcgggatatcatggagctggtgggaaggggagctcacagatgaattcaatgattttctgattgtcagttggttgataagctttgctgaaagattagaagtcagcagaaagaaatgcttgagttaagataaatggggtggtgtaggctgggtgcagtggcttagcagtggctcacacctgtaatcccagctctttagaaggctgaagaggggagatcacctgaggtcaggagtttgagatcagcctggccaacatggcaaaaccccatctctagtaaaaatgcaaaaattagccgggtgtgatggtgtgtgcctgtagtctcagctacttgggaggctgaagcaggagaatcacttgaacccaggagggagaggttgcagtgagctgagatcacaccattgttctccagcctgggcaacagagcgagactctgtctcaaaaataaaataaaataaaataaaaaattataaaaataaagataaatgaagttgtggaagcacaggttcttgttatgtagatgaagcctccagatatcaggcttcagagagaatagatggtcaatatctcttatcagaccttaaaaggtatcaaactcttagttaaatctctcctggatcaggaaaagacctggaaagggaaggagattctctatagaatgcaaatttctcctgcaaatgatagctttgcagggccatttcaaaatatgtcaacaaaatacattttgggataaaatactttgatttcctctagggcctgctatttgttatttaatgctataccagagtcaggttggagttggggatcttattgctaccaagtctgttttgtcagtcttatgatctattttttttttttttttgagataaattctcaccctgtcacccaggctggagtgcagtggtgcaatctcagctcagtgcaacctctgtctcccaggttcaagcaattctcctgccccagcctcctgagtagctgggattacaggcatgcaccaccatgctcagctaattttttgtttctttaatagagatggggtttcaccatgttggccaggatgatcttgaactcctgacctcgtgatccacccttggcctcccaaagtgctggaattgcatgcatgagcctggccaatgatttacatcttaatgccagtgctggccatttgcgcctaaactccaaaagacaagagggtataaggaggcatatccaacctcccttcctgttatgacctgaatagtttttcagattttctttgtgaccttcatggccaaaaggggaggatccattcagttagttggcgacttagaattttatttttgttttacaaaacttatttcctaggttgagtcactttacctgaacatgatcttaatgattgaatagttgttaacataaataaatacatattttttctaactcacttaatttcacactggttctactggtaaactgtttttcaaaataataagattctcataaggctatttttattaggtttcatatatagaaaaggtatctaatatattgaataatattgtagcttctaagaccaaaatgtcttatttcaaatccctgttctattacttactagtggtacaatcttgaaaaagttactttatctttctatgttttagtttcctaatctgcaaattgaaggtaatattacctattgcatacagttatttctccacttaaatgagttaatacatggagagtgcttaggaaaatgtctgatatatatatatagtaattattcactaaatatttctttattgttataattgtcatttgtattagtttcaaaagatttaacacagaatgtattatgacaaaatttcagatgtttcagaacatgctcatagggaggccacctctaataactctagcaatatgttaacatatgcatgacgctataattgtatgcaacattctaggagttaagtgttcgcatcctatgtatgtaagggtcaagttatttggtgctaaattagatttttttgggtatgactccacatagtctttttggtcacacccatatgtcagcatttagacagccatggattgagggttacgtttaagttcacagattagaaatctcatagagatttttgaaatcaggtaagtttcaagtcaaaccttggtttttttcattcataaagatgggactgtggcctattttgcagacttctgaggatttaatagaaattagtaaacacattacctgatatatagtttgtccttagtaaacatcattccttttctctgaataggtggtcatattgcgaacctctggaatcagtttagacataagaataaaacacacctaatcaaacatgacctgggtcatatcttgagtcttctaaccagagtagccttggattgcccaggctatgtggagctagtgggatgaggaagatggggactagagggaatagatggccgagagaaagatggtgggaactgactggaaagacactttcagcctttggtcaccaccctccagagcttcctaaacttagagaaccagtaactactgctgactgtggcccatagacagttttgtttgaaatagtgtttttaaatatattgaatgctagttgcttagtatttacaaattaggagactcagccttaaatcagaatctctggcttctgtagaaaaaccagatctgggtccattaggcctcacacgtgatgtgagtgggccacagcaaagaagtggctgcgcctttagattgagcctactcttccattcctgctgggcccttgtagcccttgagttgtgacacctgctttcactgaggcaaaatccactttccattgggttaactggtgacattttgatacgtaagaatattttgcttcttttgaacataaatgattatgaaatgaatttctggtacttctgtgttattttaatggattctgcccccatagtctacttgatataaagtcttaaaaaatatactagtagtactatctaggatcaaaggctaatagtattacatctagaagcaccgtatagcaataatgtcaaggagatgaaattcaggtcaggtttgtaattactacattcatatagtaatgataattagcagtttcttaaagcttcatattttatatgatttttattgctatctgtcttttcagagctttattgagaattagcaggattttatgactttggttggtgttagttaaatgaattgcagatgacagtattattaacaagaaatgagaatgatatgcttttggatgttaacagagcaaaacgctggtcagatgtgaattaacatgttcaaaagttttcatatctcttaacacacttaaagctattttgtctatggggaattatctagttattatatttgtgaagtaaacttacctgtgttgtgtttgtgttgtcttacccattgacacatattaacatgtttaaaggtacatgtgagcagttatgcacatagactacaaattagtaaactattttgaagtctagatttcatgacttattaccaatcattctgaagttttgccttctttgcttgatttgtatttttctagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggcaagggagtggctacagattcattaaactgacccttctccctcttttcctttcttacttgctaatctagacagcacaacacagaattaatgaacagactttgaaagatccagacttctggcatccccactagcaaatgtgagacttttgacaagtcatttaatctctttgagccttatttttctaatctatagaatagggatcacagatatattattcactttattacaaggttattgtagtactaacgtttggtttagtaaagggtttaatatatagttaaaccatcagtatatggaatggttattattctcccttcgcataaaaaatctgttgattacacagtaccaggtaagaagtttcaaaacagggccactccagtctagctgcttacaattccatatgaggtgaatatggtaacttgcataattgatgtataaccagataaccttgagaatgccaaaattacttgtgactggaagggaggataaggtttggaagggtgagattcttaagggcaaggctttttaatctttctactcactgccatttttcagcatctagaatagactatgccacagtgatgctcagtgaagcctattaagtgaatgcatgtaaagaagactttatatagtaaatgacacttggattaggtcttaaaatgggttggagctggcctgaaaaggtgagaatgagttattttcttggctgcaaaagtaataaagcaaaggcaaaacccaggagtgtttgaggaatagtgaaaaggccattcagtggaagataatggtatcaaaataggcccaaccatggaggctcctacatgccacagtaaggtctctgaattgtatttgataagcagtagggaataatgggatgtttcagagcaagggggcaacctgattggagcttgttccaggaggattcattttgcctcaccgtgtggaatgattagaggttgggagcaggagaaagtagaggtcagagacacggagaaccgttagagcaacactgtgatccagaaaagagggaaacatcattcaaaagctgattgtattacacaatcactcatccctatttaacgaacggtgctgggaaaactggctagccatatgcagaaagctgaaacaggatcccttccttacaccttacacaaaaattaattcaagatggattaaagacttaaacattagacttaaaaccataaaaaccctagaagaaaacctaggcaataccattcaggacataggcatgggcaaggacttcgtgtctaaaacaccaaaagcaatggcaacaaaagccaaaattgacaaatgggatctaattaaactcaagagcttctgcacagcaaaagaaactaccatcagagtgaacaggcaacctacagaaagggagaaaatttttgcaatctactcatctaacaaagggctaatatcctgaatctacaaagaactcaaaagaatttacaagaaaaaaacaaccccatcaacaagtgggcgaaggatatgaacagacacttctcaaaagaagacatttatgcagccaaaagacacatgaaaaaatgctcatcatcactggccatcagagaaatgcaaatcaaaaccacaatgagatatcatctcaccccaggtagaatggtgatcattaaaaagtcaggaaacaacaggtgctggagaggatgtggagaaataggaacacttttacactattggtgggactgtaaactagttcaaccattgtggaagacagtgtggcaattcctcagggatctagaactagaaataccatttgatccagccatcccattactgggtatatacccaaaggaatataaatcatactgctataaaggcacatacacacatatgtttattgtggcactactcacaatagcaaagacttggaaccaacctaaatgtccaacaatgatagactggattaagaaaatgtggcatatatacaccatggaatactatgcagccataaaaaatgatgagttcatatcctttgtagggacatggatgaagctggaaaccatcattctcagcaaaccatcacaaggacaaaaaacgaaacaccgcatgttctcactcataggtgggaaatgaacaatgagaacacttggacacaggaaggggaacatcacacactggggcctgttgtggggtgggggaaggtggggagggataacattaggagaaatacctaatgtaaatgacgagttaatgggtgcagcacaccaacatggcacatgtatacatatgtaacaaacctgcacattgtgcacatgtaccctagaatttaaagtattatatatatatataatatacagccttatgaacatatatatatataaaggaaaattaggcaaaatagcattacttgaggtactcaatagcctggcagagcagacattaagggtaagagagactggacttgaatttcagtttggtacttgactttgggtgggtaattagcctttattagtcttgattacacatttaaaaggtttaataaggccgggtgcagtggcttatacctgtaatcccagcactttgggaggccgaggtagtggatcacctgaggtcaggagttgaagaccagcctggccaacatggtgaaaccctatctctactaaaaatacaaaaatgagctgggcatggtggtgtgcgcctgtgatcccagctactggggaagctggggcagaagaataacttgaacctgggaggcagaggttgcagtgagctgagattgtgccactgtactccagcctgggcgacagagcgaggctgtctcaaaaaaaaaaaaaaaaaaaagtttaataatgtccatccccatagggccattacaagaatcaacttttaaaaagtcacacattatcactaaaaaagcaaaatatttttccctatgattatagaaaataatgcacattgttgaaaaaaattcatattttgataaccctattcatttagtatggattttagaatacttagtattgttgataagttgacagagcataagatattcaaatgcccttttagagtgtaaagtctttcagaaagtcagaatttaaaaggagagagatattcagatataatctgataattctagagtatataggaaaacctaaaatggtttctaagtagaagacaccaagatgattttgactcaaagagaaaaatgatgcattttgggccatcttttcatggcattttatttcttgacctttttgctttactttagtagttctgactataatggtggaaactttccaacatttccttccatgcaaagtggatgtgcttaggacacttcattagtacttaaattcctgaggtcattcattgactgccatacatcagaaatagaaagatgggtgtccctacaggtatgcctttgacataaatttggtggttggctataaaaactggtggttattcttatgttttagtatgtaattcagattttataaagaaatagcatttagttttatcactattataattttgaagagtatttctgatttggggagcattttatgtattctttggatatttgtagtaatgccattttaacctgtcttgtttagaagacacagtatgctgccaaaattctggtcattgcataggagttctagcattctaattccatctaataggaggggaaagtcatgtgtggggtatatttaatatgatgactgtatgcctagtcagggcttttgatagagaatgggaactagaactaggcaggaagttttcaagctgaacatgaggagacagtgtgcctttgaagccatttgcctcctggagagagacacccagagggagagtgtttagtaaattaatccactgagccaacagactaagctgctgaattatggtcagactcaaatggatcagatgtggagaagcctgtatttgaactgctggccattaggaatggtgtttgttgctatgggaactggtgctaaggaactatactgagagactctgattaaaagggggagggggaatggagaaaaaagcctgagaggacataaaaataaaaaagcaatccagttgttgtaaaacaaggctcaagccacatactgatggctgtgaaccatatattcctatagagtttgcataaataaattcatgctttccaattaatttgaggagaataaaatattgccgagggactgttaatttctatgatatttcaggcaaagaaccaaagtgtaggtgccgttttcatgagaattttagatatgcttgactaggaagtcattacatcacatttatctgtttggatgtgggagacattaacagccttatgaatattcatggtatctggttaattaagttaattgttctgcagaagtgcttgcacttccaaggacattttttttttttttttttttttgcctccatagtttctccctggtatttcatcagtaattctttacatgaactgctacttctgtccttacttttttgtatttggaacattttagcagctctcaggaggaagtggtaggcaaagtttctggtagtgttaagaaaaataactttcaggctaattaaaatgtttaccttgaggtagaacatttatagcttttgtgagaacattaaaattacgccattgttatttatgtgagcagcatgttcttttggcatgtagacatcttttcaaatagagtacagtttcctgaaacaaaatgtaatccatctttcagattatcccaacaaaatatagaacaagctatcgttttgcaattttacatatactttctcataaactttccttttttcttcagagtgtcaaaaaccacatttaaagactaagatacagattaatgagtagtcaatgactaaaataattttctgacttctagtcatgtctgttatcactgccaacttctacagaattagagaaaagttgcaaagcctgagaagacataaacaatttttaaagccatctctagcattctaaaaaaattttgtacttgggcatacccaccgtacttcaaactcacagggaataaatggtctttattttcttaagtcatgatatgtgtcattctctattgcacatgacattacattatgttttttaatagcctttctagaggaatgcttttacggtctactcataattaaccatggtaatggaggaaatgtgtttcatggagtactgtaatccatcgataatcctaaatatctgactctaattatgtggcctcctccaaaatctttaccacaaatctgattgggaagcacaatggattgacttgtttcttccttttctcctgatccattccagatttattagcaattagatggtcaaagggcaggctgtagagggccacaagatcattggaaagaccttgataaagatccactgagtaacaggtttctacactacttgttctcaaaacttagggtccatagactcaccttgtgaacttgctaaaacagagatacctgggtcctccctcctccaaacacattctgagtccatgagttggaggtagaacccaggaatgtacgtttttaacaagctcccaggtaatgatgctgcttggaccatgcattccagaggagtttctcaccaagtcactgtgcatacaaaccacctggggatctaataaattgcagactctgaatcagtgtgtctggaatggggcctgagaggcaacattttaaaaataatatattttttacttccattaatactgctattactgttttaatacctattatccttatttttaaatggacaaaaattgtatgtatttattgtgtacaatgtgatgttttgaaacatgtatacattgtgaaatggctaaataaagataaacatgcataaaattgacataatgatcacatactgattttacattgagaacacttaaaatctcccttagaaatttccaagtatataatgcattgttactaactattgttttagcctgttctcatgctgcaataaggaaatacccaagactgggtaatttataaaggaaagaggtttaattgacttgcagttcagcatggctggggaggcctcaggaaacttacaaccatggtggaaggcaaaggagaagcaaggcacattcttcacaaggtggcaggaaggagaaatgctgagtgaagtggggaagagtcccttataaaaccatcagatctcatgagaactcactcactatcacaagaacagcatgggggaaaccacccccgtgattcaattactcctacctggtctctcccttgacatgtggggattatggggattaaaattcaagatgagatttcggtagggacacaaagcctaaccgtatcaactgtagtcactaggttgtataacagatctcttgaatttattccttttacctgaaattttatatcctggaccagtatctccccagtccttcccacccattagccccagtaaccactattttactcttcgcttttatgagtttaagtttttcagattctacataaaagtaagtatttgcctttctgtgcctgtcttatttcacctagcataatgtcctccaggtttatccacgtgttgtaaatgacaggacctctttaatgccaaatagtattccattgtgtatataaacaggctgattgtccctaatctgaagacttaaaatccaaaatgctacaaaattagaaatgtttgagtgccagcatgatgccacaactggaaaattccacacctcatgtgacaggtagcagtcaaagtgcagtcaaacctttgtttcatatagaaaaatattttaaatattatataaaattatcttcaggctatgtgtataagatgtataaaacttttatgtttagacttgggtcccaccccccagatatctcattacaccaacagtgtaaaagtattcccatttctccacagccttaccagcatctattgtttattgactttttaataatcgccattctgactggtgtgagtgtggttttgatttgcatttctctgatgatcagtgatatttagctttttttttatatgtttgttggccacataaatgtcttcttttgagaagtgtctgttcgtatcctttgcccactttttgatggaatttttttttcttataaatatgtttaagttccttgtagattctggatgttagacctttgtcagatgggtacattgcaaaaattttctcccattctgtaggttgcctgttcactctgatgatggtttattttgctgtgcagggattgttttcttgatttctttttcagatagttgtaagtgtacagaaatgctactgatttttgtgtgttgattttgtgtcctgcaacttaactgagtttgtttattagctctgacaattcattcatggagcctttagggtttcctaaataaataagatcatgcctacaaacaaaggcaatttagcttccgtatttatgatttgcaagccttttatttctttctcttgcctaattgctctggctagaacttccagtactattttaatgacagtggtgagaatgggtattattgtcttcttgaggaacaagacattgtttctcaactcatgagagtaattttaataagcactcaagtattgtcattcctgtttgacagtaggccgtattttgagtaacaagggtcacagcataacttgccttttggtgaatcagttggaaccagtttgccatttagttaaaataaacttttctttgcactggtattactagaagtaattgtgcttatttataattaataataattaaatatgcttattcttagttacctaaaaaattatgatattaatgacctcttggttgataatggctaagctgcctcagcttctccaatttagcaacccaagtacatatcagttcaaagtaacacaaattgaagcaattatgtatgatcacataggaatgcttctgattaacaaaatccagaggactggtctttgccttcataaccggaacacaccacatgcatggtttcacagctcttggctattattggacttacttattatattctttaattcaagaaaaattgtagcttcattcattctgttcttaataattttaaattctctttagcctcctgggaatgggaagggctagctggtatagtcccctgtatctcagatttcagttacacataaacattaaaggggcctgacttagggcgctctttgcctctgtggactggtggggaaaatccaggtgtgtcttaaattctaataatcatgaaaatcagaaatcataatgtttcaaatacaaatcttcatacatgggaaatacaattgaattaaacattttcttcaatgtaggagacatttgtcagataacagaggggattctcatttggctaagagcttacctctaagattcattaaatgtgtttagagcatattttttgtagtttgtagttattttatttttctgagttattatttggattattttctcttttatttatgtatgcatttgtcactgctccccagaggcacctcattttggcattgaagctaaaaacccattcattaaggttgggatggagtgggctttgatatagctagcatttgggaggtagaaaatagacattcgtgatcaaaaaagctgtaagcggttactataaactatttttaaatttctaagtattttaaatattgaacaaatgtgtagacatttgatgtgcatctatactgtgaataagaacttaaacttctaatattcacattaactttcctgattttataaattctcgtttatttttcatctgaacattgmagaatgacatctacataaagtaaaagcaaatgttagtttgaacacattctaccctaatagtgcatgttttaaaattgctttggcaggatctaccaatgtattggcacattctcttcatggagttcctcatgtgataactgcaacattgcacattataatgggtaagaattcttccaaagcagttcatattttataaggaaatgttgatttatataaggaaggccatcttatttccatcagactttaagaaaaggcaggttctttgtctcttagagtagagaaatgtttgactaaaaaaccaaaaggcaatgctttactatgtggattgcctgtcttttcaaaatacttgctttgtaaagagcagtaaatgaagttttattgtaatctgtacagaaaaaaaatattgtagtgtgctcaaaattataattttataaccagatgaagaacattaatgaatactccttaagtatatccaacactgatgtaggactgtaccaagactctaggactaggattatgttattaatgaaaaaacataaccagaaaaaaatttcagccagtagatgtctatagatattttattatccctattggtaaaaagcatataagctcaggtatatgtaacactaaactactgttaaatctgtgtttaccttgcctatctactttaacttcgtttctttgaccatgttttataggaaatagcaataagctgaaaaatttagtactctgtgtttcttcactagtacctgaacaagttaaaaatggtaattattgtagttataggtaaagggaactgaagagaaagtgaggatgttcatggtctacagtacctttagatattctcctataagccaataaatatgctctcttatgtttgctgttttgatacaagtcctactgtactcactgattaatatttaatgtaatattcaagggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaagtaagtctttttcttaaaccaaaaattgtatcccaggttcaatgactgttaataacaaatttcattacattttagggcagaagactgtgaaatatcatttttaccatttaacagctctgatgatgtgcaagaaaggtaggtaaaaactcaatgtaatacagataacctgtatctttaaagcataaaacattctgacaaacaattgatcagacttaggatctttggttatttttctaacatagtagtaaagaatatagaatcacagactcttacaggtcctagtaagcaaacaactactcactcagcctttttctctttttccttccttctttcctcccttccttccccctgtctctccctccctccttccgttctctttttcccttcccttcccctttctttcctttcctttgtttttttccctttctttccttttccctttcccttttcttttgagtgcctactatatgccaggcactttgaatacaacaatgcaccaaaaaatgaacaaaacacacagttttgtccctcgtgataattttggtctagtgtgtaatacaaatattaaagccatattaaagaagggttatagtctttaaagaaatagtacattattattccttataatactagtttacctttaaatgaatcaacacattatgttggcagcaacaaaattgtacgtttttacttactatctaattgaagaaagtatttaacatatataatgatgagttctctaattttctcatatttaatagatttgtgtgtgtctgtgtgtctgtgcgcgcgttatctgttttatgtctttgttttgttttctttcttttaggagggcacagggatctcccaaatctggtgagtcgaaaagtatctccttgagaactgtgccaggttctgttgacattttgttctggtgagggaaaataaccaatcactttcattacctttagactgtaatgatcaatggcaaatgatccagggtcagttcttgaatgtcagcattatggcaattccttgcctgtgttcagtggcacctagaggcttggcacctaataccaggttagtaagcatttttattgaattgttgatacatttcttatagaccattttttttccagggtatccaattaactgttggttagctagaaacttaacaggtagtttatctttgtatattagagattctaagggatttgtcatcacagtaggttgagaacaactgttgaactggaataattatcagataatcattgactatttaacgtcactgaggctaaaataatatttcctaagttttattgatagaattttatgcctactttacttgatttattcatttagttgtggagaacattatattaaatactgatatttcttgtgaatgtctttgctttccaactttaatgcaaacataaatatccttagcatgaaaatcacacatatgtatatttgatactgtattagtctgttttcatgctgctgataaagacatacccgagactgggtaatttacaaaagaaagaggtttaatggacttacagttccacgttgctggggaggctccacaatcatggtggaagatgaaagtcacatctcacatggcggcagacaagagagcttgtgcagggaaactcctatttttaaaaccattagatctcatgagacttattcattaccatgagagcagcacaggaaagacccacccccatgattcagttatctcccaccaggtctctcccacaacacatgggaattatgagagctacaagatgagatttgagtgggaacacaaagccaaaccatatcagatacttttagtcaaaagaaacatttcagttctatttaatgtgaatagtagtgcatatcaatctcctgcccacattttcaattgaataaaatatgagacatcttatatatatctttttatccatgggatatagacattccttctcttgcacattcttcttaatcagctgtccattatggggctgaaaatatttctttcctgaatccaatcctgtagagtgtaggagaaaggatcgtgagtgttgtgaaatataggcaataaacggggaaatattcaaagttagagaagaaaaaagagaaactgcaaacttcgatattgaaaacccagatggcaaggtcctcattaattacatctagtgctaaaacttcaaaggagtattttgaaccttgtgtgatttagaaattgagcctggtggttttccccgacaccttcagaaatcctagatagctgtgtgctttcataatgtagtttccctgactaaacttgaagacgtggctagctgaccaaggagctatgtttggcaggacttgagacaatgtttatctaaccctgtttgtttaaggaccttcttgggagggtagacctgctcttctgggaacaatcgattcatagctccttcaaagccactccataaatgttctgcttgactagaattccactgttgactctgcaggcttaatcagtattaatgaatttttcagagaaggatgactaattagagatttcttctgtggtttataatcacaacatgccatctttgcaaagaccttttgatcaagactcatttgaccggagatttttcagagatgtagcttctgatgattcaggatgattgaacaggagatttcactttcttctttttcccccaccatgataaataataatttatgttagaatatctcagtgcaaattgccagtaggaactaatattcttatattctaagtattctaagattaaatgtgttcatatatgtgagacatttaaagcagtgccagccatgtaagttgtgtttctatttcaagtaaatattgcaaagcaggcataggatagtgcttttaatgtttataaattatgcaattaaagatgcacagtaacactaccatgaacgttttggtgctgtttatttttaattgggaagaagaagcatgatggaaagcatactgagcacctggagtattggtgctgatgaccattttttctctgtgtgcctttgaacaaatcacttaaacttggagttgtcttttccctctacatgaaatgagcgaatgatgagataatctctaaggtcccttacagctctgacttgagctttcataagatactaagagctctttttttattttgttgttattcttaaattaacttcatgtttgcactgaaatcaagctagaagtcatttgtatgtatttctgcaaactgcattctatagcttgatgcatttgtgagtggctgttttggcactaaatcacacctctgaattttcactctcttatattggatggaacagttatgcaagattaaaatgttcagtcatttaactgaacatgtgtggcagcatttgttcactccatttcatccatccaaaggccactttgatttatttcatttcctatgtcacttagaccttctgtctataaataaatatttaaatcacactttagattttagaaaatgttgagctatttgttacacaacttgtgcatattaactcttctataatacatcttttaacaacatagtttcacatttagaatttctaattacattgtattttaaattatgtcttgatatgtgagtaggacgcttgatggtttgctttgtaaaatgctctaatgtaagagcttattgagaaggaagccagtgatttaataaaactcatttgaaagcctgcatcatttaaaaaatagcaagatacggtttatgaattttaggtaaacgtaacatggtgatttatctatcttgtccaatactttcagtaaacagtatacttgttataaggaacagtatgtcataatttttggtataatctcttagtaaatttcttgatgtctaatagaaatatttaatttcagattaaataatggaagtatggctcttataattgcccgaaacacttctcggccagaatttataaaacacctgaaaagatatgccagtgtaaaaaatcaggtatagtaaattctttttgttacttatttgcaaagctattaatcatgtagaaaaagatgctgcaagaattgacatcgaatcctgcctcataagaaggttttattttcttctgaatatattaatcttctttttcccaatctatttcatccaaattttgaaaagcatccgccaggattaatatagattggccttttttgaatgatgaattagtggttatgtatctgtaaccacaaagataaaataggaaatgtagtgttatattgcaatgtgaaataaattaaggataaaattccatactcaggctgttcttcagaatgaaaagaagtgaaatttgagagtttagccttcttgatattatggcagcagactttctaaagttatgatctttagatcttcctgacatttgtttgcatatctgcattgattgaaatagatctgtagatatgtatttaaaaatatgacagttttatacaaatattcattcaaaatgagaatatgtgaagatatacatttccacttaagtgatttgctttaaagagaaacagtaactattacaagccatattattttggcagctgttttgacctgattattaggaaaatgatccttgaactatgtgaatttctgaaattgtgagtctttgaagtacataggtatggttgtaaaaccctatagtttcacactttttctttttctttctttttttttttttttttgagttagagccttgctgtgtcacccaggctggagtgcagtggcgtgatgtctgctcactgcaacctccacctcccacgttcaagcgattctcctgcctcagcctcccgagtaggtgggattacaggctcacacctccatgcccagctaatttttatatttttggtagagacagggtttcaccatgttggtcaggctggtctcgaaactcctgacctcgtgatgtgtccacctcggcctcccaaagtgctgggattacaggcgtgagccaccacgtccggcccacacattcttaaaggtataaaatggtgcttggatagagttgggagataacagacgggaggaggaggagagtaaacccagccaatgactggcagctgaaccttgcttatgtaccttagccatagcaagtctctccatttttgcctcattatattttaaaactttcttaggccatcttcatgaagtttgatctgtcagtaacattatttgatcctcatgtattgaacaactaactgggctgcttaggaacttaaatcataaaaaattacagtcccactttctttatatgtcaaagtagatcagcaggtataatgtaggttgtgagcctacataacagttttatgtatgtgtttgggtggaatatggagatttattgattttcaaaggaatatatgccctttcacattttaataaatttctaaacattaaaaccaatttttaaaaaacccaaagcactatatattcattgctgtttttaagtcagaaaatagaaacaagaaaatgattttaaagcactcaaaattccatgttcctcaagattagtgtcattaccttggtagaattttttccgaatccttttttattaaataaatgagaagtaaagtaagtattaacctcattcatgtacctctatttgagaacttaaatagtattaacctattaatgtacccctgagaagttctgtatttattttggggaggtgtatgttgcacaaattgtttatggaaggtctcttttgaaattgcctatggggcaagtctctcaggcaatttttgtaaacattcttcttcttcatttttttaaatcaatatacctttcttctgattttaaaagcaatggttaccttacacataaagacagacatacagaaaataataaaaatctgtatcgataggaagacgttttctaagagataatattatgcaggatttatcatattttctcatgtactctacgaggcatatcttgcttttgacacaagaaacagttgcctgtgtgtgattcactggccttaactctgatttatttatcaactttcaaaaattaaaatccatgctattttttttttttttgcaaagaattctaaaatattttgcatagtgtatatagtaagaaagattgattcccagggtgactgctttcaagcaatgttaatttgatttgttaattatccacacaggtgtgtttatttaggctctttccttcatggtgacattaaaaatgtgaatttatataaattttgtaagattatgaaaatcagatctatgtaaaaatcatgtctactgcataattcatagcagtgctggtattcaggaaggaaaatgtggcaattcagtttaaggagagtaacatctgcttctctgaaccatttttaccaggttgaataagcgaatgttactgtataacactgtaaaatagattgaaaccaccatgtgcggagtggctcctgttccttccccatctctgtgtaaaattagatagaggctgaacactacccttcaaagtccttgcagctccatcctattgctttgccccccttctcactgtccacacttttctctttcattgtgaccatttttggtagggagtttaaaaccttaaatgtgagtgcttcccccaggatttctttgcagccctctcatcttctcaggatgccgtctcctggatggcctcattgcccctcacttttgaactgtctgaacatcatgcactcccaagggttctgtcatctcgtcttatctgcaggacctctgtcttcttgtatgctgaagaggttctgaaattcaccggcatctggaggccaacatgtctacagccgaccttatcttttcccctaaagttgttccttctgcgttgctctgtgcgggtcaatggcaccactttctacccatccaggttaccctgaactgttccttcttcctcattcctcactaccagtcccctaacttgttctgttggtctcctcttaaatgtttctaaaatttctccctcaccttaattcaaactttaatcctttcttgcttacagtagcctccttttggccttcaggttctctggtcttgtcttccatacctctttttagagaaacttttttctaagacacacattggatttctctcctgcttaattcttcagtgcctttctcttgttgtcagaataatatggaatatcctcagtctggaacacgtggcctttgtatccaggtccctgcctgtgttgcaaccccacctcttattaccaccctccaccacattcccagtgttttggcattttattcgttggctaaggttgccataacaaataccacagaaaagatggcttaaacaaacagaaatgtatttctttcatggttctggaggctagagctgcaagacaatgtcagcaggtttggtttgtcctgagtcttctctctctggctggcacatggctgctttctcacagcacccacaagtgagtggtctttcctctgttcatccccgatgccttttcctatgtccaaatttcctcttcttataaggacaccagtcgtattggatgagggcctaaagacatcattttagcttaatcgtctctttaaagatcttatctccaaatatagttatgttctgaggtatacagagcgaggatttcaatacaggaatttgagggccaaggggcatgatgttgagcacctaggagtcacactgaattctgtgtagttgcttgaccatggtttgcctctagttttgtaaatgcttcctctctccagactttcttctccaggctaaatcttatatgttctttaaggctcaattcaaatgggaagctttcccaacatccatagcctgtttgcctcctcttgtttcctctgttgaactccacacttgcaccatcatggcactcccctgtatcaaaattgtaactgtttacttctcctccccgtgccccaaacataccctcacacaggatactaagctcttggctcccgaaagtcccacttaacagcgtctgtggcttcacagttaaagcatttgaaggatggctagatcttcattttgtgaggagtgcacatgacaactgctgatttaagataatagacttactggtggtggctgtcaattcttgacattccttggcttacagctgcatccctccagtctctgactctgccatccttggcattcttctctcataaggacatcagtcatattggattaggtcccgccctaatgacttcatcttaagttgattctacctgcaaagaccctatttctaaacaggggacattcacaggtaccaggggttaggacttgaacatagttggggtggtggagggaaatataatttagatcataacaggcagttgtgtgttttaaatgaattatcaactaacatgaatgattatgtagataattctacaaggatgaggcatgtagccaaggctttatacccgaggtaggaggtctaacgcagttactgtcaaacagttttgcttggggccctctaattctgtacctcagtcacaacagctgatgccatcatatcatctactgtttaactgtgtttacagtataaactggaaagttggctggaccttggtatctacatatgtaaaatatgggtgttggggaaaatattagttttctgtcaacttttaaaactgtttcattgaggtttacatgtggaaaaggggaaaaactatgtagatgatgtttaattaggaatgtatctcatgtcatttttctgaaaactgaaatgagtagttatacatttctgctcaagttatttggctatattttcttaattatgtcagaaaatacatagtgctttttcagtatagtttccttaggcaaacaagaaaaaacgcaagttgaagtttaccttgcaccattctatagtggtaagtaaacagtgatcttgcagcttgtgtccattgttaaagtgggaatggggcaggcaaacaccttttaaaatccatatttgattggctttctcttttaaaagaagacatacatcccattttatcttcagaagtttagacttgcgttcttccaaattaaattccaagtgtgaaacttgtactagtttgctttatgtcagctaaactaattgacaagttgataatggattatatgtcttctgtatctacaggccagtattaaagattatctttaattgaaaaatctacagtatcactattttatgtaacttctcacagatatgtactatttgtcataaaacaagatttctaggtgctagatctaaaagaacccaaaaggctttggataagagattccttcttccaaaaaaacttggagatccctgttcatagtctcaaagctattaaaatgtcagcatacatgctgatatttacttgtgagagagggctcagtgaactttgattcgcgttagtagctagagataaaccaagtataatgattatttgtatttatttttagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattaggtaagtctatttatttcaccgcttattgtcaaccagtaaacataaatctaatattacaacgaaagctctcttctctgaactatcaaagcaggcagttggttagtttttaaaaaatcagtaaatcagggaagcataaagagacatgcacaaatttcaataaataaaaagcaactttacatttattcaactgttatgtagacccaaggcattttctttggttatgcgtgtctacattggctttctaatttattgttgtgcataaactacagataatgtctacaacttccattttggatttttaaaaatggatcaagatcttaaatcttttagtggagccatctgaatagtaaagtgttagatttttatccttccatcttagtttcctctcactcataattactgtaacatgttttgttcagtaatttgcttttattaggcctttacagagcattcaacttcccttgggaacaattttacatagcaactggtataaacaggtttaggaacctgcaaacgcattcttggtaggcattgtgacactcagtggttagaagaagcatgcaggggtgcccactagacatgggtgttctagaggcataactgactgttttacagaggtaatggagagcattggacaatcaaggaagtcagttaaggaggttttagagcaattattgttgttgatgatttatcaatcagaccttctcagttttctagattacagctctgttgggaatgctgtgtttgttatcaatttgtatttggcattggcattgtgtaccatacttattaggtgtatgtgaaaaacaacaaaataagttgatgaaataatgtattttctttacagattgcatccaagacttatcagtctttatggaggaagcatggaagaaatgattccaaagtaacatgtaattgtttctaaaagaaatgtacaaactagaattttaatataaagaaatgtggccatgctttaaacctgtggtccccaccctttttgggaccagtttcatggaagacaatttttccgtggatgggggaatggtttcaggatgaactgttccacctcagatcatcaggcattagattctcttgaggaacatggcactctagatccctcacataccagttcaccatatggttcgcacttctatgagaatctaatgctgctgctgatctgacagggggaggaactcagtaatgctccattgctctaacctcctgctgtgtggccaaacggatatcctaatagaaattgatgttactaacaattagcctctagggctttaaaagtcaagatgaaatatcaattcaaattctgtttttagatatcaattcaaattcttttttttacaatgtgtttattggacacacaaaaaaactttgcaaccatcataatacatcaatatttaacctagataattctgaaataatttggattctttcatttttcaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttcttaaagtggtagggttttaaaattcatgatacaagtaacaaagtaagttgataacaaatactattttgaactgggcaaaatctagcccaatatgtaattgtgttccccttgtatctgagaggcctgtgttggacaaccatagtactctgctttcactgtgctcagataacctgaaatatatagttgtttctgagtagttctgagtaggaaagaaccaaatgtaaatttccttagagaccatcctggagaagacagttctaaatcggggcttgatttttcatctatgatcctagatgttctcctgaaagaatgactagcctttttataacgatacaaagttttttaaaaatacataaatgtcataaagtttattcctgtgtatacacactctgggttcaggaggttttgtgcttacatttcactactcaaatgccttcgcaaatctcagaacattcctcaccatcactgcaggcctgtgaacagataactttcatcaattaggatggctggctagtggcagggacttcatataaagaaatctttcccagaattgtttttccacattgccttctaatttgatcactccctataacagatgttcaaaattcggccacagctctcttatgaaggcagagtcagataaaatgatattctgcaattatctagatcataagcataaaataaatattacaaaaatgattgtatttaaagaaattttttaaaatccagaaagtcatttaaaatagaacctcatatagtatgaacaaactataaaaatattttacatttca

SEQ ID NO: 5 - DNA, 145347 bp, Homo sapiens
  mutation 128459: c/t SNP in reverse strand
attgctatttgggcaacaatatggctccttcagaactggtcgagaatttctgtggtctttgcttgaccttcaagttgggagtttcaaatcagaggctttgaagtctggaggagttcgcagccattaatccttccggggttgtgctaaaggcgtttctagaaagagatcggaaagacccgttcagcacaggcccattgcatcttctctttgaaaacgcttgtctgaatcaagtatcttatacagacccgagactgaggggagcaagagcgcaggtccggctgtggcgaggtgtccaccaccgtacttgtggtcaatgcctggactagagagccgaggccgtccagggcgggctggccagggaaccagaagcgtccctggactggctgagtgagggtgccctttccagcaacccagtggccatggttaaaaggcagaatacaaccgtcaaagaagtccccagctcccacataagagagcgcaaaggccaatggaaccaaggcctcctcgcgagaactagctcgctttgaggacaagatcctggggatggaggtggggactgacgtagtgagagggtctggaggaacagtcgtagctgaaggtcaggacatgaagaattgcacgtatggtagggatagaatggcaggtacaacttttctgtactgaaggaactgggagaggacgatccggttagggaggttggggaactaatctcaacgctgcgtttacagatgaagccgcttttatatggcgtatatgtttgcttagaggggccgacggagattaggagaagccatcctttggcgccaatgatcaaagcgtctgccaaggagaagaagccaagggatgggcctttcagagagggcaaggagtcatgctgctctggatgccagtgtcaggacaagaaatcgaaaggagcgaggactcttcactgcgtgcctcagtctccccgcttctgcctctttcacctctgtcctacttccggcgcgaaagcaggccactcgctctgatctagacctagttaacattagcttttcccttccttccctcaaatcccctcccccctctatccccgtcccttctgccgcctgaaagggttaatctctcctgcgggtaaaaacaggtccgcggagtctctaactggcgacagatgggccactttcttctggccacaaaggggccggaatggagcgctccgcggcatacaaatgggcaggtcacgtggttccaggctcttggctggaccgggaagaccatatggcgcatgccggggaggaaggaggaggggcgggggtaggggtggagggtgaggggagcggttgtcggaggagggcgggagacgagcaaggcgtggggagaagtggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaaggtaattacagttctttcatttttttgccccagaatagaagcaataactgaagactgatgaacctacatattctgtatgtgtgcgtttgcgagagtgtgtatgtgtattgagaccagcatccccctccataattgcccataagtactcacacataatgagtcgtgtcactcaagtaccccctgcaggctttctaatttaaattttaaaaatttgggtttcttttgtggatagcataggagcttcttggattttttaaaagaatgcacggtaactatgattatctgctagtgctgattttaaagtcccaaaagcaataatgacttcactttctcacttcttacagtaagaaaaaaaaatctatgttatcaatatatattttgtgtgcatgtattttacgcacattgggagtgtcaagctgtgttttcagtgaatgaaagggacatggataccttgagtattcacaccatggaaaataaatcaggttcagagatagtttagttgagaggggggaaagtggagaaagggagagggactcactcctgctacctgttaccgctccagaggcggccaagtccccagcagccactactggagccagaaattcagttgttttactaaaggctttttattttccttactagaagcggcaacttcgcggttgccaatcgctgaccattataattactcaatcttttaaagggaggtttgaggcgaactttgaaaagccccaataaagagcgggcggccctttcaatgggctgtttattagagaggagccttccgcacctgatccccggcgcgtgggagagcgctctgcgccgcgcccccagccctcgccctgcagctagcgcttttgtacaaggtggaaatttagcggtgggccagagatggaaggcaagaaaagaaaggcgagggaggggtggaagaccctgtccacttttgttgccaaatgttacattgatggtgaaacaatttggtggaaactatttttcctcctttctgcatttgcttttcagtatcccgtcgatgtaatcttcttaaaaatcgctgccagtattagtaaattacgcaatggctgttcaacttaaatcgctaagtatctggaagccaggacagaaatggaagtagaatgtgtgattttacagcttttttttttttttatggagttgtgagtaactttgaacacatttggataaacatgaagtcgctgaaatgtacagtcatttccacacacattatcctgtcgggcaaccaccataaacacatttaagttaatcactaggatacaaacacatatgcgtgagtggtgtacacatatacatattcactaccctcccccagtcctgtcctcactcctacgtactagcggggcacacgcacgcgccattataaaacactgcatttaactttttctcagaggcattcattttgtaatgggcaggtacttttcgcaagcatttgtacaggtttagggagtggaagctgaaggcgtatctggcttttgaatatagcgtttttctgcttttctttctgtttgcctctcccttgttgaatgtaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaaaccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtgagagcaattgttgcatttcttcttaaagggattctgtttttatttttggggaaagtagttgcttttttgctgagttaaaaaatactaaacactatatgtagaataaaagaaaagaaaaaagtttaccttggcatatgctcttgtctgtttatcttgcacagggagtcaccagttctatgtagataatgaaaagacctaactgatatttcattatttggaatatgggactggacggcagtacaaacagtgtgtttttttctttgttttaagtggcttagcctttaggttttttatttccatttttaaaaatgattgttacatgttttcttctatttctttttttaaaaggtggattttaataattattaacaagcaagacataaacaagtatcctagcttagtttgtctatacatttaagatgtataaaacattactattttcttggtcttctgttatctgtacatttttctgaactaaacagttttatcttgcaaactagtactgtcccagaaaaatttatacacctttaggaagtaccaaagggaaatgagttaattaatttaaagaatccaagagaagtaacattttataattgttctattaacatcttgtgatgatttccatcatttttccaagaaaaagcataatggattatttgtactgaagaacacactatttgtactgtatttaggaaggtgtaattatttcctccccccaccctttggggcactattctgttgtttcatgaacacaactcactggaaaaacttatggatgattctgtctattgttaagtccacttcaaaaaaaaaaaaacagtttggcatttcttttcctctggatgtattgactgacagtcatgattcctagggaatatcattttggcacttgtgccctggctctactgtggtgctctgattactgtcattagtaactccattgtttctactctgattcgggtgccacattggatgactaccccccttcccaagcttgttcctttaatctccttctcattggtgatttaggggttccagaaagctgacctcatttagcaagctgctccagaaaaatgtgagtaatgtaatggacaggaacaattagccatactaataacattgccaatgaggctgcgtcaagctgtgacagaagcagtaaggaatacttcgacgttaaaaaaatgtttgagagcaatttaaaatatattattttaacatgttttctatcagccttcatcacatgacagaaatacttttaagttagtcccaactttatctaaaatgcagcaatctcattccaagtgaatcagagttgttattttggaatcaagctgttgctttctatatcctggattgttctcactgttcttactttaagagacataatactgatatgatacttgaatactaccagccttccagtgtaggaggtaatgaagtgagcattcagatctgatctaacctattaagtagctcaatttcacctgcaattaaaattagacatcttcatgcaaactaaaatctgttgctgtagtgaagagaagaaataaaagaatgccattttgagaattccagcttccaaaatagcaaacagggaaatctagactgtgttcttttgtaaggtagaaatgaagactaaaagttaggttttttttttttttcttcccattttgccaatacaacttcattctaaaacatagggattctttcagtcagtcaaggagtaactcacatgccaccatcttttattcaaaggcaggcacagatgttccttctgcaggggaggatttaatttatgaaaatgatattgtttatgcatgaatgaactgcatgcactctgcataacacatagcacttccatctgatcagagaaataccacagaaccagtgccaatgtcagaaacatattctacaaatttactcacttaaatgtttaatgaatatttggaaggcattttcaaaccataagaaacattttaaattatcttcttttatgaattcctacccatatttaaaagagactcttacagtttttgtaattggctaatgcttatacccagtttgtaagaaaagaacatattttactaaatgaaaaccaaccaaaaaaaaatgctggcaagtttggcttcactggaaaaaatatttcgtttagttttgctgtttaatgcttgtcatgaataatatttgggattctatctgtttcttcatcttgagccacgactattcctatcaaataagatgcttaggtatacttgtttaatgtgaaaatcctatgaatagttatttctagaaaaagctggtatgtaaaatcagggggaaatttcataaagatgaaattgggctaaatattgtaacatgcataattactattgaataggaacacttcacataacatattttactttatataaccaattgcagctatatagtatgatctatctacttttaatcattaaaacaattatatataaattaaaatgaaagattataatatcaagagtgttctactaattttaggtttataatatgttacagtaaaataccatttgaaataaattttgtgttctaatttatcttaaaatctctctgtttttacatttgaaagtccttacattcttacaaaattaatgcattttctgaaagaagctagcaattactaaaatgatatatggatcattagctaacagtttgaatcaagctgttttagttctataattatacaagaaatttaaagtgaaaatacctattaagcaattaataaaactaggtttcaaaatattggctaattttctcctaatgggaaatgtaaaatagcaaaactgcttcttaaactacacaaaaacctcctcacttctccttttctctctctctaacaccacttatttcctgaaaatcatctaaataaaatatttaattccagggtctgatgaagaataaaagagccaatgcaacatcttgtggaacaccaggactgagaactcttgttgttaccattgcaaagaggcgttctggcgtcagatgcacagtgatttgtatggtggcataatcattggctcctggccaggcattatgtttcagaggacactattgtcaagaaccattcaactagaaatctgcactgtatgcactcaaaagttgagatcatctgccttcctatgacaggaagaattctgtgctggcaattgactcatggactctcttcacatacactaaggcttggtccagtggctctgatggaattaactgtgcagccaaactagtggcattgacaagacagggccacagtctctggggacttcaggagaaattgctaattttaaaatgcagagtattatgttaatgctggattaaatcttcagatacattaaatgtggatttggccatctaagcattattatgttatttgcccagttaatttagaggtagatggatggtgacaataaccatctctacagatccacaattctaagagatggatccaattgtgaaatgatatggagagatagagtaagttcaatctagcatatatgaagtaatttggtaactgacttttcttttaacaagatcaaaagctaacctgctttacactttcatgtctaaggacagccaaccagagagatggcttcacacactagcccactgctaagtgcttttcattcactttcatatttcatcatcaaagcaccctcctgccttatttatagatggggaaacttcaggaagttgagatacctagatatttgcattcctgtcttcctttcttcattcaggtttttctttcattgccacttcctcaaagaagcttttactgattcccatttaaaatagcaactgacttcaactccaccaaaatcactgtattgcccctccctctttccagagcatttgcctatcaaatgttatcttatgtatttacttgtatagcttaattttaaactatctatctctaggtcttctgagcacctgagaaacagagacaaagttgtctcttctgtgtgttgctgttcctctggtgcttagaagacctagaggatcctcaataaatattaactttccaagggaactgaagagcactaatgtgatgctaaagcctgttgccttaaccactatgctataagtcaaatcagttgagaatggagaggaccacaaattattttcagtccagcaagtgttataaacattaattctataaaaagaaaacaattgaaactaatttcttattatattgcatggcaccaaactccccccacttcctttttgaggatcatgagttgtctgtcattgtttctttttattgatatcaattggttaaatataatctggaattggaataaaagaaaaactattataggctttttccagaccatgtatttcaatgcatattattttttcctttctgttcattattctttcagtaattgcacttgttctatttttagtgttatgtaaaattactgtagctcataatttctattttgaagggttcagtgtataaacttagcacatcaatactatctttttagtgttcgcgctcaatggtgtcagttaagagatcaccatcacttttggtgacgtcaatgaaggggtattgcaatgcttaagagaactgttaatccctttccactggtgtcactaacaattgtagtgcttgtttattcatagcaggtacgtgactaagtaatgttaacatcaaagcagaaagaggataatagagtgttctaaaaagaaaattcggtggttgggtgcagtggctcacacctgtaatcccagcacttttgagaggccaatgggggtggatagtttgagcctaggagttcaagaccagtctgggcaatatggtgaaacctcgtgtctacaaaaaatacaaaaactagtggtgcatgatggcatgcatctatagtcccagctactcgggaggctcaggtgggaggatcacctgagcctggggaggtcaaggctgcagtgagacgtgattgtaccactgtactccagcctgggtgacaaagtgagaccctgtctcaaaaaaaaaatgatttgagataacatcacttgtcattgtttgttaactgaataatctttattctagccagtgcctaaatacataataaatgatagtacaaatggatataaattataactaaacctaagtagtgatatttatcacaatatttctttactagaagaatttctttgttaatagaggcaaggctacttgtttagataccttaaaataacataagatttttggataaataaattaatgattctttgattctgactggcatattaaaaatattaagcgaagagatctttgcttcccaggttttattttttgtctaattaactactggtgcatttatattaaaacatattgtcaagggaaaacgtatatatatatatgtgtatatatggtgtgtgtgtgtgtgtgtgtgtgtgtgtgtgcacacatatgctatacttggttgagtagtatccccttcccttgcccacctctctcccaaatttatgtccatccagaacctcaaaatgtggcctcatttgaaatattgtctttccagatttaattaagatataagatgtaaattgatacaagttcatgctggattacggtgggccctaaatccaatcactgatgtcctgataagaagcagacagaacacacagacacacagcatacaggaagaatggcatgtgaaggcaaagacagagactggagtgatgtgtctacaaatcaaggggccccaaggatttggggcccacatcagaagctgggaaagagacaggaattctcagcttctccttctgaatccctaagaaggaatcaaccctgctgacaccttgattttaaacttcttgtctccagaactgtaatataatacatttctgttgtcttaagctacccagttgctggtgatttgttatggcagccctaggaaactgataggtatactaaaatctctaatgaattgatgttaaatatatataagtataggagagttcatttaaattcttctgaaaatgtcttcttaaacttttaatgatacagtatataacaaccagtatacgtagttggtatcgggtttgacatttaaacaagctgacaaaaaacagctgtttaataaacatctgaattatataaaagttttattgtttattattcatgtgaatgacttaaactgacatctacatttagtgaagtgtgaatgggcctagccaataaactatgggtaatttttttaaagtctcatctttgaactcacaaaaaattatcaaatatcagctattatgtattcttcatgtgaagaaaatgtcatatttatttgatttgtggattagcatatatattaatagagcttttgaaagaacaaatgtagcactttcccgatttcatagacactcatttaacacacaagttcatattttaaagtacataattttaaaaaaattctagtccaaatgaatttaagtgccatgacttctaaaaattctgtctctatttttgggttttataggaccttgagccagtactcttctggtgagcttaagaggctaagacttcacctttagttatatggggctttcatctgattatttgtctattttgattgctctaaatacaagttagtgtgtatttcatctgaatgtatttcattataagttttggttttatgtagatctggggatctgtcttgtttttaatcttgattggtctgtttgttttgggatagttggtactttcatttcttatgcttgctttctttttcattttgtgcccacctttagtcaggtgaacatcagtaaggaataaaattttatttttttaagccactgaaaaaatttaaaaaccacatcataactctgcctctgctgactgataaaaatgctaacttattaagacaaaatgttatgcaagaagactttattggaatagagaaacatcctttttatgtaagaaatatcaacagagacatgtgcctttcttgtgacaaatgtggtatgtgtgtggattagaggtctggaatgtggcagcatttcagtacttggaggggagaattagagtagggtagaaagatagacggggagcagaggatgattctcacccagtagaaagcagagtgaagaaagaaaggggaattgttttttgcattatattatttgaactgtggattaagtctttccataagccatccctacgcctctaagtaggttttattaacttaagctggtttgagatgggtttttggtcacacacaagaattgcctgatacaagagaggctttgattttgttgttgcttgctcatttttatacactaagatggagaaaaccctggacatagtgaagacgaaattgaggaaggtgttgggtagagtggagggtagaagacctgtaacataggtacagaattacattaaactggaaggacttatatccagatataggagtcagggtagaaagagagaatgttagcagtaagggtaacagagtagcagaagtttattcttaccaggtcctgttatgtgacagtggaggcatgttgaccttctgactaggggagttaaaggagaacactgaaggtttagaataatgtctctaaggatagaaagagaaagtttcatcaagactcatcaataatagggcagcagggcttagggccaagcaaattcagagaccatgatattatagtagtttgtagtggtcttaatccatctaatttttcagcattttctcaatggccaatacttagcagtggtagtgttttatggcatttggacaacagaagtgaaagcactggtaagagagacgttgaagtgaaacaccatggggctcagaaaagcagagttgatccatctggtacatgggcaaggatggtcctgaacaattctgcagtaagttggaagatagaaaaaatacctaacgaacttgtagatctgggtaaggagatttttggcagaatattgtaaggctaattggcttctcttaactatatgagatagggttttacaagggagagataagcgagcataatttagaagaactatagggggtcccaggcagactctctggctggaaaattattctgatagcaagaaattagccccaaagcaaagatgaaaagtagggtacttccaattaaacatgtcataagggcaagcctcaatcaagagtgtggctagaaggcacagctcacctggacaaaagtgcttctaagcatattaggagcatataccacaataacctgacttggacccaaagttgagagaggccagtctcaaaaaaatttgagggaattgcttttgcataatatgatactttatatacatatctgttacatatcatatatatcatattaaaaagaaaaaaaaccctgtttttccttccgttctttcatataacccttctgacaacaaatgtggagtttttcacacactaagcaattctttagttcttgctggacacttcctggatgtcctacaattcaactcgattctcacacaactgcccagagtcagtgcagacccgcagattaaaggcttagccccaaaagactaccccccactttagatgtcaatcacaagtctcaacttcatttacttctgaaggacgagctatacattggaggaaacccctctttctttcaataatttgctagaatggctcacaaaactctgggaaacatttacttatggttaccaatttattataaaggatataactcagaaacagccaaatggaatagattcatagggtgaaaaatgggggagaggcatggagcacaactctctcagcacctccatgtgttcaccaacccagaagctctcagaactccttcatttagggcttttatggagctttatcaagtaggaatgattcatgaaatactggcattggtgattaacttaacctccagcccctttcccctccctcaacattgggggtgaagctaaaagttccaactctgtaatcacagggtgagcttccctggcaactagtcccctgatccttagggggcttctgaaagtcacctcattatcataaactcaggtgtggttgaaagggatgttttgaataacaaaagatgcgcctttttcctttatctttctgagttgtttcaggagctagggacaaaagactaatactataacaacaacaacaaaaaattcaatttttgcttttatctcttgggaattacaaggattttaggagctctgtccagaagccagtgatgaagatcaaaatacatatttcttattatatcacaattcacacatgtacatgatatccgtaagataagtgaactacataaagtaagctcacaaagtttctgtaggagttttgtccatttacaaacagtttgtaagctaaaagtatctgtgacaagcctcagtcaatttagaagttcatttttccaatgttaaggacatgcctgtgacacagcctcagaaggtcctgatgacatgtgcccaaggtgatcaggctacagcttggctttatacatttagggagacataagacatcaatcgatacatgtaagatgaatattagctcagtccagagaagcaggactactgaaagtggaggcttgcaggtcacaggcagattcaaaggttttctgattgggaattggttgagttattatcttaagacctggaattaataaaagggaatttatcatgcagatgaagctttaggtagcaggcttcagagacattagattgtaaaggtttcttatcagacttaaaagagtctgttctaacagtctttaggtctcagtgttgatgttaatgctggtcagctgtgcctgaattccaaaagggaggagagtataatgaggcatgtctgagtcccttttcccatcatggcatgaactagtttttcaggttaactttggaatgtccttggctgagaggaggggtccattgagatggttgggtggcttggaattttatgtttggtttacaagtttaacattaaaagcctctgtacctccaatgttttatggacaaaaagaaggctgaaaaagctacttggctgtaatcatgggccatttcttgctgaaaagaagaataaaatggaggcagaaccaaaagcccagaggctagagccaagagctgctgagaatgatgaattagggaaccactctcagagagcagatctggatgtgagataggaacattttctttctcagggtctatgaaactggcaacatatgctctcctgaatttcagaattgctatggaccagtgactgtgatatgctttctatatttttcccttttgaatgggtgcatctatcttgattatcctctgtctcattattgtatgttggatttgtgtgggacgataacatgtgtttttagttcctaggttcccagaataagaggagcacactcaaagagcgacatttatgagatactggatttttcacttgatatcataattgggtgagacttgaaagaaagtgaacatattttgcaaatgggagggatgttaaccactgacaaccacacccacagggtccactgtattagcctatctgcaaagacggctgccaaaaattccttctgtccatatatacattcccttttttaatgtgactgtttcacctgccagcaactgaagggctttatttccatttccccttgtgacttgtttgactaacagcaagaagcaaaagtaatgctattccaattctagacctgggccttaagaggcatgacagcttctgcttttactctcttgaaactcaatgtcattttttaaaagctcaggctagactactcatcatgagggaccacatgaaaagagataggcccagctagtttccacccattccagccgctccagatgagatgccagacatgcaaatgaagccatcttggatatttcagccccagctgagcttccagctaaatgtaagtacattcagttgatacctcatagagcggaactactgagctgacttcatccaactcacagaatcataatgaataacaaatcattgttgctttaagtcaatacatttaaagtttttttgttatccagttgtagatgaattatacagcctggggggaaaaaggagatagcacactgttagttgcctcatcaatattcatccccaaattctttttcctttttagtaggtctcacctcccacctggaagctgaaaacacctttcccagtctctctggaagctacagcacaggcatgttgcccaattctaaacaataggacatgataggaggtctgctgggtgggatttttgaaaatatttttttttctggttaagaaaaaagaaatgcccaaggaaaacctacaaatgccccttccattcttgcttttggacattttttgggagagggtatgatgcttagcactcctgcagccatctcggggccaacaatagaatccttgttgctacctggtgatagtgaagtagaaagctacaaagctcttgatttcttttcttttttttttttttttaaattttattattatactttaagttttagggtacatgtgcacattgtgcaggttagttacatatgtatacatgtgctatgctggtgcgctgcacccactaactcgtcgtctagcattaggtatatctcctaatgctatccctcccccctccccccaccccacaacagtccccagagtgtgatgttccccttcctgtgtccatgtgatctcattgttcaattcccacctatgagtgagaatatgcagtgtttggttttttgttcttgtgatagtttactgagaatgatgatttccaatttcatccatgtccctacaagggacatgaactcatcattttttatggctgcatagtattccatgctgtatatgtgccacattttcttaatccagtctatcattgttggacatttgggttggttccaagtctttgctattgtgaatagtgccgcaataaacatacgtgtgcatgcgtctttatagcagcatgatttatagtcctttgggtatatacccagtgatgggatggctgggtcaaatggtatttctacttctagatccctgaggaatcgccacactgacttccacaatggttgaactagttcacagtccaacagtgtaaaagtgttcctatttctccacatcctctccagcacctgttgtttcctcactttttaatgattgccattctaactggtgtgagatggtatctcattgtggttttgatttgcatttctctgatggtcagtggtgatgagcattttttcatgtgttttttgactgcataaatgtcttcttttgagaagtgtctgttcatgtcctttgcccactttttgatggggttgttttttttttcttgtaaatttgtttgagttcattgtagattctggatattagccctttgtcagatgagtaggttgcaaaaattttctcccatgctcgtgggtaggaagaatcaatatcgtgaaaatggccatactgcccaaggtaatttacagattcaatgccatccccatcaagctaccaatgactttcttcacagaattggaaaaaactactttaaaattcatatggaaccaaaaaagagcccgcatcgccaagtcaatcctaagccaaaagaacaaagcttggaggcatcacactacctgacttcaaactatactacaaggcttcagtaaccaaaacagcatggtactggtaccaaaacagagatatagatcaatggaacacagcagagccctcagaaataacgccgcatatctacaactatctgatctttgacaaacctgagaaaaacaagcaatggggaaaggattccctatttaataaatggtgctgggaaaactggttagccatatgtagaaagctgaaactggatcccttccttacaccttatacaaaaatcaattcaagatggattaaagacttaaacgttagacctaaaaccataaaaaccctagaagaaaacctaggcaataccattcaggacataggcatgggcaaggacttcatgtctaaaacacgaaaagcaatggcaacaaaagacaaaattgacaaatgggatctaattaaactaaagagcttctgtacggcaaaagaaactaccatcagagtgaacaggcaacctacaaaagctcttgatttctaatgacatcatatgggatgaaccaacccaggaacagcctgactctggacctcttttaatgtcagaaataaaatcttatttgtaaaccactcttagttgttcaggttgttgacacaggcactgaagtgcctccaaatggtgatgaataatgaggcaaaagtcaaagacagcaagtctagtgtcaaattttttgatgcctatgggtaagaagttcaagaaagtgagctattttctttctttttaaaatttatttttatttttgtgggtatatagatgtatacattagtcagctattttcaatagtgagaagggatgttgccacttagtataatgcctttttcatagctatcatagaaaccatatatacatatagtatagaaaatgaggatagatttctgacttaaactgcctatttcatttgtgtgcctggttacacctaattcaagactctacaatacagcattgctagcaattactgtgagaatatttcaagctccctatttgctggaaatacatttcatttttttgttccaagtttatgaatattagaacctatctaaaaaggagcttttaaaaacttgaggaaaggaaaagggagggcctacttttcttgcctgtgttatttcttgttactgctgattgagatgctagagatcatattgggtgagatgtgtcttagaatacagctgagcaattcacttttaacagtttccatctgagtacaaaaaactggtatgtgcagaaaacttgatattctgacttggcgggattctaggatttgttctatttttttctgtaattgttgtagggacatatggccctgtaccttttgggcagcaggagccagaatagcaggaacattctgacaaaattcccactcagcatgagagggaagcagtccccttgatacactgatgatgtgcccacttagcattacaagtgtttgagaggtggacacaactaaaactcacctcactcaaaatatatattgacacggagaaagtaaatacaatttgctgttattaacctttcttctcaccattgagacatgttaaatatctgaaattaataaaggaattaaatttaaaaagtttacttatcatgcatttaacacatttattgagcatctgttatataaatgcactgtttcaggcacaagagatagagccataaataagcagattaaatcactattctcaactgaggtactaatctgatataagagaggagacagaaataagtaaacattataaatcaactacatacttttacatggtgtaaagtgcaattaagaaaatattattgaatagaggtcaattttggaatggttgggcagggaagaccttctgaggtgacaagaagttggcctgggcaccatggggagctctaccatggtgaaaagtgttccagacagagtagacagcaacagcagaggccctaaatgagaatgcacttggcttatctggagagtagaatgaaggccagtgtggtaggacacatactaataataggagaaaactgatagaaaagagggtttgagcaggtgggcaggaattggacaacatggtgtctcatatgtcataatagaagtttggattttattctacctgcagtgagaagttcttaataaaaaaaaaattctataaactggagtttgagaaagaactatgttgatgatagcataagccctcaatcacttgtcacataaactccaaacttcagcagagactcagggagatcaaagggactaccacaggattacccactggctaaaattcagatccatggcagttggtcctgactggaattagacttccttgtctgttgccctcattgcagtgggtctgaatgtctctgtcggctgtgaatttttctccctctatctgtggcactgagaaggtggcccagacttccagagtctgtctcattggcctattacttggggatttgctgcccttcttctggaagtttgggtatttgttttcagagcatacttaaaggcctcctgaaagcaatgttaacaatagcaggatatattttacagtcttctactcagacttggatttttaagaaccagggatggagactgtgtttccagatctagtcaaatcccttccaaacataaagcaacaaagtgccttttaaactaggacctgtactgtttaatgctctggaaacaaatacccaagcttcagccaaaggagggaaagctatgttcaggaagcttcctgaaagttttttgaaagcaattttcatgcattagtattttacatatatatatatatatatatacacacacacacacacacacatatatataaacatatatatatatacacatgaatcactaatgagacaattgatcttcaggaactaacgtgaaataattggggtatcttggtattattgttatagataaatgttgaagaagttcattctttcagatattaattgagcacttactgtgtactaagaactgtgatagatactggggatttaatggtgaacaagataaattctctgccatcagggggcttatattctaacaaacttaaaatttactgagtgttctctgtatttcagtattgttactaagtacactaacttagtggggaagctagacaataaacaaagaagtatgtaataagaattaatagtaagtgctgtaaagaatactaaagcaggttatggtagagagattaatggcagcgtgaagatgtccatgtttcaatccccagaacctgtgaatatgttaccttacatagcaaaagaggctttgaaaacataattaagggttatctgggcaggcccaatgtaatcataagagtccttatctaagacgggggacaaaggtcaaagacagaggaaaagagacgatttaaggatagaagcaaagaggagagatgttagactgctggctttgaagttggaaaaagtgaacatgagccaaaacaaacaaaacagaacaaaacaaaatccacaggtgacctttagaaaaggggtccccagtctctgggccatggaccagtacctgtctgtggcctgtttggaaccaggctgcccagcaggcggtgagtggtgactggtggacaagcaagttttaccacctgagccctgtctcctgtcaggtcagtggcagcatcagattctcatagcagcctgaatcctactgtgaactgcacatgcaagggatctagtttgtgctccttatgagaatctaatgcctccaaaatgctcaccccttcaaactgcccccatccgtggaaaaactgtcttccacaaaaccagtccctggtgccaaaaaggttggggactgctgctctagaagccagaaaagaggagatatattttcctctagagcctacagaaggaatatataggcctgctggcaccttgattttagtcctgtgaaactgattttggatttctgacctccagaaatgtaaaacaatgcattggttttgtttcaagtcactaaatttgtggtaattagatacagcagcagtaagaaatgaatacacaggtttacaggatggtgaattatggagggtgctcaggaatggcctctttgaggtggtggcctttaaacagaaaaatgagcaaagtgaaagaatgaaccatctggtggggagaaaagcattccagtcagagggaacagcaaaagcgaatgctctgagaagggattattcttctcaatgtgtttgaggactggcaagaaggctttgtgtgaatgagcaaggggaaaaagttagtaggtgatctcggagacatagccagggtccagattataaaggacctctcgccttgctaagcattttgactttattccaagaataatgggaagtcaatggaaggctgtgagcagggttatatgctctcgttattttttaaaggcacaatgtaactccaaaatggaaaattggctctgggctggaggtgccagcacaggggaaaccgaaagcagagagctgggttgggagagcggagactgaagttgtccagctgaggggtgcagaagtgcagactgcaatgacagcaggcagaaaggactatatgttctagacagaatggacaggatttgctggtagattggattgaaggcatgagacaaaggagacatggatgatatcaaggattttgatactacagatttgaaacattctgagagggacaggtttgtgatggaaaatcatgagtctggttttagatatgttttagaagcttattggacagccaagtagagatgtcaggtagggagctggacataatacctaaagttcaggagagtggttggagctggtgacatcatttgcagaaccctggatggtacataaagcacgggacagtgtgtggatagatcctaaagagagccctagggcactccagccctggaagaaggcagcttatcaaaggaaaaagaaagaaagaaggaaacacaatccttattacttccatcttcaggacaattcaaagccagtgtttttgacttcctggcttgagtgaagcttgaaaaatggcaacttgcccctttgcaaagctcctaaggagtagccattggcttggcctgtttgcactggctctgggtgagcttttaaaatgccagtgagctctaattgtgttgattgcctaacagctgtgaatacaagatgctgactccagaactgcaactcattctgcgaagggcaccgtccttttccctctaatgactgctgaacagagccacctgaagcctgcatggggtttagcagcagctgcacttctgctctaagaaatagctcactgcagtcagatcaaactgaagctcttccttgcttttcctcgaagcttgggtacttattgtcggagcattaaacagtaagagtcctagcttaactggtgcacagtgctttatgtttggtagggatttggttaggcctacaaaccgtctgagctaagaaccttgagaaactcctgctatagttagctctttctgtgactctgcagtgtgaccaggaatgaggacagaattaagaatttgctgcctctatgatagaactgtttaggcactagaacactggaactagatctacaaccctatgaatttaatttccttttcaactcccctactccttcttttcaatatgatgataatgatcttgtttaaaaaaaaaaaaagccttctgctttacttcccactctgctcctcttcccagggactcactttcttcttgactgcttccccattacaagtactcagctccctgttttatcaccctgcttagagcagccattatcagccttggctgaacattggaattacctgggaacttttaaaaatccggaagtctgggtctcgcctccagagattccagcttagttgtcttgagcgtggcctggacatttgggttttcaaaagttccctatgtaactttaatgtgcaaccacaattgagaatcactagcctccagactctctgtgttatcaaaattaatgagcagctgattttagaaatctcagttatcaggagaaaagggtgaacccccccagggctcttctccttttccaggtgacacttctttatggcagtgcgtgaaagtgaagccctgctgcttgtaatctccctcaagggagtgcaagatccaggcaaagacaagactgcagaggcgctaccttgggggaaagtaggaccctaaatacttacacctggaggcacttacctttaatactgaatttgtcagatgcaaatttgtctatgcaaaccagggccttatctctagcttcccctcaggggttttgggaagtgcgctactactctgaaacagggttgtaaagcgtcacctgtgctctccagggaaccctctggaaaggaggtggaaaaacagaggcttccacccttgcaactctaagtgtgttccttggccagtgggatccatcacctagtattttcttagatatgtggtatctgggggccagtcccacacctatgcaataagaatctccatttgaacaagatgcccaagcgattatatgcaagtttaagattgaggagggctggtttaactcgagggtaacgaaaagtacgaaatcgtactttacaggagaagctaggcggagggagccacttattcttcctcttgcagctgggtctttttgtggtgagtggcgaagcggcgaggctggcaggccagggtgctggactgggtcaggcgcggccccgcctccctcctgggtccctgccctgcgcgccgttgctgtggcagcgctggacgcggctagagctggggctgccgcgccctccacctccttctccaaaggcctccccggacccctggctcgggcccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgagtgcccggccccaagcgtcttcgcctccctccgcgcttcctccctctccccggcccaaggcctacacccacgagcttttgctccaccctccccttttctcgcctcccctccccgtgctcgcctcactgcccggacaggttaccgagtccccaagtcgccgcctcctccttcccaactgggaactcacgcctctcgccccatcccagaacccccagggattctttcgctacctagccttttcccgcctccgagaccttccccgggcaaacgtcacaagcagcttttgctcagagtctcagcagaaaatcttgagccccaaaggggaggtaatttacaaatgtgagaaggtcaactactcctcccctccaagttgaaaaagttttaatccattaactttgatggtacattgaaactataaacatctcacagattatgcctacacaagagttctgaatccaactctcattttgctgacttgaaaatgtaactccagagctttgggagtgtttctgggtttttttctgcccctcaccttccttgccattgtctagaattaagacttcttcaggctcggtctagaaacttttgatttttaatattgaccctagattattggatcacagttttgcgatgcttagttacgtcaagcggtttgcttaacgtttgccttttattgacttaaaattttagttacctaaaaaagttataatgctgtagtttacaacaaatacttcgagtctattttcacgtcttagtcaaatagccttatagacttaacagatattttataaagaccattttgcaagtcttataagtagactttcatatagtcttatttctaagtccaaactcgagaaatactccccattgttgaattagcttagatgtgagcggtgaaagacagatgaaatgggggaggaactacatcaaggttactctacttgcgaggagatgacttgggggagatggaatttggtattcaacctcttttagctaaatacaaatttatgaaattaaaaaaattgccttcccctgttggaaaacaagacacagtgtggtatttatgttacagaatagactcactgtcttaaagtcttgctcaaaagtctaacaaaatgaaaccaactagccagggattcagcactggttgcgattgtgaattctgcctgtgctgcatgtgccatgctcgctcgcttcacgaaaacagtctttgaccttaaagtgttttcaggtgttttaaaaaccaaggtgtagtattttcttgaaccttttaagttaaaagctagggatatagctatggaattatttgtaagtctttcaggcaattcgagttatgcaatatagaagtttataattacagtttggattagcccaaagagccagtttaacctacagtgcagctgaaatgctatagaattaaaatgagacattgtgcaatgagaggtcatacaaaccaatgttgcagtatttgtgtacaaaaaaagcaaacaatgacatgagaaaagaaatgctgttttatattgagtggtgattaaggtaaaataggtttaattagtgcacccctggcagtagagtttaaaatacatcttgacagatttgtaactttaaaggttgcaagtactgattctttgtttaattatgccctaaaaccatttggtggtcttttccttcatacaggtgtaccctttttctttgtaattaatacctggtattcaaaccactttgggcctctaaaattgggggcacagaagcctagagccttagtaagtacttctgtttatggaagaaaccaagagatgttttatttaggtaaaatatagccaggcgtggtgtgtccctgtaatcccagctacttgggaggctgaggcaggtgaattgcttgaacctgggagttggaggttgctgtgagcggagatcacaccactgcactccagcctgggcaacaagagtgaatctccatctcaaaaagcacaacaaacaaacaaaaacaaacactgggaaataagaaggagatattaagagatgatatatttaaatgttagaaatgctctgttgttgaataagcttagatgtgagtggtaaaagattaaatggaagagggagctacatcaaagttactgtacttgggaggacatgatatggtaggatgtggtggggggagagcatgtccattgctggttggcaagtgactggctgcctcagaaaaggatgagggtgggtaggggagatcactggagattattagaacatacgtatgttttcaagattgcttagtttttaaacctcatagtactttgttttcactgatgaaataaaatactatgtgatctttttctaattttccatcttgagtaataagcaaagacattaatgtattttatgaaggctctgactgccaaaattgggacaaattgatggtcttgttggcagggtaaatgagcataaccgtagtaattgtagttctttttattgggttcagggatgacctggaataatggatgtgttattacccttccctgtagaagtgaggctttcgaaaagaggctataagtcaatttgggaggcacaaagtatcagcgctttttggggattttttttttttttaagtagagaaatattttaaatgtgtgatataaagttatgcatgtgcttcttaagcacattaactcaaccagatccaacagctggtctaataactttttaattgtttaaaaaaatttaattgacacattgtaattgtatatatttatgagatactatttgatgttttgatatttacgttgtacaattatccaatcaaagtagttagttatccttcacctcacactttcattatttccttgtgggttagaacattcaaaagactctcttctagttattttgtaatatatagtattttactgttaaccatagtcaccatactatgcaacaaaacaccagaatttattcttcctacctagttgtaactttgtgtcttttgactaacctctctccatccttccttctcccctccccttcccagtctctggtaactattctaatctctgccttatctatatcaaccttttataatagaaaaagattctacatgtgagtgacatgtggtatttgtctttctgtgtctgggttacttctcttaacacgatgtcctccaggcttagcattcacaattgacaggactttattttttaatggctgactagtattccattatgtttctgtatcacattttctttattcatccattgttgtacgcttaggttgattccatatcttggccattgtgaatagtgctgcagtaaatatgggattgcagatctcttcaacatactcattttatttcctttggatgcatacctggtagtgggattgctggatcatatgatacttctatttttaattgttttaggaacttccatgctgttttccatattgactgtactagtttacaatcataccaccggtgtgtaagtgttcccttttctccatatctgtgtcagtacttattttcttttgtctttttggcaatagccattctaactggagtgaggtgtatctaattgtggttttgatttgcatttccctgatgattagtgatgtcaagtatcttttaaatgcacctgttgatcatttatatgtcttcttttgagacctatcaattaaagtcgtttgcccatttaaaaaatcaagttggccaggcacagtggctcacgcctgtaatcccagcactttgggaggccgaggcgggcagatcacgaggtcagaagatcgagaccatcctagccaacatgatgaaaccccgtctgtactaaaaatacaaaaattagccgggtgtggtggcacatgcctgtagtcacagctacttgggaggctgaggcaggagaattgcttgaacccaggaggtggagattgcagtgagccgagatagtgccactgcactccagcctggtaacagagtgagacttcatctcaaaaaaaaaaaaaagtcattattattttatctgttgaattaattttcttatatattttggattttatccctttgtcgcatgtatagattgcaaatatttttctcccattctgcagctgttttcactttgttaatagttttcttcaaggtgcaaagttttttagtttgatgtaatcttattttgtctatgcttttgaggtcttattttaaaaatccttgctcaggtcagtgtcgagaataatttcccttttttcttgtaatttcatagttttcaagttttacattttaaatctttaatctatttttatttttgtatatggtgagagggaggggtttaatctcattcttctgcatgtgaatatctgattttcctagtaccatttgttgaagagactgtctttttcccagtgcatgttcttgacatcttaaaaattcagttggctgttgtaggtgcaaaaatttatttctgggctttccattttatttcatgggtctgtctggttttatgctagtaccatgctgtgttgatatagttttatcgtatatttcgaagtcaggtagtatgatacttccagttttgttctttttgctcagggttgctttggctatttggggttttttttgtggttctgcatgaattttcagattgtaacatttctgtaaagaatggtgttggtattctgatagcaattgcattaaatccatagatcactttgggtagtatggccattttaacaatataattatttcaatccatgaacatgtactatcttcccatttattgatgtgggaagataatttctttcatcaaagttttatacttttcagtgtagagattctttcacttccttggttgtttatttctaggtatctttttttttaaaaaagtactataaatggaattgttttcttgatttttcacatagtacaatattagtgtatagaaatgctactgatttttatatgttgattttgtgtcttgcaactttactgaattctaacagttcttttgtggagcattttgggttttctatctataagatcatatcttctgcaaacagggacagtttgacatgcttctttctaatttggatgctcgttacttctttctcttgcccagtttatctggctagaactttcagtagtatgttgaatagaaattgtgtaagtggccatcctttccttgttattgatcttagaattgatctcgttattggtcttttcccattcagtatgatgttagctgtggatttgtcatatgtggcctttgtgttgaagtacaaactttccatacctaatttgttgggtttttaatcatgaaattatgccacattttgtcaaaggcttttaatgcatctattaaaatgatcatacagtttttgtctttgttaatgtgtatcacatttactgctttgtgtatgttaaaccattcttgcatgcctctgatcccagtgatgaatcgcacttgaatgtagcaagttatctttctaatgtgctgttggatttggtttgctaatatcttgagaatttttgcacctatgttcatcagggatattgtactatagtttcctgtgttgtattgttatctgattttggaattagggtgatgcttgactcatgaaatgagtttggaagtattccctttgcttcagttttctgaaatattttgagaggaattgatattggtttgttaaatgtttggttgagttcagcagtgaagccattcgtttctgggcctttctttgatgaaagactttattactgattcaatttcctcacttattattggtctggtcagattttatgtcttcctaacttaatcttgataggttgtatgtgtcggggacttcgttttttctatgttatcaaatttgatgaaacttgttgaaaaccaactctaaattttgttcatcttttgaaattatttttagtctctatttcatttatttctcctctgagttgaattacttccttacttctaccaactttgggattagtttgttctgttcttttttttctttctttctttttttttgagatggagtttcgctcttgttgcccaggctggagtgcaatggtgtgatctcggctcaccgcaacctctgcctcctgggttcaagcaattctactgcctcagccttcctgagtagctgggattataggcatgtgccaccacacctagctaattttgtatttttagtagagacggggtttctccatgttggtcaggctggtctcgaactcccgacctcaggtgttctgcctgccgtggcctcccaaagtgctgggattacaggcatgagccacaatgcctggccgattagtttgttcttaattttgtagtgccttgaggttcatcattaggctgtttgtcagaaatctgttgtcttttttgatatgggcatttaatactataaacttacctcttaaaactgcttgtgctatgtttcgtaggttttgttatggtatattttcattctcacttgtctcaagaaaaattttaatttcctttttaatttcttcactgacccattggttgtttaggagcattttgtctccatgatttgtgaagttgtcagtttttctcattgttgatttctagtttatttcttttctttctccttccttctttccttccttccttccttccttccttccttccttccttccttccttccttcctccctccctccctccctccctccctccctcccttctgtattgctttgtctcccaggcccaagtgcagaggcacgatcttggcttactgcaatctctgcctcctgggctcaagcaatcctctcacctcagcctcccaagtagctgggactacaggtgtgtgtcactgtgcctacaggtgtgtgtcactgtgcctggttaaatttgttttttgtttttgtttgttttgttttgtatgtttagtagagatggctttcgccgttttgccatgttgcccaggctgttctcaaattgctgggctcaagcaacctgcccaccttggcttcccaaagtgctgggattacagccatgagccactgcacctggcctgatttctagtattataacgctgtggtcagtaaagatacttgatattatcttaatcttttaaaatttgttaagacttgttttgtggcctaacatgtgatctctcctcaagaatgttccatgtgcatttgagaagaatgtgtatctgcagctgttggacggaatgttctgtaagtgtctgctaggtgcatttggtctatggttcagcttaagtccaatatttcttgatctctctgtgtgtgtttgtgtatgtatgtctagataatttattcattattgaaagtgggctgttaaagtctcttactattattgtattggagtttatctctttaggttgaatatttgctgtatgtatctgggtacttaggtattaggtacatgtatgtttataattgttatatcctgttgttgaattgatccctttatcatattatgaccttctttgtctctttttacagtttttgacttaaagtctattttgtctgatatgagtattgctactcctgctcacttttggattctgattgcatggaatatctttttccatttcttcactttcagtctgtctttaacggtgaggtaagcctcttttaggcagcatgtagctgagttttttttccagtcctgcagctactttatatcttttcattagataatttatttacattcaaggtttttattgataagaacttatttctcccattttgttacttgttttctggttgtcttgtagattctcagttcttctttctctcttgtttacctctgtggtttggtcattttctgtggtcctaagctttgttttccttctatctcttgtttatgtatctgttgtaattgctttctttgtgggtaccatggggctaacataaaaagtcttgtagttataataaactattttaagctgatagcaagttaactttggtcacataaaaatactctagacttttttcctccgccatccctaatttatatttttgttgcctttatttctttagtatgtgttccctagccattgtagctgttgttgtttttgaccagttgtactttaaaccttcatctagaggatcgacaggtttacatagtaacatgatatcactggggaattctgagttggatttatacatttacctctattggtgaggtttatattctcacatgtgttcatgatagttatcattttttcatttacagctgtagcactcctgtaaacattgcttgtaaggctggtgtaggagtgaattccctcagcttttgtttgtctgggaaggcctttattctcctccaggatagttttgctggatatagtatcttttgtccttggccgagactcgtttttttttgttcttttagcatcttgaataaattatccctttctctcctggcatacatcagtaatttaatgttactgatgagaaatctactgatagtctaattaggattcccttacatgtaacttgatgcttttctcttgcagattttagaattctctgtcttcaacttttgacagtttgactataatgtgccacagagagaatctttttgggtttaatctaattgggaatctttgtggttccttcatctggatgtctatatctcccccaatatttgggaagtttttagctattatttcattaaataggttttctgtgcctttcttcaacttttctccatctgccagttctataatgcaaaaatttctttgcttagttttttttaaactttgggttatttcacaaaacctattttcagattttgaaattctttcttctgcttgatctggtctattcttgaagctctcgattgtgtcttttattcactgcattcttcagatttctgtgttttaaatgatagatcttgttttaatttctcattttataactttcctgatttcattgggttgtttgtattctcttgtagcctgctgaatttttttaagatcattatttttaattttgtttcaggcattttataaacacccttttctttggggtctgttactagagactcactgtgttcctttggcagtgtcgtgtgtccttgctttttcatgtttcttgtgacatctgcacatctagtggaatagtcacattttccagttgtatgcagtagctttcacagggagagacttttcctgtagatgggtcctagagtgttggttgggtatggtacattggctttggtttggggtggattcagtaccatggtctctgtgtagtttcgtcagctgtaatcttcacagcaatgtctgatttcctcagtggcctaggctgcaggagtttttgatggtggtatagttttgctagggacaggcatgtcatgctagttgtcaggctggacacttgcaggctcggagggctgacaagctgtcttttgggctccccagggaagagaaagtatgattttccagcttttcttctatgtttatttaaaactttgttgtctggctcacagtgttctttatctaaagtctagccagtggtggtggtcatattgcaatcattattacagcttcagactttctagaccttttccattttagtgaccttcagccttcattcgcttccattcatgaccacagaatagatgtagtcatctctattgaaggcaaacccatcccatctcttcagcttcatctagaaatttgtttcatctgttacactttctttctttggtttttagccttcattctctaccagctctttcacttaagcagagatatgttcaagactctcccattctaacagttccctgccttgatcctacaagcttttctctttagctgctaccttgctttttatttttatttttttctcacttgctctgataatctcctagaaaaattggcttactctgaccatctccattagttcacctcttaattattcttcaaccatctgagacctggctttgttctttctctactgaaactcttcaggcagagattagcagaagtcttctaattgctcaatgaagtggaaattttcagtccttattttctgtatttctccttcatttgactttgacttaactctcttggtttttgtaataccaccagcacctagtttatcagtctctcatgggaacttcattctatctgcctgccaaatggtggagtcccaaggactgtggtctgatctgctgttcctcattacatgctttctggtcagtattgcacactgtggttctcatctaccatcatctacctccagaagtgccatatatttagtaagtttacaagaaaagcaactttccttgctccgtagactaactctgatcttttgttccctatcatggttatggaactcactaattattcagcatcagctgtcagaatgtttaactttgctatttaggtttgtgtaagttatgggacaataactaggataactagaattagcttgtagcttatgtgggttagataatacaattgcatatgtaagtagtgaatattttggcttaataagtgaaggagtatttaggaagctatctggaatgttatctaagtcaggattctgaaggtaactctagcctcactgtcccttactcactatttctaaacacccaccaatcctgcctactttatttacttggtatttctccaatctgccatccttctctgtccgaccaatcactaccctagctcaggccttcaaagtctctcacttgacctactccttcacctcctttgaacctgtgcacaaatgttagcttcttagtaaggctttctctggtcacctgtataaaattcccatctgctacatacttcctggttccctgtattgccttatattcctcagtggcatttatctccttgtatactatataatttctgatctctgtcctttctattaccaccccacttcaagatggcaaggatttgtctgttatattagtgactgtcctaataggaaaaaaaatggcacatttatattagagtaacttgagaagaatttttaaaagtcagtatttataaagctgtagatatagagatagtgaagtactcttgggactagtaatcattgggcaggtgataccatttttaagcccaaaagggcatagtgaaagagcaggtgcctgaacctggattcagagagactatgtagaggaggccactaggcaggagctgtggcctttgcctcagcttggctgattacctcactaatcctcactaatcctaaattacccaagttccttcttttctggcccatttcacagtccaaagccaactttaagccagagggcaaggggagcacttgatgcagtccatgcagtatggcctcccagtgaacagggcaggtggaggatagaaactaaatctagatggaggagagggaagatattcagaatatgttttttctttactgtcagcaccttgaagagtgcctggcatatagataatatttattgaatgaatgaatttgttactggtttactggcctcatgaactttagttttgcctattctattataacttggtgactacattcctatatacttgataccaactcctcattaactacaaaggcagtattcccctctccccctttttaaacatcaaaactcttttttaaaaaaaattcttaaatgaatcgccagtatataacacataaaagtatgggtgccttgattggagtggtgggtaaatgatcctgagtctgtctgtttgggttccctctttgcctagcaggaatgtgactgtcttgtttaaagcccactgaagtagaaaacaggatgagagacacactcttcaacatggcataagatttccatgcttggctcctgcctatctctgcatcctcatttctcagtagtttcctcatattttaccatcctgtaattgaaagaattacaaaactagttctctacacaagctttcttgctgttccagctgctgggaattagcttcctttgtgcttttttttatttgaatgattcatgtttacattcattaaaattaatgaagattcattacagttgttttctctttaggcataattggatctcctatactgagacattgaatgcaactttgattgtttttttcccccattatatgttaagctccttgaggttcttttcaactttgcgttattccaggatttctatcgtaagagttaaggttcatccacttctctgatgtgaggttcatggcaggaaggttccatgttgctcagctgcagagtagaaaatactgagcagggcttaaatagattaggatgctgccattataatataaactgtgtttacgaaagagcatcatcaattcagaaaatatctttttcattgactacagtggtgcctgatgatctttctattacaatcttaaattatggtcattttaattatagaatcatacatgggtttatttatgttaaaataaggtaattatcaagctagctgtgacctatgagaaaaatcctgaagaaatgatgaagggatcaggtgactgtttttgaagtcaagtgtgaaaggtcagaccactctgggtcatgggaccctgccaaggcagagcaggtcaagtgctgtgcccagtggggccaacccccagtatggtgccagggactgggtgtgagaagtcaaaaattaagaatacacctcagaaaggggacatggacagatgccacagacttatttgcgtatttcatgatttagcccttagcttgtgctgatactggatcagatattttcagagttcagtattttcaaaagcatcgctgatcacctgttggcattgttttacatctcaaccaaggaaaaacttttgggacatctgtttaacaaggggtaagcttttatttgaaatgttcgattaaagcagaagagtcaggcatttttttgtgcctccccaaagaaagatttgtttactgtcctgtgtgaataaatataatgtcattatttcccgtaaaggaaaagctgatggggagagtaagtaatgggtaagattaggcaatgttaagctcatatattagtatgtttaagagtgatcaatttagggatctctgtgacagagatgccaaatgctcacagtgctatctcatgttggaaacatgtgtctcctccacttttcctcagtcctctgaaatgacggccctttagggattgacagatactatacagatttctgtgctgatatgtgatttgtctaaaacaaaagtttcacaaaacaattcttaccattgccatttaagagtcactctgatatgctctgtttccattgcaaacaaatgctcattatgatttgtgaaattaacttcacaatttcctaatggataacaccttgaagtatgaaaagcactacaggatcttttatagcttccctcctccagctctctataatctgctcccatctgtggtgtaggaaagatttcagcagtggccgctgaaggccctaagatcttgtctcaacagatagcaaggtgcataacagactttggacaggttgtttaacatgtctgagttactgtttattcactggcaaaatgaagggcttatattatattgtctctaagtactatcagttctgaccacctatgaactttcattttaaagaaaatacctatttctatggcctttaggcattagggaattttgtcaaattaaataaatctcagtaaggtttgatggtcaatggggcccactgtctggtgtgtgtggaggggtgttgtattttacatcaggaacttcagagccctcatgaatttctaattagaggaaccacctgggaaatataagtcaaagccctttgctcgccttactcagctttagggcacagtgactagaggtgggcaatcgctttggtgtaggtattgtcattggaaaggaagaaaccattttctggaggaaaagaattggttgaggctagctttaagcagctatttcatgatggacaaaaggactagctcatccattcttcattcgtttctctgtatcctctatcaaatttctgagtaaagattttatacaatgcttgattagcattcaaatagtatgtttcaaagattttaaaaaaaataaaactaggcctttgaatcataattatggcttataactctatttttcatatacttactatctcaagttacaaatttcatgttatgtttttttcaaaagagtattcctgccacaactcagagctcagctgaattagagcagtgactagaaaatctgagaaggctgagcttcaaaataaggtctggaaagtgtttcttattgttacaagagagtcaaaatgattttcttgagctttaagtttatgtaagtatttacttgacacttagcagtttaaaagataatgtgcaaaaatatgaaaatgagaaaaaacaatttcaaaacaagagttggtgattacgtgagacttagtagagcaaagtatattctaagtattaatctgtctaagctgtttgggaacagatgtacgtgaaatggataccgggtgttctgttgtgtacaccccaagtgagacatctgttggtagactgtgtggtcagaaataatggaagcaggggttaaaccccaatatgacctattactcatgtgaattattgaaggactaattactcagtaaaacatgatgctttgattcatcagtctacacgttaagaaaaaagcctctttagaaaaaaatttagttctgtttctaagctgtcaaatttgaggaaatttttaagatgtatgcaaagactcaaatttccatagtaactgcaaatactatctgcttataaagttttaaaatgttttgacaggtctactaatttatcataaaaatagcctcaaaagttttagctttttgttagggtaggttgggtctcacagaaaacaaatgtagagtgaattttctaaagcagggctgtccagttagacttcctgaaatgatgggagtgcactatatctgaagtgttcaatacagttaccaccagctacatgtggctattgaacagaaacatggctagtgtgactgagaaactgaatttttaattatatttaatttttattaatttgaattcaataactgcatgtagcaagtggcaactgcattgtacaacacagctctgacacatggagagttgaaaatgtttgtttactttcttcccaagttttcattttagtctttgtttctacatagaaaggaagatatagcttttgaaaaatgaacctgaatgtagaactgatatggttatgcaatttgagctgcctatttaaagataaagcaactgagtttagagatttcaaagtggcagagtcctttaacatatttcgtgggctggccacggtagctcatacctgtaatcctagtactttgggaggctgagatgggaggattgcttgagcccaggagttcgaggccagcctgggcaacatagcaagaccccatctcagggaaaaaaatatgtgtatatatatgtatatatatatatatatatatatatatatatatatatatatatgcatacacatatatacatatatacacacatatattaacatattttgtgtgtacaaaaaatatttttattatgtgtagattagttggttactagtaaagttgaagtcttgtctatagaaatcattgtatttttcatggtcattgtgatacattgtttgaactgaaatttggcaaattcaatctgtttcttactacaagaatagtacatagatttgaaatggtaactctcttagtctgtgtactctgaccctgtgaacgtctggagactaatgttattcctaaatatgctatgtccacatggcagcatctgaaggcaaacactttttaaaactgatctacttttgtggacccttcctctctctctttcctgcatcccggatggggccctctggggctggaactggcacagaactattcccctaggagtgggttcattgaagccaagggacacacaaattgagaatcagatagactggaccaaggtcattaaaccagagagggcaatccagatggggttgtccaaagtaggaagttctgaagtgaattgcagaaatccaaacatggcaaagctaaaggaatagagaaccagggcaatggatatagagaacagagcaattgggtatgcaggaagatgctattgcctagactggatgtttttgtaccctctgtaatttgagaaaatggaccgtccttgttgaaatggtcagggatgtagtagataaattcattgcagttgtgtaatctcagcactagaatactgatcataaccatatcacttgttatcccacctagcctgccacttgattgggttattagattacatttcagacattgacaagtctacaagcatcattaaaatcctaaacacagacttctgaccgtattcctacccaagttttagaagcactatgccaatgacgggggtagtatatgctgagcaggtgagttttgattgtgtgtgtctacatgtgtacgtgggtgtggtgagcaacaggaaggaactctcagccatgactctaaatgctcttgtgttggccaaaattggtataagctaggaggagaaacacaaaggagagagaggcatgaagttgaaggacattaaaccatttgcaaacttttggcatgcaaaccagaatatgaggaaacttagtgtaatgggtgactgaattcagaggtagacaggcaatcaggaaggtataggcaccaaaaatagttaccattggtgagcgtttttgtttttgtcattggcatggtgttatgaacttatgttaagcctaagggtaagtctaaaataatgtaccagctggcatcagggaattcccatgtacattcctagattttcattagaaacagtgttctggaaactaccactgctgctacacagcagtgcccagtgcttgactgaaaatagtgaacacttagatttgtttactctgccaggttctgtgctaagtatcttatcttgtttaaccttagcaaagaaactatgtagtctagatagaatttttatccctagggcccagaggtgttaaataacttgcccaaggtcataccagtaatttcagttgctggggttcaaagctaggcagtctgactccagagcctgcactgtccccatttggttatgttgcttccccagttaagcaagcaagagtctatctgacatctgagttggtggtagtaaagcatcatggtctgaaccaaaataataaaaacctttgaaacaacattatctgacttctttcaggcttttaagacagttccatcatcaacagcttattccatttctctggccacttccagtttctgaacaaatgaagaaaatgggagtgataaattggagtttttaacaagtttttttaaatctaattttttttatggaaaccaccaaacatacccaaatgtaggaataattatgtaataagtcctcatgttcaaccctaagaggggtgaagctctatgtgacccattactgagtttaaacagttttcaatttatggccagtcttatttcatctatactctacccacatcccttcttcccctggaatgattgaagtaattcctaggcatcatataatttcatctgtaagcatctcagcatgtatctctaggagataaagattttctaaaaaatcatattactactcttcaaatttaaaataatctttatagttttacatatccagttagtgtccagattttcctgatattttctctattttttaaatatgtcaaccttgaaatgaggtccatattatagctgatggctatgccttttaaattttctcatccacagattcttcttccttttttttcctttcaatttatgttttgaacaaactagtttggcctatagtttctcatgggcaagaataaccttcagactgggatggccatcactctgatacccgtaaaggggatgaggcaggttggggaagggagagcctcagaccatgatcagatgtcacaagatttttgcttacctagggtgaggacttgggaaaaagattgcccattaggagtcctgccttgggcaaaagtggccaaacttcagctgtgctgtcacaggctgtgggctgccttggaaatgtaggacctcaactcctctgaagttgaggtggagcttgagggtacgaatccctggtggccattataatgactacactcattgggatggcatggcaagttcatcctcaaagatggatcctagcatccaccatgaccaatgaggtttttttattgttatgatcactataaactcaaggatttaaacctattaaatgtttttcaattcacagcaatgattatttttactgatcttcaaattgtcacattttggatttttagaccaatgggagccccttcatcttgacttctgagttcttttgacattcactcagctgtctgatagcttccctgctttctggaatggcaagatattccaggttcatcttgaacatttcatgcttgagatatggaatcaagctcatcatcagagggtcctggttccttttactggatagtggtattagagacctcaatttgagaactaagcaacatcattgctaaaacttcccctatgtgtaccttgttacttaggtttttcaaagaacagagctagaaaatatgttgggtttttttgttttgtttttaaagaaaaaatgtatcataggattatgctgatacttccaattcaagtgcaggcctaagcttttcacattgtctcttttctcctacccttaaagtcctgattcctaactataacaacatcattactcatttgctttatcctgcattatgtagacacaatagagtaacaacaccaatgctgccaatcaaaagtataattactgaaacccacttaagatagtcctgcaatttttttttttgttcatagagtgtacactactagggaggtgtagtcaaattactatgttttaaagacacttggaataattcatatctgtgaagttatacccccaacttatttgttttttgtattattgtttcattttgcttttgatgtttaggcatttcttttttaaaaatcaattttataattacgtgaaatacttatatggttccaaaatcaaatctactaaacaaactatattctaggaagtatagcttttatgtttcccttctatgcttttccttccttcctgtaggtaggaaagcttatttgttcctcaaagctctgggttgttcttttattttatataaataaacatgtgcatatattcttttcattacccccacagtacccaccgtcttaaacacatgtacaatatatgtgtttttctaccttgatttctttcttacttagcaatatgcccagaagttcactctgtagcgctttacatcagcatcaaaatccattatgtactatcgtttattgacctctctgttggagaaatttggattgtttctagtcatttttgttatcgcaaatagtggtttaataaaaaactttactttccgttttttgtttttcaatgtgcttttaggatagatgcctagaagtgagattgttgagtcaaagaataaatgtgttaataattttgctcaatattaccaaattctttcaaaagggttgtgcaattttgctttttaaaatcattattgtataagggcatgtatttcctgaaaatttctccagaagagtttattgccaaactttaaaaaaacagcctgatacataataaatgatatctcagcatagtttaaatttgcatttttcttgttaaatcattcatgtttttactgtagtcctcctaacatttagggagcaccaattatggggtctctagaaggttccaggattctgtaatcaatttgacatgatttctgtcttcagatattcacaatcttcaggaagatatattgacaaaagaataactacatgatctattttgtgtgcaacttagtacttacagagcattataaatgcacatggaaaaataggtaaaggagaaaatcattctctgttgggcgggctgagggggaagtcaggaaaagctacagagaggttcgagggtaaactttaatgtgggccttgaagtatgatttggagttagcaagacagacaaaggagcaaggaaaccattctagaaaaagaaaattttgaaaaatctccagaaaaggatgctttggcctatttggaaaataacattgtcttatttatgggggagatgacagtgctttgtttttagtcagtagtttatacaggactttgaatagcatgcaaggaagttggcgtctcaacctgaaaattgaggaaggtgtgacaaaggctgggcattaggtgagatcaagtatttctgtttttttttttggtaaattaggtagcaggatagattataaatgggctccacactgaggagcccagtgtgatggctgatccagcagatcagggggcagtggctgcaaagctgggagaatggcaaggtaagcctggatgcaagggatattgtcaaagacaaaatttgggggatgtgaggcttaaaagggaaataaataatggtgatggtgagatttctagcttgggcagtgggatagatagtagacgctgcgcaaattcgtttttaaatcagcagaatgagaagcatcttatttgaaatatattctaccaaatcttagcatcaaatgtgctagtgactagcaaaatatgtaaacagaagggaagtagcttgaaaagtacacaaactggagaaattgctcctgaaggactgtaagttgaacccttttaagcctaagatctgtatttcctatgagccctaggctctttccttgtgtatcctgtttcttattagagtagaggctacttaaaaataatcatagtttaaagcgctctattttcagaaaacattattcattagatgttagtaaataatgtaatctttatacattcataatatttctgcattattggagtgtaaaaagtcagtgaaatagtcatttgtaaagatgtcagtttttatctgtggaaaatagctgttcataccattttaagcttaaaagttcttcatttacttcttaaaatatccatgttggtattattttgtctaatacaagtaattaatatttaccccaaattaagcttttaagtttactaaatgttacaaacataattcaaagcactgtttagtgtccatctgtgcaggaaaaataagatcaatacaattgagcagctgttagcatgtattggtttccttatattttaagtatgttttcatgttttgaaggtgtaaagggatgacagtatgttttgttgtggttttcatcatacagataaaaacttattacagttgaaatcttggtgaacataatacattttaaaatttccattcctcacccatttatctagatatttagacacagtaaaataaataacatggatacatttttgtcatgtgatttatgttttttaaaaagtagaaataaatttctctaaaagttatttttattttttaaatttagcatttttcatatttgaggaaaaaacaatatgtcttggtaccctagcttctgaactaataacacacctgtcattttacaggttattttaatgtttttcattgggatcaaacctactctggaaatatctcatgggtgagctttatttttatgaaatgttcttggcacttgaagacctttgtaggtacatgccagactcatcttacatccagttcttctgcatggaaaatatgtgcattgaaattctaagtgccttttcaaatttgaccttcttagagaataatatgagtcccaacaattaggaaaactatggaatgccttttggcctttacttttcaaagattttcagtcagtaatgtttaattagcattcattgtgtacattgtccttttttgtgtgatatggctagttccaaaggaatattctagaagatctcagccttctgctattgaaggtgataatacactactaagttatgtgttgctttacattaaaataatgttgcagcagttacttattgcttaactagcgggtataggacatcaggttgaaataactgattttgaagtgaagagttcttgtttatatcttaaactaaccaagtatgttcattaactttgagaataacaatgatctttttcattattcttgagtagactggataaatcagaaaacccatgttagaggtccctgtaaaaacttcagtcttatttggtaagtccctttataagagtttcaataaaatcaggtaaatttaaactctgaaaattctacgtactgtctatcatgttcaatttactgttaaccagtactatgcactggaaaaaatttttttcaccttaatgagaccactggtcattactgctgctactgatgctcttttgtctgcacatactgttgcaacataatgtgttgtgcatttgatacggatattatcatattgccataaggagctgctattattttagacaccaactgattccatgatagtgtcagatttctttaacatatgcttatgtttttgtacaaatgaccccaagaaacatctgctagttttgtggtggtatctactgtttcttttttagaatttgacctgtcagtcactttttaacgtgaatctacaatatttgagttgtattcctttctcgtttttatgctattgatattaacaaaattgagtcagttttatggcataattcagagagaaaccgaagctgtctatggatgttattttaaaaatacctttttcatgatgattgtgcctttaaatttttgtcattgattgacactttaaaattgaaaagtgcccttttaatggatcctttaggttccaaaatcttaagttgaaaatttctgtctattggtcctgaaagtactctctgaatttgataagtatgtagtagttgtggtgtatccttggtcagtttatatcctgtgctaattgctaatcttacttagtttctttgatgcgtgtgtgaagacaggcaaagaaaaaggaagtggaatttctacaaaactgtgaaatctttactttatggagactagagaaatttctaagtaaaagaagacactcattctattgtagttaggatcccttcttttacttgcttttcatgatcttgactgaaaagcaacaattgagatttccattgcccgacgctttctcttctgcttttctttttgtttctcttgcatttttaaagacagctatttattcaaaaacaatatgaacttttatttattggacttaaacctggaacatcaacaaaacaaagaacaaacaaaactacctttccaaatttattttattagaggatgctatcaatacaattttgtattatgttcacacttgataccaaacctaaacccaagaaagtgtgtcctgtgttacagcctatccctctgtttaagataataactagaacaatttacttttattttctactcatctgctttctgtgtatcagctgttgtcctccctcagcctcgaagcatgtcatcatttccatctccgtgctcattcagtcatccttgctgctcttagtcccctttttgtcccttgggtgacttatgtcattaggacaaccttctgtccccacttggctgaaactgagctgaggcccttgccagttgcattaggtgtggcacctttcatggctcagtttgggcctctgtgatatctgtgtgccttctactccaaactccattctgccagaggtggcagggtgactggaagctttagtttcagtgacaaaacccaagcgtggctatgctgagtgtctaagtagctttcatttaggcctgaaataggagagtcaggcgcctctgtgtcccctgagaaagagagatttccctcagctctctgggcccagcactcaaccatttaagtcagctggttagtataatttccctaaattgtggtttagtttccctatgagtaggactggagtaggaccaagtaaggaaagtccctagtgacctttctgcctcctgaggagcaggccatttactttgagttgtagcttcccatctgtctgtccccactaccctatccaaggccctggaggagccacaggatgagggaggagattcatggaaaagcgccttcaggtactgggtatgtctggagtaacatttaaagtttaaaagactctttaacaattttcctctgatacttactactgcctatacttgtttggttttagtacagtaagttttgcctatcgtgggggtgaagaaaatagaaatattcccattaactttgtatggtgcttggtatgacaccctgaacaggtgcacccgtaattgtttacttgatgttctttttaataagtcaattatatcatcggaaattgaagaatagcaaagttaatttgtttaatcattctatgggaactcttgcatgctcgttcactagaggaacattgcgtttctcccttaaaggacaaggctttgttttgtttttaataagacacactctttataattaaaacaaaatcccagtgttaagggatttctgttttaaataattggatttctttcctttgttcctctaatccctctatatgagaaaaaaatctaatggtgtcttaggataaatatttttagattaaaaagttctcttaaccactgaaatttaataatacttctcaaagtttatggatgatatagaatgtaatgtaaggttgagaattttagatttggcaaaggcaaagatacaaaaactagtgaaaaacaacaaactggaaacacttttaaaatactgatgtatttatctttgcaataaattattcagaaatataaataaactcactatttacatagttttatttaaatttgtcctcaaaatactaaatttagtactatatattttcttctttcagataaatgctttcctgaaaatggtattttaatatctacagatggtttagtttaacaatggttggggtaaaaatgacatagggaaaagcaaaatgtgacagcccagcttggttacctttagagaaactcagaataaactctattcccatttccttctctttcccctttccatactcgagagcccttttctgagactcttaagtcatgtttgggccttggagaggataaatagcagggtgggtggtaaaaggggagagtgctttgcttgaggcaaagttttcctccatatgggaccttcctcaagccctcccttcaaaccctttaaatgagagcatgagctcctaggacagaggtcatgtggaaagcagcattagcatgaaggggggtgctgtggaggggtgtaaggtgcaaaaagcagcattagcatgggggaaggtggggtggaggggtgtaaagggaatgagatgtgaagtggttaaagggccatttttctagttggcctctgggctttgatgaaccttttccagtgtgcctgtttctccacttagccctgggctaatcttgactcttaactttccaggtgtgtatctatgctgatttctcctgggtttggaagctctgagaagctctggttctagttcaatcacaagacttttaaagaaccagaaaaataaaacaattttttaaaaagtaatgaagaaaagacttttaaagaaccagtgaaaacctgggagtaaaaatatagaagacttgagaaatttcatctttacctttcaagtgggcagcatgagaaattcttgtaaatggtgctttcaaatcttacacaaggttctcagttacctttatttgtactccctagactgtattgcatcccttgctatgttgactaattcccacctaaaataattcaatggcctcccaatataatctggcattctaattaataagctaagaaattatttggtttttcactcattggcgttaaatattcttcagtgcccacatttggaaatattggaacacagaaatgaaaaaagatacaatcagtttctctgcttgccatgttttccttgatatggcaatacgacaacaggtcaccctttgaagaaaattcagagatgctaaagtagaaattaaaactgaagataagtcaaggcaggatagtataggagtctgctacagctgccatagcaaaatactacagcctgggaggcttgaacagaaatttatcttctcacagttcttgaggctagaagtccaaaatcaaggtgccattggggttggtttctgaagagggttctcttcctggctttcaggtggccaccttcatacagcatcctcacgtggccttttctttttgcctgcatggatagagatctctggtgtcttccttgtaagaacaccagtcctattggattaggaccctatgctatgacctcatttaacctaattaccctatttaaggccctgtctctaaatacagtcacactgggggttagggcttaaacatattttaggggaacacaagtcagtccataacacgtgatttgctatagttttcctttacctaaatcttttccaaccttgagagtggattttggccaggtgtggtggctcacacctgtaatcccagcactttgggaggccagggaaggtagattgcttaagcccagaagttcaagatcagcctgggaaacatggcaaaaccccgactctgggggggcagggggagtgggggaattagctgggcttggtggcgttcacctctagtcccacctactcaagagggtgaggctgaggctggaggattgctacagcccaggaggcagaggtcacagtgagcagagatcacaccacttcacttcagccctgggttacagagtgagaacttgtctcaaagaaaaaaaaaagtgggttttattcttccccttaaattcctattaatagtgaggtgaggcttcttgtgttttttttttttttttccaagacaatggttaatgtgtgattacttaaaaatgatatataacactaagaaataaagaattgttaagtgagaaggaacatattaaaatggcttggaaagatgggtaattttttacattttaagtaggttttctcaactctaactctgtggaacttggtcaatctaatcagtctaaatatagcacaaataataatagttatatggacaggagaaatagtagccctcaaagatagtgaaatacatctgaatatcactaacaatgtcatgaatttgcttgttctaaagttttctgaaagtatgaattcataactgagtttttttttttttgcctatgactactaatgtttgaggagagagtagtgtcagaaccacccccccatttattacatgtttatttcatattttggtactgaaatcagtgtttattttgtgtcttcctgataaatcttgccaataagtaattaccttccatactgaaaagttcttaggattaccaggttgctgggggcaaccttaaaaggccatgcagaacattgacttaggtggctattaccctgctttattcaggtctgagcatttactttcctactacaatcagaatactgacctacatttaaaagtgcaacactgccctgttatctaaatccactgtgttcctgagaggaaataccagaaaagagggcaccaatattatttttctgctgttcttgatcataagtgattacctttttttttggttaggcattctgcttctgaaagataactgaggttgaagttaatagaactaagattcttatataaaatcataggaaagataattttcaggattattgaatcatattgaaaaatgatataattgtgttaaaagataaggactaaaatgagttaattcaatttggaaatagttaaattagaatttgcttctgtttttgatgaatactgctttttgaaaaatcttctgagtatttaagcttttactactctagtcattctctctaaagtagacatagaagcgtgttcttatcttgatttggtaaggctctgaaaatgcaaagcaacagatgttgtacccagcataattatatgtatcctggaaacacatctttattgagtgggatttgttcttggggaaacaaaaatttggcaaacaaaggacattaacttgctgatctcagcagtaattacttgggttagattataataatcttgtgtaggtggtaactgcatgcatatattacaaaatctaattctaaaatacgtacattaaaaggaaaatgaacttgcgcaaactttagatcatgtatccccttgaagagcagaaaagatctcaatttcattatttgaaagttgtttgaacagctttttggaagaggtttccaggattccaaatcctaatatgtgtattgatactgaggctttggactaatctttgggggttactgccttttttatgcccactgaaaatagagcatttcaaacaaatgaactgatctctgatctttaagcatgccagtaactctttggaacaaatccatagttatttttaccaatgactgtattaaaacagtactttctgtattatctcttccattccaaggccattttaaaacaccctctttctcttctcccaataggtaaagtacgacagagctccttaggactgggttatggagaattatctggaggtcaatttgagaaccactgtgcaaaccatttcttaaataagtagctacaaggttgtccttacaaaaatttctgaagttgatggtgttgcgttttggagtctgaagcttaaataagagtttgtcagtggtcatggtctaaatagctgattactaccaaggtcatctaatttttttttaacacaaaaaaatgttctgagcacaaatgaaaccttcaggacaagacatttatgttttgagaatgttcttaaatgattcctgtcgtgtatcttattttacatatcttaatgatcagcatgtattttttgttgttgatgatgattttataaatgtgctatcacctagtttctaattcctaacagctccttcatcagtagaatattgctgtagcacagttttgccatctgttaagaaaagatggtgactaataagagtggcacatttcagggctggtgtgctatcgcaacatctagtgttttagtactgaggacagtgatgtatgcagtgttccttacagccatggggtgtgggaatgttttcctcttcggcaaagtctgtgtatttctatagctgaactctcaggatccagaggaaaaccacaagatgatgaaaccagatgattgtcatcaaatttctattccccactacatgattattagttttcgtcaaaagaaatactcatcctatcctgggttggaattggtaaagaattttgcattgtgactaggacacctaaaagtttttaggatgagtacaaatggaatttgatagatttccccaaaatgtttgggaaaagatttattcctccctaggaacagcaagagtagcagcatcacatgaggcaactcctggtaattttttcttcttgctcttatttcaatgatatcttttcattcttttctgtatctctcaatttctatgtttctcctcttaatgtatcctgtaaatttcttagtagaacctttttactaatgagggtttcctagtttgctttaggaggcactcaggatgcccccttttgtaaggcagtaaattgaaaataagaacttggtgaaggtccacgtgacggttagtttccattctccattgtaccaaactgctacagggaaagaaccatatttaatcaacctcaaatcctcaatatttaggtcagaaaacacttggcatagaagagacactcaaattttgcagctaaatagattattgatagaaaatatgtttcttgcctctacaagcaatatgaaaccaatacaatctctaaatatcttcagactactaggggcaaatactgtattataagaataattcttcagaaaggaaaatccagctactctcatatcacctctctatgttgaaagctagggaagataaactggcttccagccagtgagagtccatgtggacctagtgctggctggagatccctaatccaaaggcaagagccagatactggttgtctgctgaaaatcagaagatgacctctctggtagtaaggccagtgactcatccctgcatcttttatcctcttctgatttgtataaggatctctcctttttccccagtacccactctcaagaattgctttcctttttaacatgatcataccaaaatgtatctaacagtaccttgatttcctttctgaggaatttagggagcatatttactttgtcagactcattagaggtttggcttcttggtcgggttcttaaatggacaacttgtttgggtgatttggcagagaataggagaagccagtcccctctgatagagcaaacctggggagctgtggttgacccacctgctaactgtcctgtacaattaggcatgtggcatcagtgggtgactgaccagagccaccatctcaatggcggctgttctttccttcctgtgccttctcagatctcttttttgttcttgttactccactatattggtttttcttgagtttttttcaagcaaatatcattattcacttctactgcagttcctctgttgttcgctttttctcttagtcttcattgttttccattttgaacattcagagatccatcaaaaaaagtaaaataacaggaagggagaggtaaacaccagtcaaatgaagtattataatagtgtattactatactctttaaagtaattgaagggtggttttttggggtcagaatatctgttagaatttggaatttgccactcttgagactggggcaagctatttaaactctaagcttatctgtccttcctcacaatctgtaaaatgggatcataataatggcacccagtttatggtgtagtgagcattcactgacacaattaatctaaacttatttgcactacatagaacagaatttttgtctattaaacaatatagcgttttaggcatgaaagaaactttagattaaattaaatatcatttttcttaccacagggtaagtttctgttttgtttgcccctgtttctctaactcctagaatagtttccagcacatagagattaaacaaatattcgttgaatgaatgaatgcatctattctaatcctcttgttttaggaatgacccgtcaggctcaaaagtgaaagcatttccctcaagattggtgacagagttggggactaaatctaaggctttctcttcctacaccagtgtcctttctgagaacacgatgccattttctcaatatttgtttatttatatggtaaattggtaggaagctgtgtggtactataagaggataaactttgataatgaggtatacttgctatcaaattctaacattctcatttaaaacatggcataccatttgtcttctacattttcatatgtaaagtgaggtgatttctaccttatagaactattgtgaggattaactgaactaatctttgtagagcacctggtcccatttattttttttttttgctcaccccaccccccaactttctagctagataacttatacattcactctgtttttcattccttcttgaatctcctgtggccagacttgacccctgtcactctacagcttactcgtcaaggtcagtcctcatctgacttgacctactaagagtctgacaagtagtcacactatgctccttgatacagctttcttcacctaccttcttggatgtcattcttttggttctcctcctaccccattgggctgctttttcccagtctccattcttgggtattctcattttcccatgtctgtcctctgacttcttattgtctctgtttctgttttctctggttggaccttctctagtttctggcttcaaatactatctaaatgctcatgtctttcaaatttgtaactctagtctagacctctcctctgaattccagttttataaatcttctacttaaatattagaggtctaataaacttctcaaacttatgttctacaacaaactccacattttctcctgcagcctctaaatatgtacctcctatagattttcccatttcagtaagtgggaacttcattattctgattgtccaaaccaaaaacacttggagacttgctacattccaccctttgtctttcattctacatccaacctatcaacaaatcctgttgcctcttccttggaaatatatccacgcttgagcagcatcattgtcaccacttggtgttatacactctcatttctcacctggagtattgtatttctcatctggagtagtgtctgtccaacgatgtcccccatcagtctgttctccatgtagcaatttcgtttttgtttgttttaagattgggtcttactttcgccttggctggaatgcactggtgatcatagctcgctgtagcctttaattcctgggctcaagtgatcctcctgccttagcttctccagtagctaggactacaggcacacaaccacacttgactaatttttttttttttttaacttttactagagatggggtctccctttgctgcccagtctagtcttgaactcctggcctgaagtaatccttctgtgccagcctcccaaagtgttgggattataggcatgagccaccatgtctggcccagatgttaattttaaagtgtacattagagcacatcgttcttctgcatgttcagcataaaatccaatgtccttaatgtagtctatattaccctacatgggctacttgtgcctgatccctctactcttatgtcttatccctctcctgctttctcactagcaccagccacatcttaccgttccttgaacacaccaagtatgcatttgccacaggaccttgatgcttactgttccctttgcccagaaacccttggaaccagctatgtgttaaaattcagatatttactgattttagagagctaaaatggggtatatataatatattacataacactcacagctggtttgtggtagcatttcataattaaataatatttctgaatgaaacattaagaatgcccatgctaagagggatgagtaaagactcaactctcattgtcagttcagctgcagaatgaggtcagctcaagatttgctgccaaatgacttaagaaaaaaatgtttttggagctttggggatttcagaattgcagatgagagattctagacccgtacctacacagcatgctcccttattttgttccaatctttgttcaacgattatttattgggtagtcaaggaagatctctgtctaaaaggcttctctgtgtggaacaagactggcatgtggaaggtttccaattaacgatattgaaagagtgaagctcaaatcatttttcactcaaatacatactatttagaagacagtggccagtttaagaataatcattattggaaacaaagtactatttgattagggatagttaacacaaacacttattagtattagggatatgtgaaatacttaatggatgagtcatgtgctgacataaaacccattatccattttagttcctggtagcctaactggttgaactctgttttattgatctattattgatttggcctgtaacttcaagttacattttaatgtaatttcatccttttctgatcaccttgtgtcttcaagcatttttaagcagttgatagatagttgaaagatattatcactatttcaatctaaaagatattatcactattttaatctacttaaaatttttactacattcattttaagtatgacttatggaacgaatcgaaaatacaagatagtgaaaaacttgtgaggatcacctgaaattttagcattcactttccttacatagaggaacttagtctctctaaagaattatgagtaataaagtatcataatgatatttgtcttagttttggttaagtgtactccacaggagaaagttaggcatgagcaggaattattgtagtcccacattctcaaacagttctccagtaagaaagattttatgtgtttccagaaatcattttcctcctcttcagagctttgggaccataattgtatttaaattgctaatctgttttaaggaatcataataaattgtttaacatttatattcaatcaactttgtaatttgtataaatttttcagggtgacatttgaacaatttttaagaaaatgggaaatacagaagtattcttagttttaatatattttaaaaagatgacatgtgatctactgactgaaatccttcaatcatttttgtttttctccccaagattagatagaatggatgtgattttatttttaatttgcattatggagagtacttttggggggttttatgaaaaagacttcatttattttgttagtggtacttcagttgcataagaaaatgttcttttaaatatagtggtcatttgtgtgcagccttcaagttagcaaacatgcctttgagtagtcactatttttgaaggtctttatatctgattgcaatggcttatattcaatagtcctcctactaaatgaaataaaaatggatgcctcttctgccacagaggcacaggtggacatgttggtagcaagccccatgcggtgtgacacatggcacagcccaacatgggggcaaagagcatgcggcttgagctaggagtcactttatggctactttagtgtagatttgtgtttttctgtggaacagccattattgaagacatttatatagtatgatgtttgtttttcattaaatgctgattgtgatttcttaaaaatagttaagacttgattagcagaacctatttagaagccagagttcccctgcttcacctcttgctatctatataaatgatatttttgactctgtcctttataatgttggcaccctgtgcatattagatgtaatcagggctgaaaggaaacttgaatccatctggaagcaataaacttttctaaaagactgcacagtgttatttaatcctgtgacttcttactgtgagtgaaattaaggtttgatgcagttgtgtcacatcgtattgatatcaaatttatctttctaaaaaaaaactgacagtattacagcacagaggagaagatggcttgctgtaatcctgtaagctattttacattgattacatgctacataatgtacctaagtatataaaatacttgatctagaatgtttatgttttctccaaaattttctcatcaggtaatactttctcaacttcacctttagttttggcttcttatcatagtactaactatgcggtagtaattgtgttatgatgaaaggcatggagaagaaattataattttaaaactattataaagtggagacacacttgtataattaccatctatgtagactgccaaggtataaacatttagcttattttagtatcagactctttgaatcaatttaaggctttttcaataaaattggcttcctctaatttctactccaaaatggttaaaattttgttttacttcaaatacgttgtagggtatcatatttcatgtgactaggagcctaaactatatcagctgactggcataatttgtgaattatatgtgtgtttattaaaatttaaagtttttattaagacttacaattttattaagacttaatttttttccttacattttgagtaagtccaactgaaaataacttagagacttaggaaatttgactacattttataagtaatttccttgtaatttttctttcttgtggaaacaattcttactgatttacttaactcttttttcaatggcaaaaatgaaaaccaaatatatttgtcaactatattcttttaattgtggaaatgaaaggttcatatcccccatttgcctagcatattaaaaataaacatgacctttgtcttgaatgttgttaacttggattttaaaaatcaaaccaattataagctatattaaaattgcttatcaccttccctttgtcttcagtaagtctgggcctaaaaatactcatcatatgaataaataaagttttacaaatactttttagaacatcttgaattatatgtgtgtttgaagcttacttttggatgttcggtcaacaaggcttctgacagtttctttttatcttccctctattccctgccactgtgcaccccaaagtgatccctgaccacagtggtcccattgctggcatcaggaaggtagactgaggagttcaggtatcctagaggctgttaggtgaatctcttctacctctttcctggtcctaggaccactggacacttcaagtaaaaataacaattactttaatctctcaggtaaagtttcttctcccttccagcaacacagatctgcctgtgccgagttcaaatactctgaactttcaacagttgttctgaatacttttttgtcatcttatgatcaaatattgagagcattgaggggataactgaatgggcatggtataaaagtcagacttttagtgtttctaagtagcagaaccctttggacaatttagagggctgtgcgatatcctcaccgtgactgctgggaagtaatgggatctgacctgcagaggtactaccttggctgacaataatgacaaaagtgagagcaaagtacatatgactatccttgaggtcctcaggaaaaaaagagtattagtgagttgaactgtatgtaagggtctttaccaataaggaagcccatgcccagacataatccttacaccctggcaatagaaaccatcattgtggtttacatctcatcctgttcctacagtccagcaagttcaggccacaaaaggtttaagcactttttcctttgttctcatagcaacagttgcccatggaggttcagttacactaatattaacattttaatatacacaaagaagtgcctcgaatgtagtaggtattcaaacttgttaaatgaaagaagtaaactttcagacttaccttgaactactacagttttattctttctctaacctctcccactactaccatcttaaaaccaccatttaattagtattttataacaagttattaaaggctttcaaagacctttgaaccttcaccctctggtaagttaataacttctgatatgcgattaaatgtcaactgagtagtagtgggccctaagagctcagagggactgagaaatgaaggttattgtttagaagagtggctcaatgtgcttcgacagttggttaatatttgaaaagactagagtcaagaaagccttccatgtgctaggaaatgaaggagcaaaggtccagaggtggaaatgtatacagtgtgattaagggattttctgattgatagtaaatacagtcaataaaaaacttttattggaagcctagcctgtgtttgaagcattaagctaggtgctgggatacagagattagagatgaagataatgatgaagatattgttgaagtgaattgctgagaagctggagaaagggccaattaccataatctgaggctcaggaggaattggtgcaaagatcatctggtatgatatatatgaactgtatatacaaactgatctgtgtagctgaactgataatgccaaaaaaaaaaagactaggtttttgattaagatgaatccattaaggtcatgttttctgttggtgccattcttggagacctcccccaaccctatacatttataaatgtttttcctgagggactgagatggaagtggacatataaaaggaaaggtctgggcaaatacataagtaggtagtaaaatcaaggaacaaatgatctcaacaaaattgcccttcttgaaatgaatgaaaatgatgaaagccaatcacattgcatgatgaacttggggtatagaatatgaaatatttaaaattgctttatttcatgatgtttcagatgtagtaggaacttgttgcatagatggtgtaaaaacaatctagtaataaaatcttaggtatttaatacaaggtgaagaaagatgcaatgcataaatcatgccattttaggcttaattttcataaggctatgcctgtctttataagactatataccaggagttctcaagctttttggtcttggaacccttttatactcttaaatcgttgaaaaccacaaagaccatttatttaagttataaccattgatatttgttgtattagaaattaaatagacattaaaaatatttactatttaaaaataaccaaaaagatgggcatggtggcccacacctgtaatctcaacactatgcgaggccgaggcgggtggatcacttgaggtcaggagttcgagaccagccaacatggtgaaaccctgtctctactaaaatacaaaaattagccaggtgtggtggtgggcgcctgtaatcccagctactcaggaggctgaggcacgagaatcacttgaacccagggagatggaggttgccgtgagccgagattgcgccactggactctagcctgggcaacagagtgagactctgtctcaaaaaaataaaaaaaataaaaataaaaataacagtaagttcattgcatattaacataaataacatatttgtattaaaaataactattttccaaaacaatcaaaaaagcagtaccactcttctattttaaattttttcaaatctcccttttctaaaaaaaaaaaaaaaatattgtgtaagtttaaggggtacaagtgcaattttgttgcacggatatattgcttagtggtgaagtctgagaatttagtgtatcttcacccaaataacatacgttgcacccattaaataatttttcaacacccacccccttctcactctcttgagtctcctttgtctatcattccacactctgttcctatgtacacattatttagtacccacttaaagtgagaacatgtggtatttgactttctgagttttttcaactctggcttaatagaagacagctgaaatctcagaatgcttcttcatccagtctgttgtgaatatgttgctttgattcaagtatctaaggaaaatacagttttacacagatgtgcagctgaaaaggaaacatcttttaatatgttcagataattgtggatattgtcctttgatactatagcaaaacttatcaagtgctaatttcttaaaggctggttataatttgaaatctgaaaacatatctatttaattgtagtttgctatttgaaaatttattggtctgtcttgtactttgaatggatattttgcccacgtatgattttataacatcctgtattggccttttggaaaatttggtttactattatacagtttctaaatgttgataatttttattataatatattttaaaaagtctaatgtcactgccagtctcatcagaaaattctttgagattagaaagctgttaagatcatcatcacacttacaagttttacaaaattttaattttactcaaaactttatattttatcattgacaaagctctcagttgctttgcttagtgactgactcactttgttcattttccagaaagtgtttaccaaatgctgctgcctcaataccagagtctgtattgtcagttgatctttcaagtaaaaagtggtgttctatgaaaaacagctagttcagctgcgactgaaatgatataagtgtttctcctggagcaaaccaccacttcgatttgtagcagaaatgctgtatgtatactttccattgttattactcataacatttttaaaaatatactcaagggtggagatttttttaaaaataagtgttattgcttcatcaagaacagttaaatgaaactggattttttaaactgagtttgagttaatgaagaatgcagcaattattagtaaaatttggtgctccaccttgattcatactgacactccaggagttttacccactatttcttttgtacctttagtgcaaatgttaatatggtaggaatggtaaatgacatctttagtattattataaaaatcgtttttaccctgtatactctttgagactacacattgagaattgctgatgaaggtgttttaatttatcataagcactgaaaagatttacttaattcaccaatttctcctgaatatttgtttatataaaacaagactatgtgtatacacctacctttttattaatggtagagatctaggaaaattaatttctaagaactagccaggatatttggaatgtgaataaatcatatatccagaaaaaagctttagaagattgtctatgattgaaagtcaaacagctctcatttctattatactgttctttttcaaagaatttaccaattttatgtggtatttatgattaaacatacaccatgtaatttaacatttttaatgtcacttttacatcataggtattaaagattagcatttttattgtctgtattttaaagctcaaagaataacatttaggctgggtgcggtggctcacacctgtaatcccaacactttgggaggccgaggcaggcggatcacgaggtcaggagattgagaccgtcctggctaacacagtgaaacaccgtctctactaaaaatacaaaaattagccgggcatggtggcgagcgcctgtggtcctagctacttgggaggctgaagcaagagaatggtgtgaacctgggaggcggagcttgcagtgagccaagatcgcaccactgcacttcagcctgggtgacagagtgagactctgtcttaaaaaaaaaaaaaaaaaaaaaaaaatttagatttttgactgtttcattgattcatcttagacttcacatgaaaatatctgtatatcctcaaatgcttacattcttaagaagtatctcagccatttacacatgatagaaacaactaaatggaaaaaaattgcagttggaaattcactattttttatttgatccgataacaatgtgacatttgcgattggactgtaattttctgtctttctctctgaaaataagttcaaaaatttccctctaattcttttactagataagaagcctacttcgttgtaactcttgatatatgtatgtatttaggaacttaagcttttctgctaataaatgttatgtcataattcttgaggatagtattatattgtgatgggttttcagtaaactacaggagcagccctatttgtttaaaccctagtttaacctgattattaacaattaaattgtgttttcttctaacaattaaagtgtgtttaaatttattggtcccttgcttcacagatttatctcagtatgtggtgtattcaaacagaattttgtatttttaattaggggattagataaccaattctgaagagccaaaaaaattgttagacatcacattgcttaaccatctaatataccataagtgtgtgtatacactatgttgtgggagccatctatcaggcaggcctgtttttcaggcagtattttaaaaagtggacatgtgcagaaactgtgagcacaattagcgccaagcagataaatccagctctaatcctgtttacggtctacatcagacagatgtgccaagattgatttagacaagcccgaggcttacagtaatatttttaaaagtgccattcgctgttctatttttgttaaacctttgctaaatattcttaagtcttgttggttttgctcttcttattaaccaccgtaagtaacctactttaagcaggtcccgctttgctctcatggtgacaaggtaacctgccaggagaggttatctttattccctgtaattaagttgacttttccccccaaaaaaatacaacaataggaagtgggtgctgaattaaataaatagcatgatacccagtagatgtatacttaagttccttgcaagaacagatggtccccagtatctctgtaagtaatgtgagaggacagttaatgttctgaaacaactagctataaccagtatgatactaatgaaccagtagatttcaaataataaaccacatgccgccaagcaaaattatatgtcattcataaggatttaattatcataacttgcaaaaaagtgtcaatagatgatttctatatttttatctactgatatcaaatatcaatttatgaatagagtttcacttcatattttttaccaataaaggtatgttttaacattaaggtagaattaaagttatatttaaaatacatgccccaaagtatgtggtgatttttttttaactcctcttttactatactgtctgtatgtattgggctgtatatggaaatgtagcttttacatacaattaggaaaacaattgcttttatttctagcagaaacttgtactataacagaagtggctagcatgggaatcagagtagttatcttgtagatgacaactgaagcagacataaaagatgtaatattttttcagcactcaaaaatttataagtaaaattttataaacaaaaagcagtatttttgtgattcatatggaaaataaaatgagtctgagtcattcttaaggtgataccgtaaaggtgtatagataagaagtccatttttaaatatacccaagacaacagttttttctctcagtatggtttgttttcccttttttctctttaattatgtttcccataagtatttgtatattctaagaatgtccaaaaaataaatgttttgcagtgggggttgaaaagaaagaaagacctttttagatttcagctgatcttatcagatgatctctagaaccttgaaccttcaaccttcactgaagttagctggagggcttttcacctggaaacctgagaaacctcagaagccttctgctttagctctctctcaagtctaggaagccagtggcctgcgaccccacagagccagctggtccactcctcatataagaacttcggtaacaatacaaagacatagcaaagcaccatctaatctgataactcattaaacaatatttagatggctcaagactttaaataaaaacattttaagcttgtttatagaatactaacaagttttattcccaaagactatattcagagtgagaaaacaattttccttaaaactaatattatatacatgttcatatatgttaggaactagttatatgcaaaatcaagtgactcttgtgattagaactggtcacatttattcatgtagcataaatggttaatattgccaaaatgagtaatagatcagattttctatgtgagatattgacacctgagagatttacagtgtttcactgttgtgaaaaatggagtgctgaagaacatttgtctattgttatacatttgtaaaagaattcacaaattactaatttcaaataagaactaaatatttcttctaagcctatagtttttctttttaatttcttctaagcctacagtttttctttttaatttcttcttgtaacattggcaaaaagaccattcgtgtgaaaacctcagattttgatctgtacacaaatgcaggagtagagattggaagcttgagctggaaaagcaggaaatactgctcagagccttacaaggattttcagaattttcactgttgggtcctcctggttgctgcagtctaacctcgcatctccttgaaggcagccccagtttctgatgaaatactcttcagttaatttatacatatgctgtcttgctgttttcctaaggactgcaggcagaactgtggttcacctactgttttaaatttggctagatttaaaaacagatgatctcacttatatgtggaatccaaaaaagtcaaacttatagaagcagagagtacaattgcggttgtcaagagctgggggaggggaagcaaggggatgatggttaaaggtataaaatttcagttagacagaatgaataagttctggatctattgtatagcattgtgactatggctaataatgtatacttgaaaattgctaatacctgaaaatcactaagagactacgtcttaaatgttcttacaacacaccaaaaaaaggtgtgaggtaatgaatatgttacttagcttgattttaatcatttcacattgtaaacgtgtatggtactgatcttgtacctcatttcattttccatatgaatcagaaaaatactgctttttctttataatatcttatacagcatagatacaatttttagtggtcaattatattgtaatatatacataaatatatatgattttcattggtcaattatactgtaataaaacagcaaaaaataaagttgtaattaaaaaataatttggaagaaaaaattagcaagtggttggagattgaggaagatgggaccaataagtcctccaaggagagtcatacattagttttttttaaaagtccattattaatcttataatatttaatatgtttaatttcttgacacttattaatccaattaagtatgagaacactgtggataaatctaaaaaccttaaagttgagtaaaataaaccagatacaaagaagcacatactttatggttacatttatatgaagttctagaaaaggcaaaacttagctatagtaaaaaaatcatggtcctgagggaataactagagagtggtatgagggagctttctataatagtgggaaaattctgtatctttattgggatagtggttatgtgagtgcatatacttaaaaaaactcatggaattatgcccttacaaatctgtaatttttgttggtaatttataccttaataaaaaacaaaacagatgacagggttagtgattgtttccttgaagaaggtctttacatgggtctgttgttaacgagttgtagtaaaaatcatccaaaatgcttggattcaaatcttagatctgttcctaccagatgtgtgaccacagacaagttacttacattccgtcttcagtttcttctcttttaggaaaaagcatctagtttttgttgtagagattaaattagataatacaaatgaagtacagagaacagcgtttggtgtgtaacacatgttcattattagctacccttattttttagagaatggaaatttttaaatttaaactaatcaaactattttaggataagcaagtgaaacaatctttttttcaatcgatcacagaaatattttcactgaagacaaattagacatttatataagcaaactacagtgtcattaccattcaaattttcatatgcatattcatgcttacatgcatatgaaagcattacacatatgtattctataaatatatacaaaacagtaatggaaatgtgctgtactattttgaacatctttctagtcagcccggcattttatttacttttgagacagggtctcactctgttgcccaggcttgagtgcagtagtgtgatctcagctcactggaggctggaggtcctgggctaaaggaatcctcctacctcagcctcctgagtagctgggaccacaggaaagcaccaccatgcccagcttatttggtttattttgtttgtttgtttattttttatttttttgtagagatgaggtctcactatgttgcccaggctggtctcaaactcctgggctcaagttatcctcctgcctcagcctcccaaaacactgcaatcacaggcattagccactacactgacctctacattttaatagctgagtagccttctgttatatgaatatacttttttttaacaaaaccaatactccattattgtacatttaggttgtttccaagtttcactcaaataatgcttgggtaagtaagtatttttatttattattattatttttttgagatggagtttcactctgttgcccaggctgaagtgcaatggtgtgatcttggctcactgcaacctccgcctcctgggttcaagcgattctcctgcctccacctcctgagtagctggggttacaggtgcacaccatcatgcctggctcatttttgtatttttagtagagatgggatttcagcatgttggtcaggctggtctcaaactcctgaccctgtgatccgcccacctcagcctcccaaagtgctgggattacaggccgtgagccaccacgtctggcctggataagtattattttagctaaattgtgcatatttattcccttagagtaaattcctggaagtaaattgctggatcaaaaccaggtatattttaaagaattttccttttctacattaaaaataattataattctgattacaagaaaggaaaattatggagcttcataagaaaaaattagtctcatatttcatacctcatattgcatatttaataggtaaccagtgttaaatttgttgtgtgttttccactgggatttctttttatctcctttaataaaagcaggatcagatccctcagattactttgtaacttgcttttattctactttttcatacctcttagcatgaatgtctttccagaccagaatacagagatttcacttactcatttatgagctgcagaagatgactatgatttattcaaccattctcctattgaagagcatgaatattgcttcagatacttttgttattataaatattagtgcaattaacattttaaagtcttttgatacatattcccaacttgttctccagcaattaccatttttgcattcccaccagcactggggctacttccctttagttgcaccatcatttagcattatttttgatcttgtgccaatctaaaaggcaaaaagtggtatcttgttgttttaatttgcatttctttgattactaattagattgaactttttcatttgttcattggtcaatttgcatttcttcttttgtgaaatgcctgcttgggtcttttatgtactttaccattaaagtgtttttcttgattaaatagattatgtaactgtcatatgttgcaaatatttctgtccatttggcctttgcttatgactttttatgagtctttaggacttttgaggtctttattaggtattcaataattttaatgttaaatatattgatgtctgtcttcctttgtgtcttacggcttttctatttaaggttacgtaaatttctaatatacaaatattggtgtatattatgaaatagggccctatttttctttacaaaagattagtcagttctaaatcatcctttgctatttctagcggcgcttagatgccaccattatcacatcagtgaatttttaaatgtgtaattgtttcctgatctattcatttctctattcctagatacttctattgtaatagctttaccaaatatatctgatagggtgtgtactccccctcattacttcatttatttatttatttatttagagacagagtttcagtcacccaggctggagtgcagtggcatgaacttggctcactgcaacctccgcctcctgggttcaagggattctcctgcctcaacctcttgagtagctgggattacaggtgtgtgccactacacctggcaaatttttttttttttttttttttttagtagagacagggtttcaccatggtggccaggctggtctcgaacttctgatctcaggtgatctgcccttctcggcctcccaaagtgctgggattacaggtgtgagccactgtgcctggccccctcattgcttttaaaacattttcttactgtaatatatttattccaagagaattttcaaatattttatgagattccttgtccattccttacatcaaaaaataccacggagattttgattgaagttctattataagtagttacttggggtggggggaggggggagggatagcattgggagatatacctaatgctagatgacgagttagtgggtgcagcacaccagcgtggcacatgtatacatatgtaactcagctgcacaatgtgcacatgtaccctgaaacttaaagtataataataaaagaaaataaagagaatactggcatggaaaatatgtaatcttggaacttgttgtatctccacttattcaatcctttgtctctcagtagattttgaatggctctttatcccacacgagtctagaatcattttgctaagtttattcctagatataatatgctaattgatatgggaattttttttatctccattataccttcttcttgggtgtagacatatttgtagccagcttcctcactgcatattttttattaggcctaatggcattaagtttattattttggattttacaaaaaaaattatgataacatctttaaatagttagtttcaactcctcctttccccttaaatccatcaattactgtcttttatttcactttccttatgtactgactagaatgcctagaataattgaatgctatgagtaataataggtattcttgccctgtttttggaaatccttctggatttcagtaagtgtgatgttggcttttggtttagtatctttaaatttgcaatttacaagatattttacattggaatagtcattgagttgttaagtaaagcacaaacatgttaaattcagactgaagtacaggacttcaatgaaaagttaaaagagtttatttcatcactttcattttttctttccctcagtggctgtttgtcccctccccccaccccgctccatcccccagcttccttcctttgtgctcttattgttctaggtttgactacataaaaagagactctcaatttatatgtgatacaagaccataactaatattataaaattagtctagaagaagttatttgcaacctatataataagggactaatttcaagattatttgaaggactttaaagattggtaagaaaaaaatagacaaccgtttagaataaggcaaagcatgtgtagaggcaactcttaaaaaaaaaaaagtgagctgggtgtgatgatgcacacctgtggtcccagttactagggaggctgaggcaggaggatcacttgagcccaggagttcagggctgtagtgcaccacagtcacacctgtgaataaccactccattctagactgggcaaacataagaagactctgtgtcttaaagaaaaagaaatgaaaagatattcagtttcattaattgtttgactagctgatttttggaaaatacccacaaatataaccaagcctacaagttattttaaggtgggtaagagatacatcttatctatatgcattcacctatgtgaagcggacacccagtaacacccccgtgtggaagacaagcttccttaaacttcacaggacagtatttcccatgtagtccatcatagggtgaggatttttcaggacctttggtaagcctgcttgctttcattcttgagggtagaggaagggtgcaagacttccctggtctctcccaagcattttggggaccctggccataagcctacttgctcaacaggtgcaaatgactggtaatatgctgaccagatgcaagtgtaccaccaatgatttgctgtgactgagtttggtttcctttgcatatactatccagctttttgtttctaatatattcttccttaagggaaccaggacttcttggggaatccagatgagcttgaaacactgtttttataagagaagggctgttttcaaaaacatctatagttcgtaacaaaggagttagattgaagggactctcactgttcagtctgtgacaagcatgagtgttaaaatggagacaagaattttagttaattgtaatgttgaatttgtaaaaggctataacttcataatatgatcaaggggaacaagcaatctaaaatgtgttaaagtagcattttcaaagtgcggtccagggactctcagggttggtgaggtcacaactgtttttataatattgctaagaatgtatatcactctccttctctccaaggatacggtggagttttccagaagctatgggatatgtggcgatagccttgccctaatggagtgtgtgctttgtgctttgcatttttgtcctttaaaaatgcttggttttaattttgaatacaataattatagatagatataacctacataaaccaaagttatttgcggccctcagtctttaagggtgcacagtggggcctgagactaaagagtttgggaattgatgttctagagaaaagtcagtcttactgatgagggttaatcaattagtatttactgaccgggacaggacaaaccattcattttataaagacacacagagcatttcactaaaatacttttactctgattaagtggtgattttagtaatagtaatgattgtttgattttctgatacctgaaggaaaaagagcctgttgaattgatactttgagggtgttgagttttaggtcactgggtgactgtagaaatggaccaggagaagaactgaaacttgagccttctaagaaatagaagaccaaaaaatgtttagtgttaccctatcccatgaccacaataattgagaaaaaggcctttccgttccctcttccctaccctcccccttctcccctaccctctcctcccccctcccctccccctcctctcccctaccctctcctcccccctcccctccccctcgtctcccctaccctctcctctcccctaccctcccctccccctcctctcccctcccctctcctcccccctcccctccccctcctctcccctcccctccccctcctctcccctcccctccccctcctctccctccccctcttctccctccccctcctctccctaacccctcccaacctttcccctccttctctgtccccctccccctccctccctgtcttcctcccaccccccactccctgtcttcctccttgtcttccatcctcccttccttcctttccttcctgtctttcttttcctttctttcctttttcttctttccttcctgtcttccctcctctccgtctgtctccttctccttgtccccttctctctgtcttgcctttcctttccttctgtctttttctttctttctctttctttttcactcttcctttttttaatttcccttttacttgccttctctctttcattccttccatgctttcttttttttagtggtatgtatactttgtgagcaatcagactatagcttgcagaatagttgggagaggccaaaaatgcccctgagaatgcaagcaaggaacttcttagtgagcatatgaacatcctcactccaatcggaggataacattgttcatacttcaaggactaaaaagctgagagagggtctctgctttctgttacttttagcactcgagtcatttctgcatgtatttctactgattactttttctcctattttggttcatatgttttctgcttctttgcttgtctagtgattttggattagatgagtgacattgtgaattttactgtgcaggatggctgaattttttttctattcctgtaaatatttttttggcattgttctaggatgtagttaagttacctggaaaaagtgacatccttttgagaggcttgcttttaagttttgttaggtggaatcacagcagtctttagccagctcactaaggaccaatactcttctaaatacttaccataatgtcatatgaatttccatgtttttccacttcagctggtaggaacacctgtgtcatctctaagcattgtactgttaattcttctagtagttcttatctggctttgtacatctgctgatcaatactttcagctaaagtctcaaggggacctctgcaaatctacagtgttcactgttcagctttctcttctgtagtaaattgcacagtgaactctagtccccttagccttcctgaacccccagttctccttaactcagggagatcaccaggccccaccaggattcctgtatctgccctgtgacctggagattctctgcaggcaataggttggggcggtcgtagggtccactttgttttcctcctcttcggcttcactgtcctgtgttacctgatgtccaatgtctgaaaactactgtttcacgtatcttgtgtgcttttgtagttttaggtgaaaggtaaaactagtttcttattattccacattggccaaagcagaagttttggaagtctttttttaaggtctaaaacacttctactttgagagtcaattgaaatggtcttttccacaataattattttctgacctatggtttaaagataagtcatgaaaattttatgccactatttttttttaagtctgattatggttaaattcagggggctatttcctcctagattgacagagtttataatgtttcctactcacaataattgtacttctgcttcctctttgcatgtgttactttaatgggaatgtatatttccttttcgttaaggctgccttcaacaatttgtcataaagtcacttctgttagtgaattctattttttctgttactttactctatccttagtaccaaagagctccttatgtgacaccaatttattactaaaatgtcgctttgtttatgttcttggaattcttcatacattgactatcctcagatgtcgaatgttgtaggcctgtgtggcagggactctcttccatttattctatttttaatctaattcttgacaaaataaacccaatttttcttttcttcccctttccatctcacgtagggactggcataaagggcaatccataaaattacaaatgatgaatttttttggttttaactattattcatacatttaagatatggtcacaatttttatttcttactagtaattcattttattttttaacttttaggttctggggtacacgtgcaggtttgttatataggtacatttgtgtcatgggggtttgttgtacagattatttcatcacccaggtattaagcccagtacccattagttatttttcttgatcctctccctttgctcactttctaccctctggtaagccccagtgtctgttgttcctttctatgaaacacaatggttttaattggaaaatttatttttttttcaggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggtaagtactcctcatgggaaattttaatcagcccagtttccttgatatacatgattaatctagacatgttttgagtaaaaacaactttagtgatgttgagatagtttccttctgttcctagtttttgtcgtgagaaagtgttgaaatttgctaaatactttttctacattaattgagataatcatatttttccctacatcctgttaatgtggtatcttatattaattgattttcatatgtttaacatccttgcattccaggaataactccccaatggccatggtgtataatcttttaaagatgctattgaatttggtttgttaatattttgttgagtatgtttgcatcaatattcataaaacatattgttctgtagtttttctgtactgtttgtctgactttggcatcagggtaatactggcctcatagaatgagttaggaagtaactcttgaatgactattttcatgaagaagcttcaataatctgaaataaaatacttaaataatttagttcacctgagagttgtttttagaagcgtatttatttttctattaatgtcttttttgaactatataagaatgtattctccttccactcacacattgatggcaagtgtgtatttgtactctgtggcctgaaaataagatttttttgaataatcttaagaggccatgctttatactctggtaattgagaattacctatttcacagtagctttttctaaaggttaatttccagagaaaagagaacatgtttattaggatatatctcttaatgaattcagtgtatctgaaatttctaaatgacattttcatattttgcatactaaataaaattcataagtacaaatataatgcaattcataagtacaaatataatgcaatttggatttctagaagttatctagttaaaatatgatcttaggatttattttttttgtcttagatttatgaatcttgcttgtttttctgttaattcatttcttcttgtttgctgcatcagtcagatcagagtagaggcagcttgtatagttgatggcacagtttagggttagatggcacaggatagaaatgggtgctagacaaagagcagtcacagaggcatgttagaaatttccagttccagcatcattgatgaagaaaaccatgaggacccaagttgatcaaaggcagccagccaataaagctatgctcatgcgagatgagctgaagtgacattacattaaaattggaagaccctcttactaagtggctccatgcttccctgctagcccctttgggacttccaagaagacttggttatttcaagaagacaagaacccacagaggctgtagtttagtttatctctctggaaacatagagaatatgtataattaaataaaagcactttaatagtgaatcctttacagtgttatttgaaatttatgtcaagtgatttaaaaagtaaaaatgaaaattaataatttcagtggaagtaaattgattaacatgaccaggaatacataaaacttgcatggtcttgtctataaaataaggatatgtcatttaattaggagagtcaaagctcattcttgcgcttaaggtctgaggaactcttctcccatggggcttatgaagggctacactgaggcaacttcctcaatatatctcagccataaaaccaagagaaagtaagaagcagaggacatcacaacaaagctcaattcagtaaaagcaattttataggagtagagggacttgtcaaaaacaaaaacaacaacaaaaaacaatgtccaaatatttattcagcttaatgagtgatgtttttgtttgatctagggttaaaatctagacaaattacagagatgaataaactacatatcctttagtctaccatcctctgaaaatgttactttttgaaactttgattttgataagagctggaggcactcagggagtcattctctggcatggtctttgagtacagagtgattttgctgattaaaagcaaatagattgacttttaaaatcaactcatacaaacaaactgttaaaatcctctaatgagagtgaagaaacctaaccaagactgactgatacattactgctccatctctgcaccaaagtggactcagggaggcctgtaggagatgccaactccttatcctactccccacaaagacagttcttggctatcttcatcagacacaaatgaatggttgaggctccaaagctctctaccaattcttgtgttacactggcacttttaaaaaattttgtttattttttatttttaaatggagtctcactctgtcaccctggctggagtacagtggcgtgatcttggctcactgcaccctttgcctcccgggtttgagcaattctccctgcctcagcctcccgagtagctgggattacaggcacccgccactacgcctggctaatttttgtattacttagtagagatggggtttcgccatgttggccaggctggtcttgaactcctgagctcaggcaatctgcccaccttggcctcccaaagtgctgggattacaggtgttagccaccgcacctggctggcacttctcttaaaactaatatctcaagaagttttttctttaagaatcttctttcaattgcaggtccatgtagttctggtattcattaaagtgcctatcccaggggttttggtatgttgtgtttcaattttcatgtttcaatttttttgatttatgcattaattttgttttttcagaattcaggtgcaggttgtttagtttccatgtatttgtgtcgttttgagaattcctcttgttcttcatttctaattttatttcattgtgacctcagaagacacttgcattgattttgattttttttatcttattgagatgtgacttacgactatgtggtcaattttagagaatgttccatgtacagatgtgaaaaatgtatattttgtgttgttgggtggaatattctgcagatgtctgtcaggtccatttggtcaagagtctgatttaagtccagtgtatacctttgttagttttctgccatggtgatctgtctggtgctgtgagtggggtgttgaagtcccccactattattgtatagctttttttccccataggtctagtagtatttgttttatgaacctgggtgctccaacattgagtgcatatttatttaggatagttaaatcttctggttgaattgaaccctttatataatgccctcctttgtctctttttgatgttgttggtttaatgtctgtttcttctcatacaagtatagcaacatctgttcttttttaattttctatttgcatgctagatctttctccatcccttcactttgagcccatggttgtcattacatgtgagatgggtctcttgaattcagcagaaggttaggtcatttaaaaaatctaatttgccactttatgtcctttaagtggagcatttaggccatttatgttctaagttaatattgatatttgaggttttgttcctatacatttgatatttgtgtattgttaagtagttgctttctagtttgaattgtgtaattgctctataagatctctgagccttgtacttttgtgtgcttatatggtagcaagtattgttcttttgtttccatgtttagaactccttggagtatttcttgtatggcaggtgtggtggtaacaaattcccttagtgttttcttgcctgggaaagactttatttctccttcatttatgaagcttaatttggcagattatgaaattcttggctggcattttcttttttctttaaggaggctaaaagtaggcccctgatctcttcttgcttgtaaggtttctgctgagaagtcctctattagtctgattggatttcctttataggtaatttggcccttttctctagatgcctttcatattttttctttggtgttgaccttgcatagtctgatggactatattccttggggatggtcatcttgtatcttgcaggtgttttctgaatttcttgtatctggatgttaacctctctggcaagattagggaaattttcctgaattattgcctcaaatatgttttccaatttgcttacttcttcctcttctccatcaagaatgccagtaagtcataggtttggttgctttacataatcccatatttatcaaaggctttgttcatttttcagattctttatgtttgtctaactgggttaatttgaaaaggtggtcttcaagctctgaaatcttgtcttctgcttggtgtagtctgttgttaaaacttccaagtgttgttttgttttgttttgttttgttttgagatggagtctcactctgttgcctaggctggagtgcagtggcatgatcttgactcactgcaacctctgcctcctgggttcaagcgattctcctgcctcaccttctggagtagctgggattacgggcgagtgccaccacccccgactaatttttgtattttttagtagagacaaggttttgccatgttggctgagctggtctcgaactcctgaactcaggtgatttacccatcttggcctcccaaagtgctgtgattacaggtgtgagccaccatgcctggcctgcttccaagtgtattttgatgttccctttagtgaatttttcaattccaaaagttctatttggttttatcttaatatggctatctcatgtttcatatcctgcattgtgtttctggtttatttgaaatggattttaaatttctcttggctctcactgagtttccttgcaatacatattttgtttttttagtctgtcatttcaaagttttcaacttggttaggatccattgctatagagctagtgcaattctttggaggtatgaagacactctttttgtagtgttggagttcttgggcagattccttcttatctgagggagctgttgattcttatttttgaatttcctattggttgggcgggacttaaactttttttttttttccccttgagggtatgactatggtgtatgttgtgtgtgatcattcaactttgtttctgggtgctttcagggggccaaggctctttatggattccttgggcgtggtagctttcttaaatgctgcttattgtagcaatgtattggatttgtgagctgacactctatctcatgtggggctgagggtgcagaagtctcaggaagcttattttgtggagtagtgctaagcctttctggtagtgggctttttatttgatagtacagttcaggctgcaatccagtagatggcacttaaaaaataagaaccagcttgccctcagttaggctgatgtccagtagaagcacctgtcctgacaggggagtgacaggaagagattctgttggtgtgtgccgaggcctttggggtcgctggttggggggagatagggggaggtgcactagctcctcatgcaggaatgtgatctgcttttctatcataccccatcagagggctcatgaccttcagttcataaagattttttccttgggttcccagccatagtctgtctgtaggttatgcatatgcccctctgaaggcaaccaccaaaatggtcttggggcagagcctcttcccccagtctagggcagacaactccatgacttgtatgtcctccattgctgggacactgctgctctgtgtagggatggggagttgggccccaccctttatgtaagcctaagtggcattctcactttcagcaggggtggagccatcttgaaaaccatgaaaaactctttcttcgagtacctgtgctggcccccagtgggaagaaccactgctgcgtcttcaacagcgtgtggggtgggagggtattgccacagatgaccccctctccatatccgttccttgacatggtgttgccccctttagcgattggcactgtgcccacctttcctttgtcccaaaggggttttggcaagttgtgtccctctcccttataggtggcctacactaggggggttagatctctagaggttccatagctccctgggaacttgctggccccctgggcttttcaaagtcagaacaggttatgaggtatgtttgctggggatctggtgctacagagactcaagggtagagaatccctgggcagagcagaggcccaccactggtgcacaagcaatatggtgaccaccatctcagtttgtgtctgaggggagtatgggaacccctgcaggagctggccacccagttctctatccctgggaaattcctaaattaccaccaataacattgccctgggtcacaagggtggggccttgaattctttgggggttgatctctgccagactctagctacttttcctttctgcaccccagcttcttcccatgggcactccaaaaggtcctggctctctttccccagttttccattagaaacttgtccatttgacagtaactttgatcttctttctaagaagagctggcatccaaggtctgtggtcagctatgttggaaaaaagaaggagaaaaaaactagtttgtattaaattctgaaagactagtggcactggttaagtctttaaaggattgttaacaaaagaaaatctttttaaaccaaactcctaattttatcagaattgtaactgaaaatataaatgtatgaaaacataggtattatgtaaaatttgctcaataaaagaataggaaaaactactatttatcttggactgatagcatgttagtttgagatttgaaccctttctactctagtaagtagtggtgggaaaaattcactgtaggagtctgcagacataacaaactatcattagactgccaagacctccacataataaagcaagcagagaatgtcaaataagtatgtgaaaaatgatcaaaaaagagaaattgaaaatataaatagggtgctattaaaaaaggatagcatttatgttatgacatatgtacacatgaatatcactttttagaatttcatccttcttaggacttattcctgagtccgaggattgagaggttctgataaaataagtctcagtgggttccaggcatgggctttctttaaaagtctctccagggattctaatgtgttgccaggaccaagtaccatggacagccaagatctcatcagcacagtttgattgaatgaacttatgtagaaccctgaatgccacacttaaccaaagaaacctttccagggattaattataggtgacagaacatgctatattcttattaaatattattaaaagttaagcaatacccattcctgattcatgtaaaattctcacttattttccaagagttttactgtatgactggtttatgggatgcttggaaaaggttgacagacatggcaaaggttcctgcagtgtttctctttgtccatcaacagccctagctcataacctctaccctttcagctaaaagcaattagctcttcagaagtgattcattctatttatacttgggataagtaacatcaggcagtcttccctagggcttctcacgggccctggtggcatttttattctaagagagggttatatttttacatgtaattggtcataattatactaaaaacaagtaattggtgtcttatacaagaaaattatatttctgctttagtcattgacagagtatcctgagaataagagttaagaagtatattcattgtcatcttatttctgatatatttcaaattcttttgctaggaagaagcccttttgactgtgctttgtgtaacaaaacttcttcggagaaacaatttagataaactttgtcagatcttatgtgattatattcaaaatgctaattgaagattctctaaacattttcagtaaaatgttgaattgttttcatgctgttaaataagttaacatgtcttcctttactaaagtcattattataaaaatgtaaatcctaatgataatagctgatgtttattaagcatttagtaggttccattttttgatagcaacttttatgaattatctcattaaatcttcataataatagcatcaagaactacaaatatgttttcatgtaagaagggaaataaaattatgagttttgctgtgaggtttgaagaatgaaaacaatgcatgacttagaaaatagtataattaagtgaattttattatcattatcatctcttagtttataaatgaaaaaactaaggcttacataatgtaaaaatcagttaacaaggttaaacaaccggtagatggtagaggaggagctgggaataaatctgtacatgtctgaatctggagcaggaacccttaactgatgtgtcattctagcaggtcatcagttactctacaatacctattaagtatactttatttactgtgtttagatttatagtagatttagactctactgtaaaaacaaggacttcatacacctgctagaaagtatccatatcatcttgtttgaaagttgtcccgctctagtgttcttttctaatcatgatgattcagaactccaaactcttgaagcagggcaacccgtagggtcagcattcataatttctcaatacttaaaaaagtttcctcatgactgttgctattattgagatttctcaaatgtcttggcctgaattgggtgtgcactatgaaaaaaaaaatggcagacatttctttttgttaaaggaattttaaaaacacatataaacacactgatttgtgacagattaccaggctttatgtttagcagggtttcctaagcaaaacacaaattctgtaaatctacagaattagataaaacattgactcaatccttagatgagagtataatggattatcacttaataacttctgtcactgaaaataaatgatgtaaaaagtaataaagttctactctcacagtatgaataaataggaaatacataatactttaaattaggcaacaaatcattaagcccccagcattcattagactatcattaatgataataaaattgtgtggtatttatacagatattatatgtaactccaggaattttgttataattgtgtatgaatatatttgttgtttgaggcaggtagatggatatttgcagcagctatgtgctgaagcattctggtaatagttttcaaatcaaccatttttttctccttgtcgatcatctttaaagcaaaagcaccgttttttactatattttttgaaaaaaatacattaggtgtaaaattatatattttgaagaagttcactttctgtttttactagtttcacacctttgttattttttcagtggaaggagcagagataggcaaaggcgaagcctgtgtgtgtggtcaggttcctgggcccttcatagcatctgatgccaagctgtgttctcttttgtgtcattgccttcccacttgctaattacgtgacagagctagggacttccctctgtctagaatgccccccatctcttgtttgcctagtgaaatctggtttgaagttcaaggtctgatacaaaccaggtgatcctctgcaaaactaactgtacctgagcaaaccaggcacttactcttttatatgttcctggcactgctgatactctgatagaaaacatcatcacttaatgctaactgtgggctcacaaaggggatacttctactgtaagaagactgtaactcttcttagcacagagattagtaagtacttgaaacagagtttcacatataataagtgttcaataaattttattttttatttctaacacttggcacactgcatagctcagtaaatgttggtgaagtgaactgagtattctccttatctattatgtggtaggcattattctagttgcttctgttataaaccaactcatttaatccttatcacagcacttttattgtggtcaatattttttaatcctcacagatggctaaggaatcagcactctgagagattggttgacttgctttgggtaaggtgcttataaagtggtagaacaagattcctatccaggccttctgattcaaaaatacattctttttttttttttttttagtagtgttttctggaaaggcagggtataactgactatgctgtgtatttgggactaagtatattattgtcaagtatattaaaaatgtcgcaacactggaaaggagtccatcaatgggctatgcaggttgagggatttgtagatgagaaactgataaatttggttagcaaggaaagccatcaagctgtgaaccctttatattggcaaaagagagggtcctttgaaatctaagggaacagaactttcctgttctccaagtttggagcagaataggtaagctctaggcagtctaatgcccaacttttaccagtggtgttttagttttttttttttttccaaaaggaaatgatggaattctttatatacttctgaattgtctatcttttcaaaaataaaaattttcattttgcagtacatacagaatcaaaagactttcaagtcctaactccacaaatgtttattttgaagctctttaaactgtttaccacggatattagtaaatctgtcagaaatgaggtgacttacttatccttgtcccaccagatatgtgggaaggatgatcacgctagatagcatggatgggtcctctatttatctctttttacttgaatggaaaacacatcattcagattaatcaattagtcattgtgactgatagaatttttatatggataatctgggtttggtccctagctttaccacttacttggggtctttatgtcttctatggtctcctatctgtaaagggaagttgataatgccaatctagctaggttactgagatgcttaaatgtgtaatgtatgcaaagcagcaggtactcaataaagggtaactcttactattattgtatagctctccaggtatgtattgagcttctatagaatccatagccccaaactctttagccctttgagaccaagattaagcattgtctttccagaggagagggtgagagagattgccattatactaatagaattcatcattatcaccgtcatcatcatcatcatgatttcttggtgtgtcatggaatgtactgtgtttcacattaccaacagatgttaattttcacaacatccctgagacaagaaactatgattacattttacagataaggtcatgcagctataaagttgtgaaattgggattcaaactcaggcagtctgtccccacagtccatgttcttaacccaccatgctctcctgacacttgaaaagttaggaggcgtactccatagcctgtaatgttgctgcagagagaatctaattttaaatccagtgaagcatattagttgctgtctttgatatgccattcagattgtgctatccttatgatgcctaccttggttgtatatgtaactgggcgtcaaatatataaatactcaaaaagtgataggtgccaataaaatattttatagttaatacttatgtaatctgtgttctctgtgtttgagggctggttctaaaatactgctctatatttgacttctggttaaaacaataaactttgctcatattagttatatagttgataccattctcatgttgctaacatgtctgtaagtaacagttgaaattgatctggcaattttagagctgtcagacccaggagatgagagaaacatttaaaatgtttataacattaaatcagctgagtcaagagagagaaagagaaagatgattcagatttcttgtactggtggatgtaagtgcttggaactgaaataaaggagaaggtgtagggagggagaaagataaagaagtcttccctttatacaagttgaaattgagttttctttgagatatagaggtgaagacattttaagaaacttcttaaaactctctaatgtggcttttcaacctgtttccatcaatttggcacatctcacttttcggcacaacagaatattctaggtttatctcacaccttccttgccccagcccaggaatcagccatttctctaagaaactcttgtttattttggtggggaacagtattgggaaaccaacatctgggagctaaatatactcctagtggttaggaggtcataccttgtagactcttgtagctgacggagttaggacatatttattagaaatcataagtttatattgatcttgctaggatctatccaatcctacaagattcttccctgtgtctctcctttgtatttgtgtatcctttcttccatattaagaactgtggctcccaacaacaaggcatgtgcccatttgcccaatcgtatgatgtataaaaactactttgagaaaagtggcagccaaaccactaagaaaaataaacttgctgaaatgagttcaagatttattggcagctctttttttggcccctagactgaaagtatatatttcaagtattgtgttcaaaaattatttgggttagctttttccacctttcataatagtaatattatttacttgaaatacagttggctttgtttctatattcagtttttttctctctatcttcattaatttcattatatatatttaatatgtaggacattaacatgtttccaaaagaagaaaacactccttcctgtatcatttccacctcatctctcttaccccttataggtaaccaattgcactggtttctagtttatcttacttatattcctatttgaaaagttacctcatatatgtatgttttttaaatttttatacttttttacacagaaagtaacgttcagtatgtactttgccactttccttttaaacttaacagcgtatactggaaatcactccatatcgtgtcacagagagcttccttatattttttaatagctgtataagacttcattgtgttgtctgtaccatattttattcacttccccatgtgtggacattttgactgtttctagtatctgcaattactaataatgctgcagtaaactttgtgcatatcgtaccttggtaaatttctagacatagatttctgggttaaaggttaagcacatgtgtagttttgttagatattgataaattcctttccatggggtttatatcatttttaaaatatttaccagcaacgtataacagcgtccattacttcaaagcctcaccaacagattgtatgttttaagtacttttatgttttagaatttttccaatgcgataggtaaacaatggtatatcaatatagttttaatacattaaagttcagcatcttttcaagttcggctagtctcagggctattcttaatatcttgtgaattatcttcatattattttcccatattccataatacttttggttttttttcctcctcaattctgacaagttctttatatttcaggaatattagccattttatttgatatgttacaaatatttttctcccaatatataacttttctcttataacgatttttttttcatgaaaagtttttaattaaaaccttttatgggcccaggtgcagtggctcacacctgtaattccagcactttggaaggctgaggtgggcagctcatttaaggccaggagttccagaccagcctgaccaacacagtgaaaccctgtctctactaaaaatagaagaacattagctgggcttggtggcacatgcttgtgatcccagctactcaggaggctgaggcatgagaatcacttgaacccagcaggtggaggttgcagtgagtcaagatcgtgccactgcactccagagtgggcaacagagtgagactctgtctcaaaattaaataaatatataaacaaaaccattatgggccaggtgcagtggctcattcctgtaatctcagcactatgggaggtcaaggtggttgaatcatttgcgccaaggaactggacagaccagcctgggcaacatgggaaaaacctctctctaccaaaaaagaaaaaaaaaaaaattagctgggtgtggtagcatgcaccagtagtcccagttactcgggctggtcacatgagcctggggaggtcaaggctgcagtgagcagtgattgtgccattgcactccagcctaggcaacagagtgagaccatttctctaaatacatacatacatacataccttttgtggagttaaatttacacactttttctttattggctctggcttttgcattgtagtaagactttctttacactcaacttatagataaattcacccatgttttcttctagtacttgcatagttgaattttagatctctagtccatttggagtttattttttgtatggtagaaggtattgatcctattttttcccaaatagttgttacccagttgtcccaaaacaagttattgaaaagtccatctttgtcccagatagactggaacaaaatgaattaaagacttaaatatgaagatttttacttgtgtatcctttcttcctagaaagaaaacataggcgtaaagcttcatgacgttgaatacttcatgccattggtctggcaataatattactattatgaaaggtggaaaaagctaacccaagtaacttttgaacacagtacttgaaatatatactttcagtctaggggccaaaaaaagagctgccaataaatcttgaactcatttcagcaagtttacttttcttagtggtttggctgccacttttctgaaagtagtttttatacatcatacaattgggcaaatgggcagatgccttgttgttgggagccacagttcttaatatggtagaaaggatacaccaatagaaatatttatatttaagtctggcaatcatttttaagatgtgaacttgaacaggcaacaaaagcaaaaataggtacgttggattacatcaaacccaaaagctcttcacagcaaagggaacagtcagttgagtgaagagacaacctatggaatgggagaaaatatttctaagccacacatctgacagagggttaatatccaaggtatataaagaactgcaacaactcaatagcaagaaaacaaataacatgaataaaaaatgagcaaaggatctgaatagacatttctcgaaagaagacataccaatggacaacatgaaaaaatactcagcatcactaacaatcagggaaatgcaaattaaaaccacagtgagatatcgcctcacacttgttagaatggctgttatcagaaagataaaagataagtattggtggggtgtggagaaaaaggaactctagcccactgttagtgacagtgtaaattagtatagctgtgatggaaaagagaatggaggttcctcaaacagtttaaagtagaactaccatatgatccagcaattccacgactgggaatatatccaaaggaaatcagtatattgaagagaactgtattttagtgattattgcagcattgttcccaatagccaagataagggatcaatctgagtatctatcaatggacaagtgataaagaaaatatggtgtgtatacacaatgggataccattcagcctttgaagagaaggaaatcctgtcatttgccacaacgtggttgaacctggaggacattagctgagtgtaataagccagccaccaaaagaaaaataccacatgatctttcctatatgtggaattttaaaagttgaactcaaggaagtagaatagaatggtagtgaccaggggtatgcgataggctgagggatcaaggagatgttggtcacgggatacaggatttcagttagataggaggaagaagttcaagaggtctattgtataccatggtgagtatagttaattataaagtatacttgaaaattgttaagagtagattttctgttcataccacaaaatgataagtatgtgagataatgcatatgtaaattggctcaatttagccatttcacaatgtatatatatttcaaaacaacatgatgtacatgataaatatacagtttatttttaattaaaaattttaaactctctaattggtcttcaacatatagtacacaagtcttttcacgactctttataatggaacatatgttcttggaatgctaaaaattattttttttggaggccctgcaaataactaaaaatttatcttaaaagccacacctaattacttacatatgatccagaaaggatactttgaaaaagctttttaattgataaaatcattaaggtaaaacatattcataaaagtgttctctaataattttataattttctagttcatgaaggattaaatatacaactatcatttgaattggattttttatgaggttaattgtatttaaatgctaattattttaactaattttgtggttgacttctatgtagagtagggaaaaagaatttcctaaagccagttacgtatatctctttttagtctggatttttaattaggaaaagtgatatagttaaataggtctactctatagcatcttctaaaatgagtaaaaattcattatatcaggataaaaaatgataaagatatatggatgacacatttggctgaatttttcttcttcgctgttctcttgctctctatttaaatagtcttagctcttttatcatttaaattctgaagtattgaggtgattattccggcagcaggtgattctgctaattactgttcagtcagttttagctattagaaacagagatatgtttacattgctgggctgcatgtaaatttagaagttacatggctttgtttttactttgacttacggcattaaaattattttcatctgtgtatgtaaagatctgcatctataagcttttgtggataataaggtgaaattgatgcattttaatataaattgccaatataaaatatctctaactcagacctctactggaaagttgtcaaatcttatgtaggaaaggcttttaccatcactgttacacattaactgggcatagtttaatattaatagctcctgagacttgtggttaactgaggtttctatttcctgtgtttgggttttatctttgcaacaacttggttgcttttctgtgtaaaatagtggtgaatatacacaagagtatgacaaggttctgggctcttaactttgatgaacaccatgccatttccatcatgctgcactcaaaacagcacagatgtgagtctgggagtggcgtccctgccgctctcatgagcctttgtttggagaacaccctgattaacccccacccttcacggttcattgactcactgatagatcaagtttaaactagtatatattagcacatttgttaccaacagaggaacagttggccattctgttttacattgctggttcattgcaaactggcgtgctaaaaaggtctgtactctagagtatgaattgggaagttaccaaaggactgagaaccaagtcagttgcatattaatgttgaattatacctatattttaatcttggattgtctacttgggggatgcttacactgttgtcaagttatgaataagtgataattaccactttgaaattcatctttttttttcaaggagtttaggggatttaggtgtctcaatatagctttcatattaaacagtttgtcataattggatgagagcagagcaaggtcatgactacctgatgccttgtgttggagcattttaaaaatgttttccagagagttatttgtacctaatgactttacataagtccttacattatactttatttctaggtcacctaaaaatgttaattgtttagtcaagagggttaggatgtgtgtctgttttctcatgaaaaaaattaagctgttccctttttatcaattttcttgcaatctaaaggcttttttttcttaccttcctaacctagtgactaaggtcatcttattgttacagttcctttcatgggagataggtttactgcatcatttggcagtttcatagggtgaattttgtcttggcttcatctttccttactggttgtcatcccctgggccacctgcttttttgcattttcctttctcttgtgagatgatgaagctctgtgccccgatggggatgagagacagcactctgagttcaagtctaggataaggcaatgggcttgcttttcaaaacaaactagtgtcatacgggctgctgctttcaggtccactgtctgattttatcactgatgacttgtttctggaaggcaaactgatttaagttctgagcaaaagggtcggtgtttattttcaatgctactattaatttagagttttaatttagaaaagattttttaccagttctcaaatatgatttttctattgactttaagtttgtagatataaggagtagacatgagatagagactgaattgcttttttgtttttaaaacttggcagtaataaggggttgcttgttttttcatgctaaatattttttctaagggatctagatacctatcagaaaacttaactttgataactctggttctttattaagtatttttgtcttattttaggaattaatagaaatagttgtaattttagacttcctttataaaataccaatttaaagagaagctttttgcttaaatgattgttttgcagtgttgtgcttttgttttctttaatgcagttgaaatcgcagctttataacttattttttaatttggggtttttaaaagaatattagttatttatttatatttattgggcacctactgtgtgccagacactattctaggaactagtaaacatagcagagagcagaatcatgaagttcttgacctcaaggagcttaaatcctagtggtagagggggaattcaaaaaaatcaaataaatgtatttctattatgtcaagtgatggtatgtactaccaggcaatcagatgaaaatatttcctcttctatacacagtgggcaaggaaggcttcattgactgtggagttttagaagaaagctgaaagtaatggggaaagagagccatatcgatatatgaaggaaaacatggtccaagcagaggaaacgaaaagtgcaaagaattgagcaagaaagtcatgttcaagtggagtcagcaggggaaagagtaggtcacaaatgcggctgagggtgggtcatgaagggccttacaagctttgtatgagtttttacttttattctgaaaaaaacaaaaacaaaaacaaaaaaaaccggggagctatttggggattttaatagaaaagtaacataatttccttttaaaatggatatgtggccactaagtggagagagtggtgtatatatgagtggatggaataattgatacaggcaagcaggagacaggttaaatgaaaaatggattaatccaggcaaaagatggtgacttaaattaagctgggagtgggagagatggtgagacatgcttagactttggattcatttttccagatagaactggctgacagagacatgtcatttaccaacatagacatggcagattttttttttcttttctgagacaaggtcttgctctgttgtccaggctggagtgcaatggtgtgaccatagctcatggaagcctcagactcttgatatcaagtgatcctcccacctcaacctccctagtagttgagattacaggcatatgccactgtatccagccaactttttttttttctgtagagacaatatctctctgtgttgcctagggtagcctttaactcctggcctcaagcattcctcctacctcagcctctcaaagtgctgggattataggagtgagccaccatgcctggccaatatggcggttattaagaggataagtcaaagattacatgaatattctgttatgaaaagtgtcaaacatatagaaaatataaacagtattccagtgggcacccatatttttatcaccttgattctacagatcttaacatttttctgtatctgcttcaaacattttattctgccaatgtgttctaaagtaaattgttgatattgtgatagttctctccaaaatgctgcagtgtgtagctctaaaaatagatatttttcagataaccaaatatcattaacctgccaaatcaatgaatgataattgcttattaacatttaatacttggtccatagtcaaattctccatattttccataatgtcttttatagttaacttttaccaactagtgtctgatcaagaatcattcatttaactaattacatttaaactgtaacattacaacatgttttttcgtatgttttattctctctgacattgacttatggaagagactagattatttgtcctgtagacattttatcatacataagagttactaggagagctctgattactagtccccactctcagaaattttgattcagttgctctttccagtgagctgctggtgatgctggactttcattctgaagaccatactttgagcactactgctgtaccactatccgatggcttctttgtgatatcgtttaacttgttgttctgttgcctgtatttcctctaaactgaattttcaatctaaaggcttactgagattcatgtttgatactttgggcaagaatacttcataagttctagtgcttaatgttaggtagcacttaattctgactatttcactattcatgaggctaagctaaggaggtgacagcctgatccttctattgtaatgtttcatgtgaaactactagataatttgttgagttggggggtgggtagggaagagatatctagttttcaataaatatttcacctaatggttttaacacacattgatcatccttgcctgaactaattatttaattagggatggcaacatggagactttctaattcaatctttttttttttttctaaatgaatggccttgtttttatttttaaatggatgttacttcgcaactggggttatttgattacccagaaatatagcgcatattaaaaaggtaggataaatgcttagttaactaattaagcaatttttaattaccagttttcacagtaaggcactaaagtttctgacttgagcaaagataaagtggaaagataaagtggtcgtttagtgagatgggcaagactgtggataggtagactaggtttggtgggaaagtcagaatatcagttttgaatatgttaagtttgagatgtctattagaaacatatgttgacgaggccaggtgcaatggctcatgcctgtaatctcagtactttaggaggctgaggtgggcggatcacctgaagtcaggagttcaagacgagcctggccaacatgtgaaaccctgtgtttactaaaaatacaaaaattagctgggcttggtggcatgcacctgtaatcccagtaatcccagctacttgggaggctgaggcgggagaatcacttgaacccagggggcggaggttggagtgagccaagatcccgccagccactgcacttcagcctgggtgacagagcgagactccatctcaaaaaaaaaaaacatatatatatatatatatatgttgacaatatttcagttgaataaaataaaatattctagctattttaggtagaaaggcattttataccgatactactactaaagggtaagaagatatgactgtagtacattaaatatgctgatggcctacaactgttgctgtgttgctttttcctcttcaccacacatatgcagcctcatgaaacattttccatgaccagcacactgaaggaaataaaaggaacctagtttagagatggttctgcatgatacaacaaaaatgagctgctaaagcattacaatcccactcaagagtattcccccatcaaatagtggggctggtattttaatcagttgatactaattgtcaaggtgtgatggccaagggattgatgtttatcagtgtatggacagtggttcagagtttggtgaattagtcgagttgaaagagaaagattggtgacaaagatgtatgaggtggaaagtatactttcacagaataagaacagaaaatgagatttatgtttttttgtaaacgttcaacaaagaaaattcattcagaggaggaaataggtaggcaagatgccctattctacagatgttagtcagcatcactgcaaagcaacctcagggcttatgcagtggacacttaaaatagcactggtgcagggatgggagaaataaatggatttaataagcactgctgcttaccaaggttgattgaattgccactattgccaagtgttctacctgcaaacagatcaaccttgagccctggatatggcaccatgtcccagagcaaccagccagccacctggtggcaggttgattgcattggatttgctccattatggaaggtcagtggtttgtcactgctgcgatgaatgcttactgtacgtttggatttgcattccctgcccaccatgtttctgtcagcaataacatggccttattaaagccttattcaataatatgacatcctatataatattgcttttgatcaggagactcattcacatcaaaataagtgaggcaattggctgtcaactacaggattcactggtcttaccatgttcctgttgtagcatattgtattctacctggaagatgaaaccttgtgacattaaagtagtttttagttccataaacataatacaggggtctatgaatcaagaagtggaggtagaagtgttgtcttttacttcacatctaatcacatgttcaaaatattttttcatcttgcctctgcaactttgaactttgctgacacactgaggttttagtgtgaggaaacaatactttcacatgggaacatgatagtcgttcaattgaactggacatttagaataacctggccacattactgaactgtataactgaaacaacaaatgaaaaaaatgaagatgctacgctggcaaagatgattaattttgattattgggagaaatagtattgctactgttaggaggaagactatatgtctagaaactaggaggaaacctgggttgcctccttgtagcagggtaaaatgagtgagtaccttgtctaagaaagggaacatgaccaaactgaacccagaagacataggaaatctaaacagatcaattaacaccaaagaaacgggcattttttggtacttctaaaaaagtaccagactgatattttcacagagatgttcgttatacccttaaggaacaggaacagaaaacttctatactatttaaactattttagaggatagaaaaggaaagaaaactccagattttatttatagaacttgcatgaaattgataccaaattctgacaatgcaagttcaaaaaggaaaactagagatcagtgttacttatgtcaaacagctcttaatagaatagatggatatggttatcaacatgataaatatgtttatcacattttaaagcctacatggagaaacatttgaggttttcttattctagaactgacaggaatgtcctttattatgagcactattagtcaaatttttctggtggaactaatgtaagtagactgctgaagaaaatgaatggtatgaacattggaaaggggaaattaaatgattattatttacagataaaataattgttaagctggaaaatccaagtgaataaagggaaggcctacaattaagcagttaaggaaagggctaggtatagaaatcaatagttttgatatatgcaggctatagccagttaggagatcagttaggggaaaaacacgttgacagcagcaacgaaaagctgataaacctagaattgttcaccacttatcttaaaatgtttaacatggtactgagggacacaggagattatttatgtggaaaaacataccatgtttctatacagaaaaattgaacatcacaaaagtattatttgatcttaagataatttatatttaatgcaatctcagtgaaataccaggagaatgtttttaagctagacaaacttatttcaaagatcatatgtaaaaataagcaaaaatagatgtgaaaaattctttaaagtaatgagagaccagtcttattgactattaagtcattataaaactataatgtttaaaagatggtactgacatatgaatagatcagtggatctcagatgggcagtgcagaaagagatccaaacacatacaaaaatttagtacctctaaaggtggcatttaaaatctgtggggaaagatggattttccaatgaataatgttgggataggtagatagccatctggaaaaaatgaaagtcaaatcccaactttttaccttttatcaaaatgaacttcagatacaattgaaaatataaaattgagaccataaaagtattagaagaaaaatgcagtttttaagtctcaaaaggggactcttaaatatcatacaaagcccagaggccataaaagagatgattgataaattcaaatataggtccgtgtaagcgaaaactttcagtatggagaaaacataagttattaaggcaaatgacacactaggaaaagcatttgtaactcataacaagcctagttttcttactgtgtaaagtactgccataattgacaaagaaaatatgaagaattggcaagtgacatacatagaaagttcatggaaaaaataactcttaaacatttacaaaattttacaacctctcatgaaaagagaaatggaaattgaaattagagtcacatacagtatttcacttttcatttgtcaaagatcaaaaagtttgaacatactgtgggtttatgtttataaggatgtaagaaaacaggcaatctaaattccttgtagagtgtaaattggtagtaataagagaaaaatttactgaatactttgtgccaggtgcttttctaagcactttacatttaattatctcaattaacttatccagaaagtaccattatttctgtattacacgtgaggaatttgaagaaaagttagacaagtaattcaaagtcacacagttaataaatgacagagtgaagatttgagaccatttcctttttctcaagtgtccacttttggtcgcaactctgctgtttctgtagtgagtgatttaacactatatgataaaaccttaagagtacgtactctttgatccagtgattctacttccagaagtttgtccattttgcatcaaatagatggagaatagcattcattgcattgttatttgcagtaaaggaagattggaaacaacctgaacatttatcctcaaggactcatccatacaaaagaattgaagtaaattcatccagatgaatatgaggcagctttagatagagtgagatggcatcctatgtagtgatatggagtcatctttaaaatacagtaaaaggaaaaagcaagatacagaatagcatgtagggaagctgctgtctatgtgaaaagctgtagaatatacgtgcatttttgtatatgcatagaatattcctagacaaggacaaacatggtggttcatacctgtaatcctagcactttgggagactgaggcaggtgattcacttgactccaagttcaggatgagcctggccaacatggcaaaaccccatctctagaaaaaatataaaaattagctgggtctggtggtgtatgcctgtggtcccagctacttgggaggctgaggcaagaggattgcttgagcctgggaggcaaaggttgtagtgagccaagatcatgccactgcactccagcttgggtgacagagcaagacaccattcatctctctatctcttttctctctctctctttctctgtctacacacatacacatacccccccacacacatatatatacacacatatatgtgtgtgtgtatatatatgtgtgtatatatatacgtgtgtgtatatatatgcgtgtatatagatacatttctagaaggattctcaaagtgatatcagtgattgttgtgcaagaaggaaactagatatcagtgaatgcgctaaataaggtgattttgaattctgtagcatgtgtatgatttacctatagagaaagcagtctagcatgagcgtgggtttctcaaatatagaatgtttgcagtgaggtcacttggtgaaaagtatagccatgtcagacagatgtaggttcagattccaggacttccaggactgctgaaagggaaaggggctttggatctccttcagctccaggcagcattgctcctttcccagctttgacattagctggagggaagacaagttcttagagctctatgtgcttgggacaagaccccttccccctactgccttactcgccaaccataactgctgcaaacaattcttacctcttccaccccatgtcactgcctaaaacccttcatcacctggcctcccatgcctctaagtctctgtacatcccctagcctgatactgtccccaaccctcctcaactccagacaccattttactctaccctctggaattgtccattattagcaaaatctcctttattttcaacctcctttctaagtatttcccccacattcttgttgtaatagagacacagctttcccaggactgtatagctttccttgcagtcctctaaagtggtaactggtttctctgccatacatttcataccactggtcctggagatattgtcaatatcttaatgtcttccttccatctcacttaaattttgagaccataattcctttttcctctcttaaaagttctcagtgttgaagctcaatccattagatacctctagctggcactactagttgcagtcctgtgcagactactgagtcattttctttactccctgaagacttaaactctatcttactctcactctctctgacattactcctattaaaatgttatgtttctttagctattctttcagtttttggtctcctctccttcaacgaggatgatttctagaatgttggttctcaaaatgtggcccctttgcagacatcgtcagcacctgggaacctgttataaatatgaatctgcagaccacaccccagactactaagcccaaaattctgggggctggagcccagaatctatgttttaagaagcacgtcaggtaattctgatgaatatgccagttccttagatcttgttattgtcattactgacaactttctctgagaccacaatttgaatctaccaatttttcactagtactcacccatcttaagtccttactttccccttaccagccagacatttgaatattccttgactcttctctttcacatactatatccaaagagtcaacaaatgctgtcagctataccttcaaaatacatgtagaatctaacttttaacctccactgcagtcacttcagtccaagcacaaccatttcccacctggagtattgcaactgttcttgtttggtggcccttggccctactttatctactttccgcaaagcagccagagtgtttctttcaacacctaaggttatatggcttcattgattgaaattcaccgtgcttcacctctttctctacaaaagccaaagtccttgtaaatgcctgtaaggctcgagggtgatctgaccttccctggcctgtcgtgtttcggtaaaagtaagctgagtctttcatagttaaaggacagcaatattgtcctgcatgatattttaaaaacccaatcaagaatcacacattgcatttaattttcatgcctttagtctccattaaaagtgtgccctttgtattaataattggagtgatgagggacagagtttaagaatatataaatattttgtccccaactgactgtcactggatggctttggcacccattggtgattcttacctgaatcagtaattattgtgatgactgaaaatagtgatttttctcactgtataattcttctatatttattaattaccttaatattatcctatagaacagaatgttcccttctcatcttttgtttgtttagtgtcagtattactcatgaagttgggtgtttagaaaattcaatgttgtataatactgttattattcaatattgtattttctcagtttgagtcttccatctgcgtcctttcatgtaaatagtataaagatcagtaatagaggaacatagagtaaagtgtgagcagagaagccttactctgagacaaacttcagagaggtgaactctgttgctgattaagaaaggcttcactgaggaagtgttgtttgaagtgagctttgaaaagtcataaaattttgacaaaagtggggatggggtggagcttaaaggaaaaactgtctgaacaaaggaaggcccggcagactaggaatttggcaataatacagtggttttggaccttgatgaggaagttgaaatggaacataaaaaccctctgcatttagctccatttatttgctcaggcagctctcactgcctaaaattttcacccctgctgttttgctcaggggtgggatgaggggtaatgagggaggaaattttagggggtgaaaacagcacaagccaaaaaccctgctcagatactcccttctcttgaagccttttccagatccctaataagaattaaccaccctctctcacacactctgttgtactttgtccttctctgttaaccagcctctgtgttttgtgctgtctgtatttgtggatacatcttcctcctttaaagcacgaatcatatcttaatcccttggcccttcttcccagtacttagcacaagtgctcaatacatgtttctttaacgcgtgtaacagaggaaggcgaggagagtgagtgggattgggagcaggaggattctgaatgtcattttaaggggtttgggctcgctcttcaggcagcaatgagccatagccgcctttgaactgtgcagcactgaccagagctgtgatgccaaaggatgcagtggaaggggaggacagccagcatgcctgggcatggtccccaagtcagaggacatcagtgggagaagggagaaggcatggaagcaagtggctaccatcttatgaatctgagcactcattcaaaggtggcaaggaaaaaggaaggcattgagcacggttttgaggtttccagcctgggtgattggaggctgatgcaggcttcttaccaaaaagggccctaggcagtttcaccaggaatgtttaaggagtttatcatgaccctatctcttcctcgtctaaaactctccctaaaatcaaaacagtatgtcctgttgaaatactttattgtatcaaatataatgagaagtaaaatattctctctacttgatgtatgaaacactgacttcttgtagtggacaattttcacttgtctttttagtaatggtttttattaaaaatagatgttaataactgcttgtttaatctttaaacgtggccctctgagagcagcttaccgtaaaagaaacggttgtcagctttctttttgctcctcagtccctcctgccccttcctaacaacagaaaatttgctttgcacctgctccaactgggttcgaagagataagcatcttgcaagcccagaaaattgtagtatcaaatctcagccccaactgtgaggcagcactatcattgaatccctgctgagaggcgttgctttcccaattcccaaaagagttctttctcccctggccccttttcaggcttgaactctgaccgaaaccctctttttaactcccagcatgcactgcacttggtactgacactgacccatccctgcttcctctgttctgcactggactcatcagtaggtcaggcgttggtagccctggggtcactggggtgcccaattccaataatgagcacatttagctaaggagaggaaatgtacccttctatttgttacagtccattgctttttttccagaaacaaatgctaaaagaacatttgatatattgtggtttggtaaatacacatagcactgcctaatattcacaaagttgcctcttttttttgcatcttccttcataaattaaatatattgttctaactcatgatttattttaagagggatatacctatttcacagctaggaaaatgttttcaaataaagttatattcagaatactcttgcaagaatttcaaataaaaatagcaaatactatttaaatgcatataacattctaacagacttgtgtgtcattttaaagggaaagaaaaaaaatgatgacaaggactttacaactttgtctttaaaatttcttcttaggctttccaaacagaccgaagtcattaaaaatactccttaacccccaaagtcacaaaaaagaagctacccaggtttattatgagaaggttgaacctctgttgaagcttgcaggaataaaaactgatgtaacaagtaagtaattttcagaatataatttcaccatctacaaaaacatacaaaagcaaaataatctgaatttgtccttaatgcaaacttgggaaactacttgtaatatctatagcatttttacgtcttcataacctactgcagccagctcgagggttataatttaattatttttgttatttttattagaatattaatattttctctttagaattttttcagatattttttcagacttaaacaattgttagatataattacaaaggaagctgtatacttgtttacatcttcatggagatgtttgctacttacacgttaattttgcagttaggcaagaaattgattttttgctcacttatatagttgatgtctttccatggaattcttccttgggttgttttcgttctgactctgacccctggtggttaggtcaaaactaagcactgaactgctggttttattaatagatgaatttagagatgctagaagcttaaatttgttgtctaaactaagaaatgtacttaggtttgtgccaaggaaaatagaaacttgttaatgctaaacttaatagatgattagtaatatcctttttgatttttttaatttggtagtcacatttctttgtttctttgagacttattttcgtatggtggggaactgagtagaagagtcgatgctatggagaatcgcaaccttcctagctttatttctatgtggcttcgctaacagtggaaatttgcaataaattttaattgatgaaaagtattataaaataagcctactcaggggacaagcccagagtgcaattggaacttcctagtcccagttatagattcctagggaagggattcacagtgatgtggctttactcagctgtaaacaaaggagataagtttcaagatgttaataatatcattgaaacctacacctagtgatctgatggattgaggtagaagaaagttcaaaaaaaaaaaaaaagcaagttttgtaggaaggtcagcccccatgaaatgtgcctataactatagaggttcgagagaaactaccatgaaaaactcaagaggaatttttgaattaaaataaagttatagtgaagaagttaacctttatgtttgtgaccttcggcttatttagaggtgatttacaagtaaaagagaaaattcagatttatgttttctttctactgaagatttccaaagattggctgaaggaaaagtttgagatttgtattagggtgagacaattaaaagttgaataaacatattggcatactcaatgactattttgttcattgcttttacatgtgaatactacaaagcagcttaacatggatattgctatatagcattcacttcaggaatctcattgtatgcttgctctgtgttcaacatagtgcaggatgcgagatgaataagctatcatacttggatgactttctacattattagagattcaaaaaaatgcttaaaaccattataactggggtatacataaaagaactttgatgtctcagaggtgatattttgatcggaagattcaagaaaagcatttgaactaggcagtttttaagaggcagacaaaaaatgagggaaggaagtcaggctaacaggcatgtactgtaaaagttgggagggggggcggagagagagagtgtgtgtatgtgagagagtccatgtgtgttacacccatacatctggagagtttgtgccataactttgctctactttcctcagtttttacattatctgaaatcttactctatcatcataaaatagctgccagtgaatttcatcctttcttattaatatccagtgggatggggagaggtgtgcatatgtgtgcaagagagacccaacatgctttaatcctgaagatgaattaaaatttccttttttaagtttgggcacagatactgtattagcgcagtcaatctggaataatcatttatttaaccatcaagactcttcccaggggctgaggacagatccccttttcctgatgactgaaatgcctcagctgaatctggattctgttagggagaagaaagggcaaaatgacttctaggaaggctctcaacaatgtatactacaggaggtataattccaggttatggatggatccttaagctgcactcagcagtttactcatcgtgtattgatccacagttggtgtaaatttttttttatcatactgttgcaatctggtttggcaaagatgactccaccagcagaattaaaattaaaaaggaagagagaaaaagagattggagacaagaaaactgatatacaaggcctgaactaaggcagaggaaatcatctaaatgtgctttccttcttaattgtattggagacaaaactattatgttctaggatttttttctctaaatttgtaaatattactaagtaccatatttaaacataaaacaatagaatattccgtaaagcaaatttagaatttacttacatttgtgcagaatggctaattattagctgcctaacactcctcctacaggcaaatttataaaattacatcatttgcttataaaaccattttagtatgcatattggctcaatatttatgaaaaatatttcttgaataaacctgtgaatatttgaaaagttttagtcttcctgcctatcttacagtgttatttttgtagttgaaataatatatttgaaactttgtatattatactacagaaaggtggtcataatactgttagtttcagtttcaaaaattatgtcatagtaagatcgaattcgtactttatttgaaagtatatggaagagtaaagcagaaagaggacatatcttctgcatgtccagtgggacattgttttaatgtatccttgtgtgaatgggtgagtccaaatggaattggaattacaaaataaaccctatatgatgagttaattaggaaatagtgctatataaatatgaagtataatatgaagaattacagctagatatatacactataaggtactgtaattttttcataaatttattttaaaaatggatcttaccacattaataaaaacacacttctttcattttgggttgtgctgaaatcctaactacttctgaatatagatcagcatcttttgaaatatttgtgctaaagttgcatccccactctgctaccaccaccaaggtagtatcttatctaatagcatcagaaaaacttccgggagaacctggaaagaattattttttcctaattacctattcgtacacaaatcaaagaagagtatgaacgataagcccatgctggcatatgatatcatttctcttgcttctgaaacaaagcaagttttagagattgtaccattaaaggtgtgacagatattttgaggatcagagatccataggataattcatagtacaatagagtgaaaaagttaaggcagcagagaaatcagactgaaaagaactttcgaggccatatggttcaatttttctccttgtgggtggagcacaggtgtgtggcactcaactttggcttggccacctacactagaggcagagtacgttgttactggacaatactgtttgacattcttatgaatgttcagagttactgtacctttgggcagattagaaaaggcacctcctctgtgctgacttacaaaaaggtgccctttcttccagactaattcatcctttgcttataaaaccatttcagtatgcatattggctcaatatttatgaaaaaaatatttcatactttcaaaatattcatatttcaaaaatattcagcccaaggtcactagattcagcctaaagtcatttgttagattgcaaatccgtcattcccgttagccaagtacctttgtgctaggcataaactgtacaaaatgagaacttgtcagctgacattcgcctctttgtaatttttatgtactagagttaatgttatctcttgtagtaatatgaaataaatgtgccccatctattgtataggagtcattgagatatttgaagagagatatcctgtctgcccctcatctcttgttcacgataggtacttccatcgccttcagttactttttgcattaacagagctgctagaccttatcatggtcattatcattatcatactcaaagacatttatctgaaggaaaccttgatctctgccagctcagggctcttgggagtgcctagtcaccagataattttacctcctgggcagagttgtcaagaaagtggtgtttgttatcattttccccttctttctcctaaaatcacgcttctaacatggctgttaacaagcctcttcatagtgtttctctggttgtttatggctctacttgaagccttccatttcttggaaatgcctcttgcctttctaaatctcacccagcagaaagctaggccatctaatgaaactgtgtcacaaaagattccagtagcctgaggcatcactccttccaattttacctgcattttaatacaaaatctgaaaagtaaatgttcatgcatcatatctagctagagagaaagataattctgtgtaaaagattctttttgttacctcttaaataattgtgggtgtatatggccagtcctgttcccagcattcagatgtgagttaggaagttggaactttatacctggggacgatgaagactcactaatggggtatatacaaaaaagtgatatgattaaatatgtatctgaaaatggttattctggctagagtgggggagaggtttgagggagacaagataaaaggctattgtagtacaggtggagtatcccttatctgaaaggcttgggaccagaactgttacagatttaggatgtttttagcttttggaatatttgcattatacttaaccacttcagcatctctctaatttgaaaatcatggacacaggaaggggaatatcacactctggggacagttgtggggtggtgggaggggggagggatagcatcgggagatatacctaatgctagatgacgagttagtgggtgcagcgcaccagcatggcacatgtatacatatgtaactaacctgcacaatgtgcacatgtaccctaaaacttaaaagtataataaaaaaaaattaaaaaaaaaaaaaaagaaaatactccaatgagcatttactttgaacgccatgtcattgctccaaaatttttagatgttgaagcgttttggattttagatattctggttacagatacttaacttgtctacacatgaaagatatttagtgatcagatcaatcagctaatttagggaattagctgggagaaatggaggaatgctatggcataatttaaagacagaaacaactggccttggccatggagtggttctggagagtggaggaaagggacactctagaaagaagtcattttcctgtcttggggtagatgatggaacacaaaaagaacaatatatttgagagagaatatatttgaaggtatacataatggattctgttttgagcttactaactttaaagtacctacaggacaggaaagaaaatgacatttcagtatcatatcccacactagaattttatcaccaaaccaagaaatgtttccttatgtccaaatcaaatctcacctgattttatttcaggtgattttctcatcaacattgaatatcaaccttaagactttcttgtcttcctgaggaagttgcatttgcaccaaagaggggagggggaaattcccagcagtgagaattgtgttcaaagacctgtaaactgtgaaggcttcacatctcctatttagaaagagcacaggttggcaatctcataggaaaaggcaaatagatgaaagaagaggctgggttacattttttgaaattacatttatctagcaatcctttctttgtttgtttgtagggggatgatttgaatctggctgtcactgattccagggcccacaatagcctgtctaaatacatatttggtcctttctactatatttaaatagtaatccagatcactctttatccttttgcctaacattgttttgtataaccacctattacttcatattataattcattatttcattagcatatattgtctatctccagaatgcaaattcctgaggccaaagactaattcattttgttcattttgctaatatattttatagatgtagatagtcaggttcttttcattttgtttctttgttctagatctttgattttattggacttttgcaatgttacttaaaaaattgctattttcaggcaggttgcattagtgtataatcaaattccacccacaatatcaaaaaaagactattacaaattaaaaaaataaaaatagcattcaataataacacagttctaaagctcattattggatctgaaaaactttaccaatgtaagctttggtataaaagtaaggcttggtgaactgattcttagcataaatattttttcatgatattcttatttttaatgtgtatatgtaagatgttttattttgcattttaaggttgtaagtacttgctgtagttataaatgaatgatcagcacacatcttctttgataacctttcaactttattaatattaatgtttcatatgtagttttattatggctttcttctgattggaatttaatatagagaggttttattcatgtgagtgttaatggcattttgaataagctatgggagaattacaatgtaacactgctggatacagaatgattcttttagacaccaagactaataatttttaacaatatcgaaaaacattgtaggaaaagcttgaaccatgctggcaccagggacagacaagcatgaaagattaatgtaatcttgcatataatgacacacattcttacacaaaaaatccatctgcaatgtcatgtcagtcagcagaaatctttgatgggtggatacagctgggctgtctcttctggcagagctgccctggaaaatgctaaatgtggttgtgatgcttggtgccatctgcagtgtgcccgtttatcctgtcttcactggcatttacgatactgcatagggcatcagtgactgtggagacagcgatacagagtgacagattcatttcctcggagggtctgagctctggtgggcctgtgtgccaccctccttcttgggtctgggtctcttataattggtgttggctttactttgtattttcacatccaactcttcctctttttagtctaacagttccagtacacattcttctggtttgtaaatcttacactaaccttttgactaatttattcatgtaaggttgccaaaccgatttaagattgactgttcaatgccagctaatatgccttatttccaaaatactgctcctcctaagcctctgatttaaaggacatgtgtcttatttagggaatactaaacaggcaccaggacaaattgggtaaccactatgcgtgggatattcccaaatgactttatgtagttgaaacaaatatatgaccttctcttacataaagctataaaacatcaggccagtaacacttagtcctcttgcccatgattaaaatataaatattcaagaataaatgctgttttatgacttgaccatatgtttatcatattattttgccagaacaagttaaaaagtgtgatcattgtttaaaactgtcactttgtgtatgtgtgtgtgtttttttaatagtaatggaatatgaagggcacgctctgtcactgcttaaggaatgtgaactccagggatttgatgggtaggttatattattaatcaatatatgttatatcatttatgtattaaatgccttcactagttttagctacatatttggaacctaacatttaaaaatatttgtagtgtatgtactttggctctatcttgttcatatctatgtaataataattaatgataatatgacatggtcatctatctctcaggatctggcataggaaagcaaaaagaggaatctaattattaaaatactgggaaatgacagtgtactactctatacttactaatgtgcatacatttgcatctataattatttgcttttaccatatatctagagaagcactaatggaagatgttatactggtcacatggcataactatatgatgatcttcttttgcaaattaattgataggtttaatagctacccattggttaacttgtctgtgatagattgagggaagatattttataaatacaagtaaataaatacattatttccagaaacaataagaaataattttaattatctcataatgtagtgactacaatttaggtatgttattcacagtgggcatcggaaaccattgttcgcaatacattggagtgtacagagattgttcactggcatgcaaacgttagaaccaaggcaagtgatataaatttcattgccattttttaaaattaggtgaaccaatttgctaaagtgttggactgatgtgtaagactaaaacatattatattcctttagggaagttctttttacgtgagtagatatttgagaatttaaaaagttgacaagtgtgtgaattatttgtgttacatggtgatgggcagggggcaaagacccataaggtcaggaaagggagttaggtctgtactttcaccaaagtgaaaggcattaaccttcccaaagactgatttgaatgtgctggggagggaagtgatgcaatcaaaatggagtattggcagggctgtttttcagaaatgcttatttatttatttattttttggatgaggagaaaacaatagctgttgagaaagaaaatgtggtaagtaaaacatgatttttccaaaaggaatctaattgagggaagtaaatctagatagcaatattatataaacattgggaatcaaaaatatggggtaggagattacttcagaactttatacttagaggtagacaaaaacattaataggcttcatttagaaaattgtcttacaagtatacaatttaagaaaagtccttgtgggaatcatgcataccaactacctatttgaatatgctgcatagtccctcactagacctcatgagtacatgaaggtagctgcattgcaaatgagtacctgcttcaaaacttgattaaagaatgagaataaagatatcacagatattaaacttgttcttacacagcagcattacagaatgttctgctgaatgcagtatctatcaatatgttttactggtatttgtactgggtaaagggatgaaaagaactttgcagaatgaagaaagacgattgctgaagtgtagtacaataatatttttctctttacctgaacatatttaatccttatttatttttcatggcaggtgttgttatttttcagtgtagagctaaaagatgtatagatttttcagttattatattttataaaccaaatagtttggcctaaccattatatgaattgagttatgtaagtgtttctaaactctatggcatgctgatttatttcagacttacaataatttcaaatttctactgaaagtcatcttccgtgttctaagactctttaaatcaggggtccccaactccgagactgcagatgaatatcagtcagtggccttttaggaactgggaggcacagtaggaggtgagtggcaggagagggatcatttccgcctgagctccacctcctgtcaggtcagcagcagcattagattctcacaggagtgcgaaccctattgtgaactgggcacgcgagggatataactggtcatgcgagggatctaggttgcgtgctcttgatgagaatctaatgcttgatgatctgaggtggaacagtttcatcctgaaaccatccgtctcccaccccaccctgcagtccatggaaaaattatcttcccacaaaaaagtccttggtaccaaaaaggttggggaccactttaaatagcttatttatttttgtggggtcagttttcccagtagaagctgatatggtagttggagtaattatcttaataaactggcaattttaagtcactgtacttagaattacatagagagatatatgaggagaataatagaaacatagtttcttcaggtacttcaaaggaacaattctcttgcaagtaaaattgtttgaaaatggaatattctacattggtgagttttctattcctgaacctgttctaaagagtggctaaaggaaaattttgggggaaatttatagaaaaggtgcagagatgagagaaggttaaccccaaaatgctatggcattttgatgagagacagactcaaatttctttaagaactttggcctgaagcacctccgtctgacactagtggaactattaatagggagtgattaggaaatcacctaacagtttggtttctagatacaggctgaagaagttaagagccaagaaagattctatgtatagtatttagtaaagcaaaacaatttggtaagtaatgtttaagaaatgctatttcctaagattttggagttgtatttattttttttaatgaattacatatgtttctatgagacatcttgtgacatttctaaacccaacagaaacagtgtatcagcacttatgacagctagttctccactgcagtgtgtcctaggaaacactctaagatccactgttaaaccttatgagagcttcagattctatattgctccctattttactgggcatgagtaggaagttttaggaaggaaaataaaagaatatcagctgcatagacttgaagcagtaacacttgcatttataagtgtgagtatagttttaaaaatctatagattttatgcaattgtaaatatatgaattcctcgctattaatatttgtttcagaatttttaaaaaaattgttgagttacttttcttttgttcatttcaccattaattagacccataatgttgtagacattatttggattatattgacattttatcagattgaacatatctgtattacttagtaaggtaaaaagcaaaaacaaaaacaaacttttccagaaagaaaaaaaactgtgaatcaaaactacaacaatatattgaacatttcatagatgatgggttcatagataagtataaaaacattcattaaaaaaatctttatcactctttgaaaaaggatatattatcacccagtgtttcttttctagacagaataattctgtttggagccatggcaaggagtttacttattttaaaaacaagatttgtcacatgcaaaggattagttactctaaggtttatgttttagagtgacacaagtgtgattaactcactataaatgattgaatactttgctttttgcctttcttgtatatttagactcttgtgatatttttgtaagaagctgttgatgaaaaaaaccaaactgtaaaatatttaaagaggtttattttgagccaaatatgagtgctcatggcctatgataaccccaggggggtcctgagaacatgtgcccacagtagttgggttacaacttggttttatacattttggggatacagaagttatagccaaagacataaatcgataaatgtagggtattcattggtttggcccagagaggcgggatatcatggagctggtgggaaggggagctcacagatgaattcaatgattttctgattgtcagttggttgataagctttgctgaaagattagaagtcagcagaaagaaatgcttgagttaagataaatggggtggtgtaggctgggtgcagtggcttagcagtggctcacacctgtaatcccagctctttagaaggctgaagaggggagatcacctgaggtcaggagtttgagatcagcctggccaacatggcaaaaccccatctctagtaaaaatgcaaaaattagccgggtgtgatggtgtgtgcctgtagtctcagctacttgggaggctgaagcaggagaatcacttgaacccaggagggagaggttgcagtgagctgagatcacaccattgttctccagcctgggcaacagagcgagactctgtctcaaaaataaaataaaataaaataaaaaattataaaaataaagataaatgaagttgtggaagcacaggttcttgttatgtagatgaagcctccagatatcaggcttcagagagaatagatggtcaatatctcttatcagaccttaaaaggtatcaaactcttagttaaatctctcctggatcaggaaaagacctggaaagggaaggagattctctatagaatgcaaatttctcctgcaaatgatagctttgcagggccatttcaaaatatgtcaacaaaatacattttgggataaaatactttgatttcctctagggcctgctatttgttatttaatgctataccagagtcaggttggagttggggatcttattgctaccaagtctgttttgtcagtcttatgatctattttttttttttttttgagataaattctcaccctgtcacccaggctggagtgcagtggtgcaatctcagctcagtgcaacctctgtctcccaggttcaagcaattctcctgccccagcctcctgagtagctgggattacaggcatgcaccaccatgctcagctaattttttgtttctttaatagagatggggtttcaccatgttggccaggatgatcttgaactcctgacctcgtgatccacccttggcctcccaaagtgctggaattgcatgcatgagcctggccaatgatttacatcttaatgccagtgctggccatttgcgcctaaactccaaaagacaagagggtataaggaggcatatccaacctcccttcctgttatgacctgaatagtttttcagattttctttgtgaccttcatggccaaaaggggaggatccattcagttagttggcgacttagaattttatttttgttttacaaaacttatttcctaggttgagtcactttacctgaacatgatcttaatgattgaatagttgttaacataaataaatacatattttttctaactcacttaatttcacactggttctactggtaaactgtttttcaaaataataagattctcataaggctatttttattaggtttcatatatagaaaaggtatctaatatattgaataatattgtagcttctaagaccaaaatgtcttatttcaaatccctgttctattacttactagtggtacaatcttgaaaaagttactttatctttctatgttttagtttcctaatctgcaaattgaaggtaatattacctattgcatacagttatttctccacttaaatgagttaatacatggagagtgcttaggaaaatgtctgatatatatatatagtaattattcactaaatatttctttattgttataattgtcatttgtattagtttcaaaagatttaacacagaatgtattatgacaaaatttcagatgtttcagaacatgctcatagggaggccacctctaataactctagcaatatgttaacatatgcatgacgctataattgtatgcaacattctaggagttaagtgttcgcatcctatgtatgtaagggtcaagttatttggtgctaaattagatttttttgggtatgactccacatagtctttttggtcacacccatatgtcagcatttagacagccatggattgagggttacgtttaagttcacagattagaaatctcatagagatttttgaaatcaggtaagtttcaagtcaaaccttggtttttttcattcataaagatgggactgtggcctattttgcagacttctgaggatttaatagaaattagtaaacacattacctgatatatagtttgtccttagtaaacatcattccttttctctgaataggtggtcatattgcgaacctctggaatcagtttagacataagaataaaacacacctaatcaaacatgacctgggtcatatcttgagtcttctaaccagagtagccttggattgcccaggctatgtggagctagtgggatgaggaagatggggactagagggaatagatggccgagagaaagatggtgggaactgactggaaagacactttcagcctttggtcaccaccctccagagcttcctaaacttagagaaccagtaactactgctgactgtggcccatagacagttttgtttgaaatagtgtttttaaatatattgaatgctagttgcttagtatttacaaattaggagactcagccttaaatcagaatctctggcttctgtagaaaaaccagatctgggtccattaggcctcacacgtgatgtgagtgggccacagcaaagaagtggctgcgcctttagattgagcctactcttccattcctgctgggcccttgtagcccttgagttgtgacacctgctttcactgaggcaaaatccactttccattgggttaactggtgacattttgatacgtaagaatattttgcttcttttgaacataaatgattatgaaatgaatttctggtacttctgtgttattttaatggattctgcccccatagtctacttgatataaagtcttaaaaaatatactagtagtactatctaggatcaaaggctaatagtattacatctagaagcaccgtatagcaataatgtcaaggagatgaaattcaggtcaggtttgtaattactacattcatatagtaatgataattagcagtttcttaaagcttcatattttatatgatttttattgctatctgtcttttcagagctttattgagaattagcaggattttatgactttggttggtgttagttaaatgaattgcagatgacagtattattaacaagaaatgagaatgatatgcttttggatgttaacagagcaaaacgctggtcagatgtgaattaacatgttcaaaagttttcatatctcttaacacacttaaagctattttgtctatggggaattatctagttattatatttgtgaagtaaacttacctgtgttgtgtttgtgttgtcttacccattgacacatattaacatgtttaaaggtacatgtgagcagttatgcacatagactacaaattagtaaactattttgaagtctagatttcatgacttattaccaatcattctgaagttttgccttctttgcttgatttgtatttttctagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggcaagggagtggctacagattcattaaactgacccttctccctcttttcctttcttacttgctaatctagacagcacaacacagaattaatgaacagactttgaaagatccagacttctggcatccccactagcaaatgtgagacttttgacaagtcatttaatctctttgagccttatttttctaatctatagaatagggatcacagatatattattcactttattacaaggttattgtagtactaacgtttggtttagtaaagggtttaatatatagttaaaccatcagtatatggaatggttattattctcccttcgcataaaaaatctgttgattacacagtaccaggtaagaagtttcaaaacagggccactccagtctagctgcttacaattccatatgaggtgaatatggtaacttgcataattgatgtataaccagataaccttgagaatgccaaaattacttgtgactggaagggaggataaggtttggaagggtgagattcttaagggcaaggctttttaatctttctactcactgccatttttcagcatctagaatagactatgccacagtgatgctcagtgaagcctattaagtgaatgcatgtaaagaagactttatatagtaaatgacacttggattaggtcttaaaatgggttggagctggcctgaaaaggtgagaatgagttattttcttggctgcaaaagtaataaagcaaaggcaaaacccaggagtgtttgaggaatagtgaaaaggccattcagtggaagataatggtatcaaaataggcccaaccatggaggctcctacatgccacagtaaggtctctgaattgtatttgataagcagtagggaataatgggatgtttcagagcaagggggcaacctgattggagcttgttccaggaggattcattttgcctcaccgtgtggaatgattagaggttgggagcaggagaaagtagaggtcagagacacggagaaccgttagagcaacactgtgatccagaaaagagggaaacatcattcaaaagctgattgtattacacaatcactcatccctatttaacgaacggtgctgggaaaactggctagccatatgcagaaagctgaaacaggatcccttccttacaccttacacaaaaattaattcaagatggattaaagacttaaacattagacttaaaaccataaaaaccctagaagaaaacctaggcaataccattcaggacataggcatgggcaaggacttcgtgtctaaaacaccaaaagcaatggcaacaaaagccaaaattgacaaatgggatctaattaaactcaagagcttctgcacagcaaaagaaactaccatcagagtgaacaggcaacctacagaaagggagaaaatttttgcaatctactcatctaacaaagggctaatatcctgaatctacaaagaactcaaaagaatttacaagaaaaaaacaaccccatcaacaagtgggcgaaggatatgaacagacacttctcaaaagaagacatttatgcagccaaaagacacatgaaaaaatgctcatcatcactggccatcagagaaatgcaaatcaaaaccacaatgagatatcatctcaccccaggtagaatggtgatcattaaaaagtcaggaaacaacaggtgctggagaggatgtggagaaataggaacacttttacactattggtgggactgtaaactagttcaaccattgtggaagacagtgtggcaattcctcagggatctagaactagaaataccatttgatccagccatcccattactgggtatatacccaaaggaatataaatcatactgctataaaggcacatacacacatatgtttattgtggcactactcacaatagcaaagacttggaaccaacctaaatgtccaacaatgatagactggattaagaaaatgtggcatatatacaccatggaatactatgcagccataaaaaatgatgagttcatatcctttgtagggacatggatgaagctggaaaccatcattctcagcaaaccatcacaaggacaaaaaacgaaacaccgcatgttctcactcataggtgggaaatgaacaatgagaacacttggacacaggaaggggaacatcacacactggggcctgttgtggggtgggggaaggtggggagggataacattaggagaaatacctaatgtaaatgacgagttaatgggtgcagcacaccaacatggcacatgtatacatatgtaacaaacctgcacattgtgcacatgtaccctagaatttaaagtattatatatatatataatatacagccttatgaacatatatatatataaaggaaaattaggcaaaatagcattacttgaggtactcaatagcctggcagagcagacattaagggtaagagagactggacttgaatttcagtttggtacttgactttgggtgggtaattagcctttattagtcttgattacacatttaaaaggtttaataaggccgggtgcagtggcttatacctgtaatcccagcactttgggaggccgaggtagtggatcacctgaggtcaggagttgaagaccagcctggccaacatggtgaaaccctatctctactaaaaatacaaaaatgagctgggcatggtggtgtgcgcctgtgatcccagctactggggaagctggggcagaagaataacttgaacctgggaggcagaggttgcagtgagctgagattgtgccactgtactccagcctgggcgacagagcgaggctgtctcaaaaaaaaaaaaaaaaaaaagtttaataatgtccatccccatagggccattacaagaatcaacttttaaaaagtcacacattatcactaaaaaagcaaaatatttttccctatgattatagaaaataatgcacattgttgaaaaaaattcatattttgataaccctattcatttagtatggattttagaatacttagtattgttgataagttgacagagcataagatattcaaatgcccttttagagtgtaaagtctttcagaaagtcagaatttaaaaggagagagatattcagatataatctgataattctagagtatataggaaaacctaaaatggtttctaagtagaagacaccaagatgattttgactcaaagagaaaaatgatgcattttgggccatcttttcatggcattttatttcttgacctttttgctttactttagtagttctgactataatggtggaaactttccaacatttccttccatgcaaagtggatgtgcttaggacacttcattagtacttaaattcctgaggtcattcattgactgccatacatcagaaatagaaagatgggtgtccctacaggtatgcctttgacataaatttggtggttggctataaaaactggtggttattcttatgttttagtatgtaattcagattttataaagaaatagcatttagttttatcactattataattttgaagagtatttctgatttggggagcattttatgtattctttggatatttgtagtaatgccattttaacctgtcttgtttagaagacacagtatgctgccaaaattctggtcattgcataggagttctagcattctaattccatctaataggaggggaaagtcatgtgtggggtatatttaatatgatgactgtatgcctagtcagggcttttgatagagaatgggaactagaactaggcaggaagttttcaagctgaacatgaggagacagtgtgcctttgaagccatttgcctcctggagagagacacccagagggagagtgtttagtaaattaatccactgagccaacagactaagctgctgaattatggtcagactcaaatggatcagatgtggagaagcctgtatttgaactgctggccattaggaatggtgtttgttgctatgggaactggtgctaaggaactatactgagagactctgattaaaagggggagggggaatggagaaaaaagcctgagaggacataaaaataaaaaagcaatccagttgttgtaaaacaaggctcaagccacatactgatggctgtgaaccatatattcctatagagtttgcataaataaattcatgctttccaattaatttgaggagaataaaatattgccgagggactgttaatttctatgatatttcaggcaaagaaccaaagtgtaggtgccgttttcatgagaattttagatatgcttgactaggaagtcattacatcacatttatctgtttggatgtgggagacattaacagccttatgaatattcatggtatctggttaattaagttaattgttctgcagaagtgcttgcacttccaaggacattttttttttttttttttttttgcctccatagtttctccctggtatttcatcagtaattctttacatgaactgctacttctgtccttacttttttgtatttggaacattttagcagctctcaggaggaagtggtaggcaaagtttctggtagtgttaagaaaaataactttcaggctaattaaaatgtttaccttgaggtagaacatttatagcttttgtgagaacattaaaattacgccattgttatttatgtgagcagcatgttcttttggcatgtagacatcttttcaaatagagtacagtttcctgaaacaaaatgtaatccatctttcagattatcccaacaaaatatagaacaagctatcgttttgcaattttacatatactttctcataaactttccttttttcttcagagtgtcaaaaaccacatttaaagactaagatacagattaatgagtagtcaatgactaaaataattttctgacttctagtcatgtctgttatcactgccaacttctacagaattagagaaaagttgcaaagcctgagaagacataaacaatttttaaagccatctctagcattctaaaaaaattttgtacttgggcatacccaccrtacttcaaactcacagggaataaatggtctttattttcttaagtcatgatatgtgtcattctctattgcacatgacattacattatgttttttaatagcctttctagaggaatgcttttacggtctactcataattaaccatggtaatggaggaaatgtgtttcatggagtactgtaatccatcgataatcctaaatatctgactctaattatgtggcctcctccaaaatctttaccacaaatctgattgggaagcacaatggattgacttgtttcttccttttctcctgatccattccagatttattagcaattagatggtcaaagggcaggctgtagagggccacaagatcattggaaagaccttgataaagatccactgagtaacaggtttctacactacttgttctcaaaacttagggtccatagactcaccttgtgaacttgctaaaacagagatacctgggtcctccctcctccaaacacattctgagtccatgagttggaggtagaacccaggaatgtacgtttttaacaagctcccaggtaatgatgctgcttggaccatgcattccagaggagtttctcaccaagtcactgtgcatacaaaccacctggggatctaataaattgcagactctgaatcagtgtgtctggaatggggcctgagaggcaacattttaaaaataatatattttttacttccattaatactgctattactgttttaatacctattatccttatttttaaatggacaaaaattgtatgtatttattgtgtacaatgtgatgttttgaaacatgtatacattgtgaaatggctaaataaagataaacatgcataaaattgacataatgatcacatactgattttacattgagaacacttaaaatctcccttagaaatttccaagtatataatgcattgttactaactattgttttagcctgttctcatgctgcaataaggaaatacccaagactgggtaatttataaaggaaagaggtttaattgacttgcagttcagcatggctggggaggcctcaggaaacttacaaccatggtggaaggcaaaggagaagcaaggcacattcttcacaaggtggcaggaaggagaaatgctgagtgaagtggggaagagtcccttataaaaccatcagatctcatgagaactcactcactatcacaagaacagcatgggggaaaccacccccgtgattcaattactcctacctggtctctcccttgacatgtggggattatggggattaaaattcaagatgagatttcggtagggacacaaagcctaaccgtatcaactgtagtcactaggttgtataacagatctcttgaatttattccttttacctgaaattttatatcctggaccagtatctccccagtccttcccacccattagccccagtaaccactattttactcttcgcttttatgagtttaagtttttcagattctacataaaagtaagtatttgcctttctgtgcctgtcttatttcacctagcataatgtcctccaggtttatccacgtgttgtaaatgacaggacctctttaatgccaaatagtattccattgtgtatataaacaggctgattgtccctaatctgaagacttaaaatccaaaatgctacaaaattagaaatgtttgagtgccagcatgatgccacaactggaaaattccacacctcatgtgacaggtagcagtcaaagtgcagtcaaacctttgtttcatatagaaaaatattttaaatattatataaaattatcttcaggctatgtgtataagatgtataaaacttttatgtttagacttgggtcccaccccccagatatctcattacaccaacagtgtaaaagtattcccatttctccacagccttaccagcatctattgtttattgactttttaataatcgccattctgactggtgtgagtgtggttttgatttgcatttctctgatgatcagtgatatttagctttttttttatatgtttgttggccacataaatgtcttcttttgagaagtgtctgttcgtatcctttgcccactttttgatggaatttttttttcttataaatatgtttaagttccttgtagattctggatgttagacctttgtcagatgggtacattgcaaaaattttctcccattctgtaggttgcctgttcactctgatgatggtttattttgctgtgcagggattgttttcttgatttctttttcagatagttgtaagtgtacagaaatgctactgatttttgtgtgttgattttgtgtcctgcaacttaactgagtttgtttattagctctgacaattcattcatggagcctttagggtttcctaaataaataagatcatgcctacaaacaaaggcaatttagcttccgtatttatgatttgcaagccttttatttctttctcttgcctaattgctctggctagaacttccagtactattttaatgacagtggtgagaatgggtattattgtcttcttgaggaacaagacattgtttctcaactcatgagagtaattttaataagcactcaagtattgtcattcctgtttgacagtaggccgtattttgagtaacaagggtcacagcataacttgccttttggtgaatcagttggaaccagtttgccatttagttaaaataaacttttctttgcactggtattactagaagtaattgtgcttatttataattaataataattaaatatgcttattcttagttacctaaaaaattatgatattaatgacctcttggttgataatggctaagctgcctcagcttctccaatttagcaacccaagtacatatcagttcaaagtaacacaaattgaagcaattatgtatgatcacataggaatgcttctgattaacaaaatccagaggactggtctttgccttcataaccggaacacaccacatgcatggtttcacagctcttggctattattggacttacttattatattctttaattcaagaaaaattgtagcttcattcattctgttcttaataattttaaattctctttagcctcctgggaatgggaagggctagctggtatagtcccctgtatctcagatttcagttacacataaacattaaaggggcctgacttagggcgctctttgcctctgtggactggtggggaaaatccaggtgtgtcttaaattctaataatcatgaaaatcagaaatcataatgtttcaaatacaaatcttcatacatgggaaatacaattgaattaaacattttcttcaatgtaggagacatttgtcagataacagaggggattctcatttggctaagagcttacctctaagattcattaaatgtgtttagagcatattttttgtagtttgtagttattttatttttctgagttattatttggattattttctcttttatttatgtatgcatttgtcactgctccccagaggcacctcattttggcattgaagctaaaaacccattcattaaggttgggatggagtgggctttgatatagctagcatttgggaggtagaaaatagacattcgtgatcaaaaaagctgtaagcggttactataaactatttttaaatttctaagtattttaaatattgaacaaatgtgtagacatttgatgtgcatctatactgtgaataagaacttaaacttctaatattcacattaactttcctgattttataaattctcgtttatttttcatctgaacattgaagaatgacatctacataaagtaaaagcaaatgttagtttgaacacattctaccctaatagtgcatgttttaaaattgctttggcaggatctaccaatgtattggcacattctcttcatggagttcctcatgtgataactgcaacattgcacattataatgggtaagaattcttccaaagcagttcatattttataaggaaatgttgatttatataaggaaggccatcttatttccatcagactttaagaaaaggcaggttctttgtctcttagagtagagaaatgtttgactaaaaaaccaaaaggcaatgctttactatgtggattgcctgtcttttcaaaatacttgctttgtaaagagcagtaaatgaagttttattgtaatctgtacagaaaaaaaatattgtagtgtgctcaaaattataattttataaccagatgaagaacattaatgaatactccttaagtatatccaacactgatgtaggactgtaccaagactctaggactaggattatgttattaatgaaaaaacataaccagaaaaaaatttcagccagtagatgtctatagatattttattatccctattggtaaaaagcatataagctcaggtatatgtaacactaaactactgttaaatctgtgtttaccttgcctatctactttaacttcgtttctttgaccatgttttataggaaatagcaataagctgaaaaatttagtactctgtgtttcttcactagtacctgaacaagttaaaaatggtaattattgtagttataggtaaagggaactgaagagaaagtgaggatgttcatggtctacagtacctttagatattctcctataagccaataaatatgctctcttatgtttgctgttttgatacaagtcctactgtactcactgattaatatttaatgtaatattcaagggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaagtaagtctttttcttaaaccaaaaattgtatcccaggttcaatgactgttaataacaaatttcattacattttagggcagaagactgtgaaatatcatttttaccatttaacagctctgatgatgtgcaagaaaggtaggtaaaaactcaatgtaatacagataacctgtatctttaaagcataaaacattctgacaaacaattgatcagacttaggatctttggttatttttctaacatagtagtaaagaatatagaatcacagactcttacaggtcctagtaagcaaacaactactcactcagcctttttctctttttccttccttctttcctcccttccttccccctgtctctccctccctccttccgttctctttttcccttcccttcccctttctttcctttcctttgtttttttccctttctttccttttccctttcccttttcttttgagtgcctactatatgccaggcactttgaatacaacaatgcaccaaaaaatgaacaaaacacacagttttgtccctcgtgataattttggtctagtgtgtaatacaaatattaaagccatattaaagaagggttatagtctttaaagaaatagtacattattattccttataatactagtttacctttaaatgaatcaacacattatgttggcagcaacaaaattgtacgtttttacttactatctaattgaagaaagtatttaacatatataatgatgagttctctaattttctcatatttaatagatttgtgtgtgtctgtgtgtctgtgcgcgcgttatctgttttatgtctttgttttgttttctttcttttaggagggcacagggatctcccaaatctggtgagtcgaaaagtatctccttgagaactgtgccaggttctgttgacattttgttctggtgagggaaaataaccaatcactttcattacctttagactgtaatgatcaatggcaaatgatccagggtcagttcttgaatgtcagcattatggcaattccttgcctgtgttcagtggcacctagaggcttggcacctaataccaggttagtaagcatttttattgaattgttgatacatttcttatagaccattttttttccagggtatccaattaactgttggttagctagaaacttaacaggtagtttatctttgtatattagagattctaagggatttgtcatcacagtaggttgagaacaactgttgaactggaataattatcagataatcattgactatttaacgtcactgaggctaaaataatatttcctaagttttattgatagaattttatgcctactttacttgatttattcatttagttgtggagaacattatattaaatactgatatttcttgtgaatgtctttgctttccaactttaatgcaaacataaatatccttagcatgaaaatcacacatatgtatatttgatactgtattagtctgttttcatgctgctgataaagacatacccgagactgggtaatttacaaaagaaagaggtttaatggacttacagttccacgttgctggggaggctccacaatcatggtggaagatgaaagtcacatctcacatggcggcagacaagagagcttgtgcagggaaactcctatttttaaaaccattagatctcatgagacttattcattaccatgagagcagcacaggaaagacccacccccatgattcagttatctcccaccaggtctctcccacaacacatgggaattatgagagctacaagatgagatttgagtgggaacacaaagccaaaccatatcagatacttttagtcaaaagaaacatttcagttctatttaatgtgaatagtagtgcatatcaatctcctgcccacattttcaattgaataaaatatgagacatcttatatatatctttttatccatgggatatagacattccttctcttgcacattcttcttaatcagctgtccattatggggctgaaaatatttctttcctgaatccaatcctgtagagtgtaggagaaaggatcgtgagtgttgtgaaatataggcaataaacggggaaatattcaaagttagagaagaaaaaagagaaactgcaaacttcgatattgaaaacccagatggcaaggtcctcattaattacatctagtgctaaaacttcaaaggagtattttgaaccttgtgtgatttagaaattgagcctggtggttttccccgacaccttcagaaatcctagatagctgtgtgctttcataatgtagtttccctgactaaacttgaagacgtggctagctgaccaaggagctatgtttggcaggacttgagacaatgtttatctaaccctgtttgtttaaggaccttcttgggagggtagacctgctcttctgggaacaatcgattcatagctccttcaaagccactccataaatgttctgcttgactagaattccactgttgactctgcaggcttaatcagtattaatgaatttttcagagaaggatgactaattagagatttcttctgtggtttataatcacaacatgccatctttgcaaagaccttttgatcaagactcatttgaccggagatttttcagagatgtagcttctgatgattcaggatgattgaacaggagatttcactttcttctttttcccccaccatgataaataataatttatgttagaatatctcagtgcaaattgccagtaggaactaatattcttatattctaagtattctaagattaaatgtgttcatatatgtgagacatttaaagcagtgccagccatgtaagttgtgtttctatttcaagtaaatattgcaaagcaggcataggatagtgcttttaatgtttataaattatgcaattaaagatgcacagtaacactaccatgaacgttttggtgctgtttatttttaattgggaagaagaagcatgatggaaagcatactgagcacctggagtattggtgctgatgaccattttttctctgtgtgcctttgaacaaatcacttaaacttggagttgtcttttccctctacatgaaatgagcgaatgatgagataatctctaaggtcccttacagctctgacttgagctttcataagatactaagagctctttttttattttgttgttattcttaaattaacttcatgtttgcactgaaatcaagctagaagtcatttgtatgtatttctgcaaactgcattctatagcttgatgcatttgtgagtggctgttttggcactaaatcacacctctgaattttcactctcttatattggatggaacagttatgcaagattaaaatgttcagtcatttaactgaacatgtgtggcagcatttgttcactccatttcatccatccaaaggccactttgatttatttcatttcctatgtcacttagaccttctgtctataaataaatatttaaatcacactttagattttagaaaatgttgagctatttgttacacaacttgtgcatattaactcttctataatacatcttttaacaacatagtttcacatttagaatttctaattacattgtattttaaattatgtcttgatatgtgagtaggacgcttgatggtttgctttgtaaaatgctctaatgtaagagcttattgagaaggaagccagtgatttaataaaactcatttgaaagcctgcatcatttaaaaaatagcaagatacggtttatgaattttaggtaaacgtaacatggtgatttatctatcttgtccaatactttcagtaaacagtatacttgttataaggaacagtatgtcataatttttggtataatctcttagtaaatttcttgatgtctaatagaaatatttaatttcagattaaataatggaagtatggctcttataattgcccgaaacacttctcggccagaatttataaaacacctgaaaagatatgccagtgtaaaaaatcaggtatagtaaattctttttgttacttatttgcaaagctattaatcatgtagaaaaagatgctgcaagaattgacatcgaatcctgcctcataagaaggttttattttcttctgaatatattaatcttctttttcccaatctatttcatccaaattttgaaaagcatccgccaggattaatatagattggccttttttgaatgatgaattagtggttatgtatctgtaaccacaaagataaaataggaaatgtagtgttatattgcaatgtgaaataaattaaggataaaattccatactcaggctgttcttcagaatgaaaagaagtgaaatttgagagtttagccttcttgatattatggcagcagactttctaaagttatgatctttagatcttcctgacatttgtttgcatatctgcattgattgaaatagatctgtagatatgtatttaaaaatatgacagttttatacaaatattcattcaaaatgagaatatgtgaagatatacatttccacttaagtgatttgctttaaagagaaacagtaactattacaagccatattattttggcagctgttttgacctgattattaggaaaatgatccttgaactatgtgaatttctgaaattgtgagtctttgaagtacataggtatggttgtaaaaccctatagtttcacactttttctttttctttctttttttttttttttttgagttagagccttgctgtgtcacccaggctggagtgcagtggcgtgatgtctgctcactgcaacctccacctcccacgttcaagcgattctcctgcctcagcctcccgagtaggtgggattacaggctcacacctccatgcccagctaatttttatatttttggtagagacagggtttcaccatgttggtcaggctggtctcgaaactcctgacctcgtgatgtgtccacctcggcctcccaaagtgctgggattacaggcgtgagccaccacgtccggcccacacattcttaaaggtataaaatggtgcttggatagagttgggagataacagacgggaggaggaggagagtaaacccagccaatgactggcagctgaaccttgcttatgtaccttagccatagcaagtctctccatttttgcctcattatattttaaaactttcttaggccatcttcatgaagtttgatctgtcagtaacattatttgatcctcatgtattgaacaactaactgggctgcttaggaacttaaatcataaaaaattacagtcccactttctttatatgtcaaagtagatcagcaggtataatgtaggttgtgagcctacataacagttttatgtatgtgtttgggtggaatatggagatttattgattttcaaaggaatatatgccctttcacattttaataaatttctaaacattaaaaccaatttttaaaaaacccaaagcactatatattcattgctgtttttaagtcagaaaatagaaacaagaaaatgattttaaagcactcaaaattccatgttcctcaagattagtgtcattaccttggtagaattttttccgaatccttttttattaaataaatgagaagtaaagtaagtattaacctcattcatgtacctctatttgagaacttaaatagtattaacctattaatgtacccctgagaagttctgtatttattttggggaggtgtatgttgcacaaattgtttatggaaggtctcttttgaaattgcctatggggcaagtctctcaggcaatttttgtaaacattcttcttcttcatttttttaaatcaatatacctttcttctgattttaaaagcaatggttaccttacacataaagacagacatacagaaaataataaaaatctgtatcgataggaagacgttttctaagagataatattatgcaggatttatcatattttctcatgtactctacgaggcatatcttgcttttgacacaagaaacagttgcctgtgtgtgattcactggccttaactctgatttatttatcaactttcaaaaattaaaatccatgctattttttttttttttgcaaagaattctaaaatattttgcatagtgtatatagtaagaaagattgattcccagggtgactgctttcaagcaatgttaatttgatttgttaattatccacacaggtgtgtttatttaggctctttccttcatggtgacattaaaaatgtgaatttatataaattttgtaagattatgaaaatcagatctatgtaaaaatcatgtctactgcataattcatagcagtgctggtattcaggaaggaaaatgtggcaattcagtttaaggagagtaacatctgcttctctgaaccatttttaccaggttgaataagcgaatgttactgtataacactgtaaaatagattgaaaccaccatgtgcggagtggctcctgttccttccccatctctgtgtaaaattagatagaggctgaacactacccttcaaagtccttgcagctccatcctattgctttgccccccttctcactgtccacacttttctctttcattgtgaccatttttggtagggagtttaaaaccttaaatgtgagtgcttcccccaggatttctttgcagccctctcatcttctcaggatgccgtctcctggatggcctcattgcccctcacttttgaactgtctgaacatcatgcactcccaagggttctgtcatctcgtcttatctgcaggacctctgtcttcttgtatgctgaagaggttctgaaattcaccggcatctggaggccaacatgtctacagccgaccttatcttttcccctaaagttgttccttctgcgttgctctgtgcgggtcaatggcaccactttctacccatccaggttaccctgaactgttccttcttcctcattcctcactaccagtcccctaacttgttctgttggtctcctcttaaatgtttctaaaatttctccctcaccttaattcaaactttaatcctttcttgcttacagtagcctccttttggccttcaggttctctggtcttgtcttccatacctctttttagagaaacttttttctaagacacacattggatttctctcctgcttaattcttcagtgcctttctcttgttgtcagaataatatggaatatcctcagtctggaacacgtggcctttgtatccaggtccctgcctgtgttgcaaccccacctcttattaccaccctccaccacattcccagtgttttggcattttattcgttggctaaggttgccataacaaataccacagaaaagatggcttaaacaaacagaaatgtatttctttcatggttctggaggctagagctgcaagacaatgtcagcaggtttggtttgtcctgagtcttctctctctggctggcacatggctgctttctcacagcacccacaagtgagtggtctttcctctgttcatccccgatgccttttcctatgtccaaatttcctcttcttataaggacaccagtcgtattggatgagggcctaaagacatcattttagcttaatcgtctctttaaagatcttatctccaaatatagttatgttctgaggtatacagagcgaggatttcaatacaggaatttgagggccaaggggcatgatgttgagcacctaggagtcacactgaattctgtgtagttgcttgaccatggtttgcctctagttttgtaaatgcttcctctctccagactttcttctccaggctaaatcttatatgttctttaaggctcaattcaaatgggaagctttcccaacatccatagcctgtttgcctcctcttgtttcctctgttgaactccacacttgcaccatcatggcactcccctgtatcaaaattgtaactgtttacttctcctccccgtgccccaaacataccctcacacaggatactaagctcttggctcccgaaagtcccacttaacagcgtctgtggcttcacagttaaagcatttgaaggatggctagatcttcattttgtgaggagtgcacatgacaactgctgatttaagataatagacttactggtggtggctgtcaattcttgacattccttggcttacagctgcatccctccagtctctgactctgccatccttggcattcttctctcataaggacatcagtcatattggattaggtcccgccctaatgacttcatcttaagttgattctacctgcaaagaccctatttctaaacaggggacattcacaggtaccaggggttaggacttgaacatagttggggtggtggagggaaatataatttagatcataacaggcagttgtgtgttttaaatgaattatcaactaacatgaatgattatgtagataattctacaaggatgaggcatgtagccaaggctttatacccgaggtaggaggtctaacgcagttactgtcaaacagttttgcttggggccctctaattctgtacctcagtcacaacagctgatgccatcatatcatctactgtttaactgtgtttacagtataaactggaaagttggctggaccttggtatctacatatgtaaaatatgggtgttggggaaaatattagttttctgtcaacttttaaaactgtttcattgaggtttacatgtggaaaaggggaaaaactatgtagatgatgtttaattaggaatgtatctcatgtcatttttctgaaaactgaaatgagtagttatacatttctgctcaagttatttggctatattttcttaattatgtcagaaaatacatagtgctttttcagtatagtttccttaggcaaacaagaaaaaacgcaagttgaagtttaccttgcaccattctatagtggtaagtaaacagtgatcttgcagcttgtgtccattgttaaagtgggaatggggcaggcaaacaccttttaaaatccatatttgattggctttctcttttaaaagaagacatacatcccattttatcttcagaagtttagacttgcgttcttccaaattaaattccaagtgtgaaacttgtactagtttgctttatgtcagctaaactaattgacaagttgataatggattatatgtcttctgtatctacaggccagtattaaagattatctttaattgaaaaatctacagtatcactattttatgtaacttctcacagatatgtactatttgtcataaaacaagatttctaggtgctagatctaaaagaacccaaaaggctttggataagagattccttcttccaaaaaaacttggagatccctgttcatagtctcaaagctattaaaatgtcagcatacatgctgatatttacttgtgagagagggctcagtgaactttgattcgcgttagtagctagagataaaccaagtataatgattatttgtatttatttttagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattaggtaagtctatttatttcaccgcttattgtcaaccagtaaacataaatctaatattacaacgaaagctctcttctctgaactatcaaagcaggcagttggttagtttttaaaaaatcagtaaatcagggaagcataaagagacatgcacaaatttcaataaataaaaagcaactttacatttattcaactgttatgtagacccaaggcattttctttggttatgcgtgtctacattggctttctaatttattgttgtgcataaactacagataatgtctacaacttccattttggatttttaaaaatggatcaagatcttaaatcttttagtggagccatctgaatagtaaagtgttagatttttatccttccatcttagtttcctctcactcataattactgtaacatgttttgttcagtaatttgcttttattaggcctttacagagcattcaacttcccttgggaacaattttacatagcaactggtataaacaggtttaggaacctgcaaacgcattcttggtaggcattgtgacactcagtggttagaagaagcatgcaggggtgcccactagacatgggtgttctagaggcataactgactgttttacagaggtaatggagagcattggacaatcaaggaagtcagttaaggaggttttagagcaattattgttgttgatgatttatcaatcagaccttctcagttttctagattacagctctgttgggaatgctgtgtttgttatcaatttgtatttggcattggcattgtgtaccatacttattaggtgtatgtgaaaaacaacaaaataagttgatgaaataatgtattttctttacagattgcatccaagacttatcagtctttatggaggaagcatggaagaaatgattccaaagtaacatgtaattgtttctaaaagaaatgtacaaactagaattttaatataaagaaatgtggccatgctttaaacctgtggtccccaccctttttgggaccagtttcatggaagacaatttttccgtggatgggggaatggtttcaggatgaactgttccacctcagatcatcaggcattagattctcttgaggaacatggcactctagatccctcacataccagttcaccatatggttcgcacttctatgagaatctaatgctgctgctgatctgacagggggaggaactcagtaatgctccattgctctaacctcctgctgtgtggccaaacggatatcctaatagaaattgatgttactaacaattagcctctagggctttaaaagtcaagatgaaatatcaattcaaattctgtttttagatatcaattcaaattcttttttttacaatgtgtttattggacacacaaaaaaactttgcaaccatcataatacatcaatatttaacctagataattctgaaataatttggattctttcatttttcaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttcttaaagtggtagggttttaaaattcatgatacaagtaacaaagtaagttgataacaaatactattttgaactgggcaaaatctagcccaatatgtaattgtgttccccttgtatctgagaggcctgtgttggacaaccatagtactctgctttcactgtgctcagataacctgaaatatatagttgtttctgagtagttctgagtaggaaagaaccaaatgtaaatttccttagagaccatcctggagaagacagttctaaatcggggcttgatttttcatctatgatcctagatgttctcctgaaagaatgactagcctttttataacgatacaaagttttttaaaaatacataaatgtcataaagtttattcctgtgtatacacactctgggttcaggaggttttgtgcttacatttcactactcaaatgccttcgcaaatctcagaacattcctcaccatcactgcaggcctgtgaacagataactttcatcaattaggatggctggctagtggcagggacttcatataaagaaatctttcccagaattgtttttccacattgccttctaatttgatcactccctataacagatgttcaaaattcggccacagctctcttatgaaggcagagtcagataaaatgatattctgcaattatctagatcataagcataaaataaatattacaaaaatgattgtatttaaagaaattttttaaaatccagaaagtcatttaaaatagaacctcatatagtatgaacaaactataaaaatattttacatttca

SEQ ID NO: 6 - DNA, 145347 bp, Homo sapiens
  mutation 124294: a/c SNP in reverse strand
attgctatttgggcaacaatatggctccttcagaactggtcgagaatttctgtggtctttgcttgaccttcaagttgggagtttcaaatcagaggctttgaagtctggaggagttcgcagccattaatccttccggggttgtgctaaaggcgtttctagaaagagatcggaaagacccgttcagcacaggcccattgcatcttctctttgaaaacgcttgtctgaatcaagtatcttatacagacccgagactgaggggagcaagagcgcaggtccggctgtggcgaggtgtccaccaccgtacttgtggtcaatgcctggactagagagccgaggccgtccagggcgggctggccagggaaccagaagcgtccctggactggctgagtgagggtgccctttccagcaacccagtggccatggttaaaaggcagaatacaaccgtcaaagaagtccccagctcccacataagagagcgcaaaggccaatggaaccaaggcctcctcgcgagaactagctcgctttgaggacaagatcctggggatggaggtggggactgacgtagtgagagggtctggaggaacagtcgtagctgaaggtcaggacatgaagaattgcacgtatggtagggatagaatggcaggtacaacttttctgtactgaaggaactgggagaggacgatccggttagggaggttggggaactaatctcaacgctgcgtttacagatgaagccgcttttatatggcgtatatgtttgcttagaggggccgacggagattaggagaagccatcctttggcgccaatgatcaaagcgtctgccaaggagaagaagccaagggatgggcctttcagagagggcaaggagtcatgctgctctggatgccagtgtcaggacaagaaatcgaaaggagcgaggactcttcactgcgtgcctcagtctccccgcttctgcctctttcacctctgtcctacttccggcgcgaaagcaggccactcgctctgatctagacctagttaacattagcttttcccttccttccctcaaatcccctcccccctctatccccgtcccttctgccgcctgaaagggttaatctctcctgcgggtaaaaacaggtccgcggagtctctaactggcgacagatgggccactttcttctggccacaaaggggccggaatggagcgctccgcggcatacaaatgggcaggtcacgtggttccaggctcttggctggaccgggaagaccatatggcgcatgccggggaggaaggaggaggggcgggggtaggggtggagggtgaggggagcggttgtcggaggagggcgggagacgagcaaggcgtggggagaagtggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaaggtaattacagttctttcatttttttgccccagaatagaagcaataactgaagactgatgaacctacatattctgtatgtgtgcgtttgcgagagtgtgtatgtgtattgagaccagcatccccctccataattgcccataagtactcacacataatgagtcgtgtcactcaagtaccccctgcaggctttctaatttaaattttaaaaatttgggtttcttttgtggatagcataggagcttcttggattttttaaaagaatgcacggtaactatgattatctgctagtgctgattttaaagtcccaaaagcaataatgacttcactttctcacttcttacagtaagaaaaaaaaatctatgttatcaatatatattttgtgtgcatgtattttacgcacattgggagtgtcaagctgtgttttcagtgaatgaaagggacatggataccttgagtattcacaccatggaaaataaatcaggttcagagatagtttagttgagaggggggaaagtggagaaagggagagggactcactcctgctacctgttaccgctccagaggcggccaagtccccagcagccactactggagccagaaattcagttgttttactaaaggctttttattttccttactagaagcggcaacttcgcggttgccaatcgctgaccattataattactcaatcttttaaagggaggtttgaggcgaactttgaaaagccccaataaagagcgggcggccctttcaatgggctgtttattagagaggagccttccgcacctgatccccggcgcgtgggagagcgctctgcgccgcgcccccagccctcgccctgcagctagcgcttttgtacaaggtggaaatttagcggtgggccagagatggaaggcaagaaaagaaaggcgagggaggggtggaagaccctgtccacttttgttgccaaatgttacattgatggtgaaacaatttggtggaaactatttttcctcctttctgcatttgcttttcagtatcccgtcgatgtaatcttcttaaaaatcgctgccagtattagtaaattacgcaatggctgttcaacttaaatcgctaagtatctggaagccaggacagaaatggaagtagaatgtgtgattttacagcttttttttttttttatggagttgtgagtaactttgaacacatttggataaacatgaagtcgctgaaatgtacagtcatttccacacacattatcctgtcgggcaaccaccataaacacatttaagttaatcactaggatacaaacacatatgcgtgagtggtgtacacatatacatattcactaccctcccccagtcctgtcctcactcctacgtactagcggggcacacgcacgcgccattataaaacactgcatttaactttttctcagaggcattcattttgtaatgggcaggtacttttcgcaagcatttgtacaggtttagggagtggaagctgaaggcgtatctggcttttgaatatagcgtttttctgcttttctttctgtttgcctctcccttgttgaatgtaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaaaccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtgagagcaattgttgcatttcttcttaaagggattctgtttttatttttggggaaagtagttgcttttttgctgagttaaaaaatactaaacactatatgtagaataaaagaaaagaaaaaagtttaccttggcatatgctcttgtctgtttatcttgcacagggagtcaccagttctatgtagataatgaaaagacctaactgatatttcattatttggaatatgggactggacggcagtacaaacagtgtgtttttttctttgttttaagtggcttagcctttaggttttttatttccatttttaaaaatgattgttacatgttttcttctatttctttttttaaaaggtggattttaataattattaacaagcaagacataaacaagtatcctagcttagtttgtctatacatttaagatgtataaaacattactattttcttggtcttctgttatctgtacatttttctgaactaaacagttttatcttgcaaactagtactgtcccagaaaaatttatacacctttaggaagtaccaaagggaaatgagttaattaatttaaagaatccaagagaagtaacattttataattgttctattaacatcttgtgatgatttccatcatttttccaagaaaaagcataatggattatttgtactgaagaacacactatttgtactgtatttaggaaggtgtaattatttcctccccccaccctttggggcactattctgttgtttcatgaacacaactcactggaaaaacttatggatgattctgtctattgttaagtccacttcaaaaaaaaaaaaacagtttggcatttcttttcctctggatgtattgactgacagtcatgattcctagggaatatcattttggcacttgtgccctggctctactgtggtgctctgattactgtcattagtaactccattgtttctactctgattcgggtgccacattggatgactaccccccttcccaagcttgttcctttaatctccttctcattggtgatttaggggttccagaaagctgacctcatttagcaagctgctccagaaaaatgtgagtaatgtaatggacaggaacaattagccatactaataacattgccaatgaggctgcgtcaagctgtgacagaagcagtaaggaatacttcgacgttaaaaaaatgtttgagagcaatttaaaatatattattttaacatgttttctatcagccttcatcacatgacagaaatacttttaagttagtcccaactttatctaaaatgcagcaatctcattccaagtgaatcagagttgttattttggaatcaagctgttgctttctatatcctggattgttctcactgttcttactttaagagacataatactgatatgatacttgaatactaccagccttccagtgtaggaggtaatgaagtgagcattcagatctgatctaacctattaagtagctcaatttcacctgcaattaaaattagacatcttcatgcaaactaaaatctgttgctgtagtgaagagaagaaataaaagaatgccattttgagaattccagcttccaaaatagcaaacagggaaatctagactgtgttcttttgtaaggtagaaatgaagactaaaagttaggttttttttttttttcttcccattttgccaatacaacttcattctaaaacatagggattctttcagtcagtcaaggagtaactcacatgccaccatcttttattcaaaggcaggcacagatgttccttctgcaggggaggatttaatttatgaaaatgatattgtttatgcatgaatgaactgcatgcactctgcataacacatagcacttccatctgatcagagaaataccacagaaccagtgccaatgtcagaaacatattctacaaatttactcacttaaatgtttaatgaatatttggaaggcattttcaaaccataagaaacattttaaattatcttcttttatgaattcctacccatatttaaaagagactcttacagtttttgtaattggctaatgcttatacccagtttgtaagaaaagaacatattttactaaatgaaaaccaaccaaaaaaaaatgctggcaagtttggcttcactggaaaaaatatttcgtttagttttgctgtttaatgcttgtcatgaataatatttgggattctatctgtttcttcatcttgagccacgactattcctatcaaataagatgcttaggtatacttgtttaatgtgaaaatcctatgaatagttatttctagaaaaagctggtatgtaaaatcagggggaaatttcataaagatgaaattgggctaaatattgtaacatgcataattactattgaataggaacacttcacataacatattttactttatataaccaattgcagctatatagtatgatctatctacttttaatcattaaaacaattatatataaattaaaatgaaagattataatatcaagagtgttctactaattttaggtttataatatgttacagtaaaataccatttgaaataaattttgtgttctaatttatcttaaaatctctctgtttttacatttgaaagtccttacattcttacaaaattaatgcattttctgaaagaagctagcaattactaaaatgatatatggatcattagctaacagtttgaatcaagctgttttagttctataattatacaagaaatttaaagtgaaaatacctattaagcaattaataaaactaggtttcaaaatattggctaattttctcctaatgggaaatgtaaaatagcaaaactgcttcttaaactacacaaaaacctcctcacttctccttttctctctctctaacaccacttatttcctgaaaatcatctaaataaaatatttaattccagggtctgatgaagaataaaagagccaatgcaacatcttgtggaacaccaggactgagaactcttgttgttaccattgcaaagaggcgttctggcgtcagatgcacagtgatttgtatggtggcataatcattggctcctggccaggcattatgtttcagaggacactattgtcaagaaccattcaactagaaatctgcactgtatgcactcaaaagttgagatcatctgccttcctatgacaggaagaattctgtgctggcaattgactcatggactctcttcacatacactaaggcttggtccagtggctctgatggaattaactgtgcagccaaactagtggcattgacaagacagggccacagtctctggggacttcaggagaaattgctaattttaaaatgcagagtattatgttaatgctggattaaatcttcagatacattaaatgtggatttggccatctaagcattattatgttatttgcccagttaatttagaggtagatggatggtgacaataaccatctctacagatccacaattctaagagatggatccaattgtgaaatgatatggagagatagagtaagttcaatctagcatatatgaagtaatttggtaactgacttttcttttaacaagatcaaaagctaacctgctttacactttcatgtctaaggacagccaaccagagagatggcttcacacactagcccactgctaagtgcttttcattcactttcatatttcatcatcaaagcaccctcctgccttatttatagatggggaaacttcaggaagttgagatacctagatatttgcattcctgtcttcctttcttcattcaggtttttctttcattgccacttcctcaaagaagcttttactgattcccatttaaaatagcaactgacttcaactccaccaaaatcactgtattgcccctccctctttccagagcatttgcctatcaaatgttatcttatgtatttacttgtatagcttaattttaaactatctatctctaggtcttctgagcacctgagaaacagagacaaagttgtctcttctgtgtgttgctgttcctctggtgcttagaagacctagaggatcctcaataaatattaactttccaagggaactgaagagcactaatgtgatgctaaagcctgttgccttaaccactatgctataagtcaaatcagttgagaatggagaggaccacaaattattttcagtccagcaagtgttataaacattaattctataaaaagaaaacaattgaaactaatttcttattatattgcatggcaccaaactccccccacttcctttttgaggatcatgagttgtctgtcattgtttctttttattgatatcaattggttaaatataatctggaattggaataaaagaaaaactattataggctttttccagaccatgtatttcaatgcatattattttttcctttctgttcattattctttcagtaattgcacttgttctatttttagtgttatgtaaaattactgtagctcataatttctattttgaagggttcagtgtataaacttagcacatcaatactatctttttagtgttcgcgctcaatggtgtcagttaagagatcaccatcacttttggtgacgtcaatgaaggggtattgcaatgcttaagagaactgttaatccctttccactggtgtcactaacaattgtagtgcttgtttattcatagcaggtacgtgactaagtaatgttaacatcaaagcagaaagaggataatagagtgttctaaaaagaaaattcggtggttgggtgcagtggctcacacctgtaatcccagcacttttgagaggccaatgggggtggatagtttgagcctaggagttcaagaccagtctgggcaatatggtgaaacctcgtgtctacaaaaaatacaaaaactagtggtgcatgatggcatgcatctatagtcccagctactcgggaggctcaggtgggaggatcacctgagcctggggaggtcaaggctgcagtgagacgtgattgtaccactgtactccagcctgggtgacaaagtgagaccctgtctcaaaaaaaaaatgatttgagataacatcacttgtcattgtttgttaactgaataatctttattctagccagtgcctaaatacataataaatgatagtacaaatggatataaattataactaaacctaagtagtgatatttatcacaatatttctttactagaagaatttctttgttaatagaggcaaggctacttgtttagataccttaaaataacataagatttttggataaataaattaatgattctttgattctgactggcatattaaaaatattaagcgaagagatctttgcttcccaggttttattttttgtctaattaactactggtgcatttatattaaaacatattgtcaagggaaaacgtatatatatatatgtgtatatatggtgtgtgtgtgtgtgtgtgtgtgtgtgtgtgcacacatatgctatacttggttgagtagtatccccttcccttgcccacctctctcccaaatttatgtccatccagaacctcaaaatgtggcctcatttgaaatattgtctttccagatttaattaagatataagatgtaaattgatacaagttcatgctggattacggtgggccctaaatccaatcactgatgtcctgataagaagcagacagaacacacagacacacagcatacaggaagaatggcatgtgaaggcaaagacagagactggagtgatgtgtctacaaatcaaggggccccaaggatttggggcccacatcagaagctgggaaagagacaggaattctcagcttctccttctgaatccctaagaaggaatcaaccctgctgacaccttgattttaaacttcttgtctccagaactgtaatataatacatttctgttgtcttaagctacccagttgctggtgatttgttatggcagccctaggaaactgataggtatactaaaatctctaatgaattgatgttaaatatatataagtataggagagttcatttaaattcttctgaaaatgtcttcttaaacttttaatgatacagtatataacaaccagtatacgtagttggtatcgggtttgacatttaaacaagctgacaaaaaacagctgtttaataaacatctgaattatataaaagttttattgtttattattcatgtgaatgacttaaactgacatctacatttagtgaagtgtgaatgggcctagccaataaactatgggtaatttttttaaagtctcatctttgaactcacaaaaaattatcaaatatcagctattatgtattcttcatgtgaagaaaatgtcatatttatttgatttgtggattagcatatatattaatagagcttttgaaagaacaaatgtagcactttcccgatttcatagacactcatttaacacacaagttcatattttaaagtacataattttaaaaaaattctagtccaaatgaatttaagtgccatgacttctaaaaattctgtctctatttttgggttttataggaccttgagccagtactcttctggtgagcttaagaggctaagacttcacctttagttatatggggctttcatctgattatttgtctattttgattgctctaaatacaagttagtgtgtatttcatctgaatgtatttcattataagttttggttttatgtagatctggggatctgtcttgtttttaatcttgattggtctgtttgttttgggatagttggtactttcatttcttatgcttgctttctttttcattttgtgcccacctttagtcaggtgaacatcagtaaggaataaaattttatttttttaagccactgaaaaaatttaaaaaccacatcataactctgcctctgctgactgataaaaatgctaacttattaagacaaaatgttatgcaagaagactttattggaatagagaaacatcctttttatgtaagaaatatcaacagagacatgtgcctttcttgtgacaaatgtggtatgtgtgtggattagaggtctggaatgtggcagcatttcagtacttggaggggagaattagagtagggtagaaagatagacggggagcagaggatgattctcacccagtagaaagcagagtgaagaaagaaaggggaattgttttttgcattatattatttgaactgtggattaagtctttccataagccatccctacgcctctaagtaggttttattaacttaagctggtttgagatgggtttttggtcacacacaagaattgcctgatacaagagaggctttgattttgttgttgcttgctcatttttatacactaagatggagaaaaccctggacatagtgaagacgaaattgaggaaggtgttgggtagagtggagggtagaagacctgtaacataggtacagaattacattaaactggaaggacttatatccagatataggagtcagggtagaaagagagaatgttagcagtaagggtaacagagtagcagaagtttattcttaccaggtcctgttatgtgacagtggaggcatgttgaccttctgactaggggagttaaaggagaacactgaaggtttagaataatgtctctaaggatagaaagagaaagtttcatcaagactcatcaataatagggcagcagggcttagggccaagcaaattcagagaccatgatattatagtagtttgtagtggtcttaatccatctaatttttcagcattttctcaatggccaatacttagcagtggtagtgttttatggcatttggacaacagaagtgaaagcactggtaagagagacgttgaagtgaaacaccatggggctcagaaaagcagagttgatccatctggtacatgggcaaggatggtcctgaacaattctgcagtaagttggaagatagaaaaaatacctaacgaacttgtagatctgggtaaggagatttttggcagaatattgtaaggctaattggcttctcttaactatatgagatagggttttacaagggagagataagcgagcataatttagaagaactatagggggtcccaggcagactctctggctggaaaattattctgatagcaagaaattagccccaaagcaaagatgaaaagtagggtacttccaattaaacatgtcataagggcaagcctcaatcaagagtgtggctagaaggcacagctcacctggacaaaagtgcttctaagcatattaggagcatataccacaataacctgacttggacccaaagttgagagaggccagtctcaaaaaaatttgagggaattgcttttgcataatatgatactttatatacatatctgttacatatcatatatatcatattaaaaagaaaaaaaaccctgtttttccttccgttctttcatataacccttctgacaacaaatgtggagtttttcacacactaagcaattctttagttcttgctggacacttcctggatgtcctacaattcaactcgattctcacacaactgcccagagtcagtgcagacccgcagattaaaggcttagccccaaaagactaccccccactttagatgtcaatcacaagtctcaacttcatttacttctgaaggacgagctatacattggaggaaacccctctttctttcaataatttgctagaatggctcacaaaactctgggaaacatttacttatggttaccaatttattataaaggatataactcagaaacagccaaatggaatagattcatagggtgaaaaatgggggagaggcatggagcacaactctctcagcacctccatgtgttcaccaacccagaagctctcagaactccttcatttagggcttttatggagctttatcaagtaggaatgattcatgaaatactggcattggtgattaacttaacctccagcccctttcccctccctcaacattgggggtgaagctaaaagttccaactctgtaatcacagggtgagcttccctggcaactagtcccctgatccttagggggcttctgaaagtcacctcattatcataaactcaggtgtggttgaaagggatgttttgaataacaaaagatgcgcctttttcctttatctttctgagttgtttcaggagctagggacaaaagactaatactataacaacaacaacaaaaaattcaatttttgcttttatctcttgggaattacaaggattttaggagctctgtccagaagccagtgatgaagatcaaaatacatatttcttattatatcacaattcacacatgtacatgatatccgtaagataagtgaactacataaagtaagctcacaaagtttctgtaggagttttgtccatttacaaacagtttgtaagctaaaagtatctgtgacaagcctcagtcaatttagaagttcatttttccaatgttaaggacatgcctgtgacacagcctcagaaggtcctgatgacatgtgcccaaggtgatcaggctacagcttggctttatacatttagggagacataagacatcaatcgatacatgtaagatgaatattagctcagtccagagaagcaggactactgaaagtggaggcttgcaggtcacaggcagattcaaaggttttctgattgggaattggttgagttattatcttaagacctggaattaataaaagggaatttatcatgcagatgaagctttaggtagcaggcttcagagacattagattgtaaaggtttcttatcagacttaaaagagtctgttctaacagtctttaggtctcagtgttgatgttaatgctggtcagctgtgcctgaattccaaaagggaggagagtataatgaggcatgtctgagtcccttttcccatcatggcatgaactagtttttcaggttaactttggaatgtccttggctgagaggaggggtccattgagatggttgggtggcttggaattttatgtttggtttacaagtttaacattaaaagcctctgtacctccaatgttttatggacaaaaagaaggctgaaaaagctacttggctgtaatcatgggccatttcttgctgaaaagaagaataaaatggaggcagaaccaaaagcccagaggctagagccaagagctgctgagaatgatgaattagggaaccactctcagagagcagatctggatgtgagataggaacattttctttctcagggtctatgaaactggcaacatatgctctcctgaatttcagaattgctatggaccagtgactgtgatatgctttctatatttttcccttttgaatgggtgcatctatcttgattatcctctgtctcattattgtatgttggatttgtgtgggacgataacatgtgtttttagttcctaggttcccagaataagaggagcacactcaaagagcgacatttatgagatactggatttttcacttgatatcataattgggtgagacttgaaagaaagtgaacatattttgcaaatgggagggatgttaaccactgacaaccacacccacagggtccactgtattagcctatctgcaaagacggctgccaaaaattccttctgtccatatatacattcccttttttaatgtgactgtttcacctgccagcaactgaagggctttatttccatttccccttgtgacttgtttgactaacagcaagaagcaaaagtaatgctattccaattctagacctgggccttaagaggcatgacagcttctgcttttactctcttgaaactcaatgtcattttttaaaagctcaggctagactactcatcatgagggaccacatgaaaagagataggcccagctagtttccacccattccagccgctccagatgagatgccagacatgcaaatgaagccatcttggatatttcagccccagctgagcttccagctaaatgtaagtacattcagttgatacctcatagagcggaactactgagctgacttcatccaactcacagaatcataatgaataacaaatcattgttgctttaagtcaatacatttaaagtttttttgttatccagttgtagatgaattatacagcctggggggaaaaaggagatagcacactgttagttgcctcatcaatattcatccccaaattctttttcctttttagtaggtctcacctcccacctggaagctgaaaacacctttcccagtctctctggaagctacagcacaggcatgttgcccaattctaaacaataggacatgataggaggtctgctgggtgggatttttgaaaatatttttttttctggttaagaaaaaagaaatgcccaaggaaaacctacaaatgccccttccattcttgcttttggacattttttgggagagggtatgatgcttagcactcctgcagccatctcggggccaacaatagaatccttgttgctacctggtgatagtgaagtagaaagctacaaagctcttgatttcttttcttttttttttttttttaaattttattattatactttaagttttagggtacatgtgcacattgtgcaggttagttacatatgtatacatgtgctatgctggtgcgctgcacccactaactcgtcgtctagcattaggtatatctcctaatgctatccctcccccctccccccaccccacaacagtccccagagtgtgatgttccccttcctgtgtccatgtgatctcattgttcaattcccacctatgagtgagaatatgcagtgtttggttttttgttcttgtgatagtttactgagaatgatgatttccaatttcatccatgtccctacaagggacatgaactcatcattttttatggctgcatagtattccatgctgtatatgtgccacattttcttaatccagtctatcattgttggacatttgggttggttccaagtctttgctattgtgaatagtgccgcaataaacatacgtgtgcatgcgtctttatagcagcatgatttatagtcctttgggtatatacccagtgatgggatggctgggtcaaatggtatttctacttctagatccctgaggaatcgccacactgacttccacaatggttgaactagttcacagtccaacagtgtaaaagtgttcctatttctccacatcctctccagcacctgttgtttcctcactttttaatgattgccattctaactggtgtgagatggtatctcattgtggttttgatttgcatttctctgatggtcagtggtgatgagcattttttcatgtgttttttgactgcataaatgtcttcttttgagaagtgtctgttcatgtcctttgcccactttttgatggggttgttttttttttcttgtaaatttgtttgagttcattgtagattctggatattagccctttgtcagatgagtaggttgcaaaaattttctcccatgctcgtgggtaggaagaatcaatatcgtgaaaatggccatactgcccaaggtaatttacagattcaatgccatccccatcaagctaccaatgactttcttcacagaattggaaaaaactactttaaaattcatatggaaccaaaaaagagcccgcatcgccaagtcaatcctaagccaaaagaacaaagcttggaggcatcacactacctgacttcaaactatactacaaggcttcagtaaccaaaacagcatggtactggtaccaaaacagagatatagatcaatggaacacagcagagccctcagaaataacgccgcatatctacaactatctgatctttgacaaacctgagaaaaacaagcaatggggaaaggattccctatttaataaatggtgctgggaaaactggttagccatatgtagaaagctgaaactggatcccttccttacaccttatacaaaaatcaattcaagatggattaaagacttaaacgttagacctaaaaccataaaaaccctagaagaaaacctaggcaataccattcaggacataggcatgggcaaggacttcatgtctaaaacacgaaaagcaatggcaacaaaagacaaaattgacaaatgggatctaattaaactaaagagcttctgtacggcaaaagaaactaccatcagagtgaacaggcaacctacaaaagctcttgatttctaatgacatcatatgggatgaaccaacccaggaacagcctgactctggacctcttttaatgtcagaaataaaatcttatttgtaaaccactcttagttgttcaggttgttgacacaggcactgaagtgcctccaaatggtgatgaataatgaggcaaaagtcaaagacagcaagtctagtgtcaaattttttgatgcctatgggtaagaagttcaagaaagtgagctattttctttctttttaaaatttatttttatttttgtgggtatatagatgtatacattagtcagctattttcaatagtgagaagggatgttgccacttagtataatgcctttttcatagctatcatagaaaccatatatacatatagtatagaaaatgaggatagatttctgacttaaactgcctatttcatttgtgtgcctggttacacctaattcaagactctacaatacagcattgctagcaattactgtgagaatatttcaagctccctatttgctggaaatacatttcatttttttgttccaagtttatgaatattagaacctatctaaaaaggagcttttaaaaacttgaggaaaggaaaagggagggcctacttttcttgcctgtgttatttcttgttactgctgattgagatgctagagatcatattgggtgagatgtgtcttagaatacagctgagcaattcacttttaacagtttccatctgagtacaaaaaactggtatgtgcagaaaacttgatattctgacttggcgggattctaggatttgttctatttttttctgtaattgttgtagggacatatggccctgtaccttttgggcagcaggagccagaatagcaggaacattctgacaaaattcccactcagcatgagagggaagcagtccccttgatacactgatgatgtgcccacttagcattacaagtgtttgagaggtggacacaactaaaactcacctcactcaaaatatatattgacacggagaaagtaaatacaatttgctgttattaacctttcttctcaccattgagacatgttaaatatctgaaattaataaaggaattaaatttaaaaagtttacttatcatgcatttaacacatttattgagcatctgttatataaatgcactgtttcaggcacaagagatagagccataaataagcagattaaatcactattctcaactgaggtactaatctgatataagagaggagacagaaataagtaaacattataaatcaactacatacttttacatggtgtaaagtgcaattaagaaaatattattgaatagaggtcaattttggaatggttgggcagggaagaccttctgaggtgacaagaagttggcctgggcaccatggggagctctaccatggtgaaaagtgttccagacagagtagacagcaacagcagaggccctaaatgagaatgcacttggcttatctggagagtagaatgaaggccagtgtggtaggacacatactaataataggagaaaactgatagaaaagagggtttgagcaggtgggcaggaattggacaacatggtgtctcatatgtcataatagaagtttggattttattctacctgcagtgagaagttcttaataaaaaaaaaattctataaactggagtttgagaaagaactatgttgatgatagcataagccctcaatcacttgtcacataaactccaaacttcagcagagactcagggagatcaaagggactaccacaggattacccactggctaaaattcagatccatggcagttggtcctgactggaattagacttccttgtctgttgccctcattgcagtgggtctgaatgtctctgtcggctgtgaatttttctccctctatctgtggcactgagaaggtggcccagacttccagagtctgtctcattggcctattacttggggatttgctgcccttcttctggaagtttgggtatttgttttcagagcatacttaaaggcctcctgaaagcaatgttaacaatagcaggatatattttacagtcttctactcagacttggatttttaagaaccagggatggagactgtgtttccagatctagtcaaatcccttccaaacataaagcaacaaagtgccttttaaactaggacctgtactgtttaatgctctggaaacaaatacccaagcttcagccaaaggagggaaagctatgttcaggaagcttcctgaaagttttttgaaagcaattttcatgcattagtattttacatatatatatatatatatatacacacacacacacacacacatatatataaacatatatatatatacacatgaatcactaatgagacaattgatcttcaggaactaacgtgaaataattggggtatcttggtattattgttatagataaatgttgaagaagttcattctttcagatattaattgagcacttactgtgtactaagaactgtgatagatactggggatttaatggtgaacaagataaattctctgccatcagggggcttatattctaacaaacttaaaatttactgagtgttctctgtatttcagtattgttactaagtacactaacttagtggggaagctagacaataaacaaagaagtatgtaataagaattaatagtaagtgctgtaaagaatactaaagcaggttatggtagagagattaatggcagcgtgaagatgtccatgtttcaatccccagaacctgtgaatatgttaccttacatagcaaaagaggctttgaaaacataattaagggttatctgggcaggcccaatgtaatcataagagtccttatctaagacgggggacaaaggtcaaagacagaggaaaagagacgatttaaggatagaagcaaagaggagagatgttagactgctggctttgaagttggaaaaagtgaacatgagccaaaacaaacaaaacagaacaaaacaaaatccacaggtgacctttagaaaaggggtccccagtctctgggccatggaccagtacctgtctgtggcctgtttggaaccaggctgcccagcaggcggtgagtggtgactggtggacaagcaagttttaccacctgagccctgtctcctgtcaggtcagtggcagcatcagattctcatagcagcctgaatcctactgtgaactgcacatgcaagggatctagtttgtgctccttatgagaatctaatgcctccaaaatgctcaccccttcaaactgcccccatccgtggaaaaactgtcttccacaaaaccagtccctggtgccaaaaaggttggggactgctgctctagaagccagaaaagaggagatatattttcctctagagcctacagaaggaatatataggcctgctggcaccttgattttagtcctgtgaaactgattttggatttctgacctccagaaatgtaaaacaatgcattggttttgtttcaagtcactaaatttgtggtaattagatacagcagcagtaagaaatgaatacacaggtttacaggatggtgaattatggagggtgctcaggaatggcctctttgaggtggtggcctttaaacagaaaaatgagcaaagtgaaagaatgaaccatctggtggggagaaaagcattccagtcagagggaacagcaaaagcgaatgctctgagaagggattattcttctcaatgtgtttgaggactggcaagaaggctttgtgtgaatgagcaaggggaaaaagttagtaggtgatctcggagacatagccagggtccagattataaaggacctctcgccttgctaagcattttgactttattccaagaataatgggaagtcaatggaaggctgtgagcagggttatatgctctcgttattttttaaaggcacaatgtaactccaaaatggaaaattggctctgggctggaggtgccagcacaggggaaaccgaaagcagagagctgggttgggagagcggagactgaagttgtccagctgaggggtgcagaagtgcagactgcaatgacagcaggcagaaaggactatatgttctagacagaatggacaggatttgctggtagattggattgaaggcatgagacaaaggagacatggatgatatcaaggattttgatactacagatttgaaacattctgagagggacaggtttgtgatggaaaatcatgagtctggttttagatatgttttagaagcttattggacagccaagtagagatgtcaggtagggagctggacataatacctaaagttcaggagagtggttggagctggtgacatcatttgcagaaccctggatggtacataaagcacgggacagtgtgtggatagatcctaaagagagccctagggcactccagccctggaagaaggcagcttatcaaaggaaaaagaaagaaagaaggaaacacaatccttattacttccatcttcaggacaattcaaagccagtgtttttgacttcctggcttgagtgaagcttgaaaaatggcaacttgcccctttgcaaagctcctaaggagtagccattggcttggcctgtttgcactggctctgggtgagcttttaaaatgccagtgagctctaattgtgttgattgcctaacagctgtgaatacaagatgctgactccagaactgcaactcattctgcgaagggcaccgtccttttccctctaatgactgctgaacagagccacctgaagcctgcatggggtttagcagcagctgcacttctgctctaagaaatagctcactgcagtcagatcaaactgaagctcttccttgcttttcctcgaagcttgggtacttattgtcggagcattaaacagtaagagtcctagcttaactggtgcacagtgctttatgtttggtagggatttggttaggcctacaaaccgtctgagctaagaaccttgagaaactcctgctatagttagctctttctgtgactctgcagtgtgaccaggaatgaggacagaattaagaatttgctgcctctatgatagaactgtttaggcactagaacactggaactagatctacaaccctatgaatttaatttccttttcaactcccctactccttcttttcaatatgatgataatgatcttgtttaaaaaaaaaaaaagccttctgctttacttcccactctgctcctcttcccagggactcactttcttcttgactgcttccccattacaagtactcagctccctgttttatcaccctgcttagagcagccattatcagccttggctgaacattggaattacctgggaacttttaaaaatccggaagtctgggtctcgcctccagagattccagcttagttgtcttgagcgtggcctggacatttgggttttcaaaagttccctatgtaactttaatgtgcaaccacaattgagaatcactagcctccagactctctgtgttatcaaaattaatgagcagctgattttagaaatctcagttatcaggagaaaagggtgaacccccccagggctcttctccttttccaggtgacacttctttatggcagtgcgtgaaagtgaagccctgctgcttgtaatctccctcaagggagtgcaagatccaggcaaagacaagactgcagaggcgctaccttgggggaaagtaggaccctaaatacttacacctggaggcacttacctttaatactgaatttgtcagatgcaaatttgtctatgcaaaccagggccttatctctagcttcccctcaggggttttgggaagtgcgctactactctgaaacagggttgtaaagcgtcacctgtgctctccagggaaccctctggaaaggaggtggaaaaacagaggcttccacccttgcaactctaagtgtgttccttggccagtgggatccatcacctagtattttcttagatatgtggtatctgggggccagtcccacacctatgcaataagaatctccatttgaacaagatgcccaagcgattatatgcaagtttaagattgaggagggctggtttaactcgagggtaacgaaaagtacgaaatcgtactttacaggagaagctaggcggagggagccacttattcttcctcttgcagctgggtctttttgtggtgagtggcgaagcggcgaggctggcaggccagggtgctggactgggtcaggcgcggccccgcctccctcctgggtccctgccctgcgcgccgttgctgtggcagcgctggacgcggctagagctggggctgccgcgccctccacctccttctccaaaggcctccccggacccctggctcgggcccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgagtgcccggccccaagcgtcttcgcctccctccgcgcttcctccctctccccggcccaaggcctacacccacgagcttttgctccaccctccccttttctcgcctcccctccccgtgctcgcctcactgcccggacaggttaccgagtccccaagtcgccgcctcctccttcccaactgggaactcacgcctctcgccccatcccagaacccccagggattctttcgctacctagccttttcccgcctccgagaccttccccgggcaaacgtcacaagcagcttttgctcagagtctcagcagaaaatcttgagccccaaaggggaggtaatttacaaatgtgagaaggtcaactactcctcccctccaagttgaaaaagttttaatccattaactttgatggtacattgaaactataaacatctcacagattatgcctacacaagagttctgaatccaactctcattttgctgacttgaaaatgtaactccagagctttgggagtgtttctgggtttttttctgcccctcaccttccttgccattgtctagaattaagacttcttcaggctcggtctagaaacttttgatttttaatattgaccctagattattggatcacagttttgcgatgcttagttacgtcaagcggtttgcttaacgtttgccttttattgacttaaaattttagttacctaaaaaagttataatgctgtagtttacaacaaatacttcgagtctattttcacgtcttagtcaaatagccttatagacttaacagatattttataaagaccattttgcaagtcttataagtagactttcatatagtcttatttctaagtccaaactcgagaaatactccccattgttgaattagcttagatgtgagcggtgaaagacagatgaaatgggggaggaactacatcaaggttactctacttgcgaggagatgacttgggggagatggaatttggtattcaacctcttttagctaaatacaaatttatgaaattaaaaaaattgccttcccctgttggaaaacaagacacagtgtggtatttatgttacagaatagactcactgtcttaaagtcttgctcaaaagtctaacaaaatgaaaccaactagccagggattcagcactggttgcgattgtgaattctgcctgtgctgcatgtgccatgctcgctcgcttcacgaaaacagtctttgaccttaaagtgttttcaggtgttttaaaaaccaaggtgtagtattttcttgaaccttttaagttaaaagctagggatatagctatggaattatttgtaagtctttcaggcaattcgagttatgcaatatagaagtttataattacagtttggattagcccaaagagccagtttaacctacagtgcagctgaaatgctatagaattaaaatgagacattgtgcaatgagaggtcatacaaaccaatgttgcagtatttgtgtacaaaaaaagcaaacaatgacatgagaaaagaaatgctgttttatattgagtggtgattaaggtaaaataggtttaattagtgcacccctggcagtagagtttaaaatacatcttgacagatttgtaactttaaaggttgcaagtactgattctttgtttaattatgccctaaaaccatttggtggtcttttccttcatacaggtgtaccctttttctttgtaattaatacctggtattcaaaccactttgggcctctaaaattgggggcacagaagcctagagccttagtaagtacttctgtttatggaagaaaccaagagatgttttatttaggtaaaatatagccaggcgtggtgtgtccctgtaatcccagctacttgggaggctgaggcaggtgaattgcttgaacctgggagttggaggttgctgtgagcggagatcacaccactgcactccagcctgggcaacaagagtgaatctccatctcaaaaagcacaacaaacaaacaaaaacaaacactgggaaataagaaggagatattaagagatgatatatttaaatgttagaaatgctctgttgttgaataagcttagatgtgagtggtaaaagattaaatggaagagggagctacatcaaagttactgtacttgggaggacatgatatggtaggatgtggtggggggagagcatgtccattgctggttggcaagtgactggctgcctcagaaaaggatgagggtgggtaggggagatcactggagattattagaacatacgtatgttttcaagattgcttagtttttaaacctcatagtactttgttttcactgatgaaataaaatactatgtgatctttttctaattttccatcttgagtaataagcaaagacattaatgtattttatgaaggctctgactgccaaaattgggacaaattgatggtcttgttggcagggtaaatgagcataaccgtagtaattgtagttctttttattgggttcagggatgacctggaataatggatgtgttattacccttccctgtagaagtgaggctttcgaaaagaggctataagtcaatttgggaggcacaaagtatcagcgctttttggggattttttttttttttaagtagagaaatattttaaatgtgtgatataaagttatgcatgtgcttcttaagcacattaactcaaccagatccaacagctggtctaataactttttaattgtttaaaaaaatttaattgacacattgtaattgtatatatttatgagatactatttgatgttttgatatttacgttgtacaattatccaatcaaagtagttagttatccttcacctcacactttcattatttccttgtgggttagaacattcaaaagactctcttctagttattttgtaatatatagtattttactgttaaccatagtcaccatactatgcaacaaaacaccagaatttattcttcctacctagttgtaactttgtgtcttttgactaacctctctccatccttccttctcccctccccttcccagtctctggtaactattctaatctctgccttatctatatcaaccttttataatagaaaaagattctacatgtgagtgacatgtggtatttgtctttctgtgtctgggttacttctcttaacacgatgtcctccaggcttagcattcacaattgacaggactttattttttaatggctgactagtattccattatgtttctgtatcacattttctttattcatccattgttgtacgcttaggttgattccatatcttggccattgtgaatagtgctgcagtaaatatgggattgcagatctcttcaacatactcattttatttcctttggatgcatacctggtagtgggattgctggatcatatgatacttctatttttaattgttttaggaacttccatgctgttttccatattgactgtactagtttacaatcataccaccggtgtgtaagtgttcccttttctccatatctgtgtcagtacttattttcttttgtctttttggcaatagccattctaactggagtgaggtgtatctaattgtggttttgatttgcatttccctgatgattagtgatgtcaagtatcttttaaatgcacctgttgatcatttatatgtcttcttttgagacctatcaattaaagtcgtttgcccatttaaaaaatcaagttggccaggcacagtggctcacgcctgtaatcccagcactttgggaggccgaggcgggcagatcacgaggtcagaagatcgagaccatcctagccaacatgatgaaaccccgtctgtactaaaaatacaaaaattagccgggtgtggtggcacatgcctgtagtcacagctacttgggaggctgaggcaggagaattgcttgaacccaggaggtggagattgcagtgagccgagatagtgccactgcactccagcctggtaacagagtgagacttcatctcaaaaaaaaaaaaaagtcattattattttatctgttgaattaattttcttatatattttggattttatccctttgtcgcatgtatagattgcaaatatttttctcccattctgcagctgttttcactttgttaatagttttcttcaaggtgcaaagttttttagtttgatgtaatcttattttgtctatgcttttgaggtcttattttaaaaatccttgctcaggtcagtgtcgagaataatttcccttttttcttgtaatttcatagttttcaagttttacattttaaatctttaatctatttttatttttgtatatggtgagagggaggggtttaatctcattcttctgcatgtgaatatctgattttcctagtaccatttgttgaagagactgtctttttcccagtgcatgttcttgacatcttaaaaattcagttggctgttgtaggtgcaaaaatttatttctgggctttccattttatttcatgggtctgtctggttttatgctagtaccatgctgtgttgatatagttttatcgtatatttcgaagtcaggtagtatgatacttccagttttgttctttttgctcagggttgctttggctatttggggttttttttgtggttctgcatgaattttcagattgtaacatttctgtaaagaatggtgttggtattctgatagcaattgcattaaatccatagatcactttgggtagtatggccattttaacaatataattatttcaatccatgaacatgtactatcttcccatttattgatgtgggaagataatttctttcatcaaagttttatacttttcagtgtagagattctttcacttccttggttgtttatttctaggtatctttttttttaaaaaagtactataaatggaattgttttcttgatttttcacatagtacaatattagtgtatagaaatgctactgatttttatatgttgattttgtgtcttgcaactttactgaattctaacagttcttttgtggagcattttgggttttctatctataagatcatatcttctgcaaacagggacagtttgacatgcttctttctaatttggatgctcgttacttctttctcttgcccagtttatctggctagaactttcagtagtatgttgaatagaaattgtgtaagtggccatcctttccttgttattgatcttagaattgatctcgttattggtcttttcccattcagtatgatgttagctgtggatttgtcatatgtggcctttgtgttgaagtacaaactttccatacctaatttgttgggtttttaatcatgaaattatgccacattttgtcaaaggcttttaatgcatctattaaaatgatcatacagtttttgtctttgttaatgtgtatcacatttactgctttgtgtatgttaaaccattcttgcatgcctctgatcccagtgatgaatcgcacttgaatgtagcaagttatctttctaatgtgctgttggatttggtttgctaatatcttgagaatttttgcacctatgttcatcagggatattgtactatagtttcctgtgttgtattgttatctgattttggaattagggtgatgcttgactcatgaaatgagtttggaagtattccctttgcttcagttttctgaaatattttgagaggaattgatattggtttgttaaatgtttggttgagttcagcagtgaagccattcgtttctgggcctttctttgatgaaagactttattactgattcaatttcctcacttattattggtctggtcagattttatgtcttcctaacttaatcttgataggttgtatgtgtcggggacttcgttttttctatgttatcaaatttgatgaaacttgttgaaaaccaactctaaattttgttcatcttttgaaattatttttagtctctatttcatttatttctcctctgagttgaattacttccttacttctaccaactttgggattagtttgttctgttcttttttttctttctttctttttttttgagatggagtttcgctcttgttgcccaggctggagtgcaatggtgtgatctcggctcaccgcaacctctgcctcctgggttcaagcaattctactgcctcagccttcctgagtagctgggattataggcatgtgccaccacacctagctaattttgtatttttagtagagacggggtttctccatgttggtcaggctggtctcgaactcccgacctcaggtgttctgcctgccgtggcctcccaaagtgctgggattacaggcatgagccacaatgcctggccgattagtttgttcttaattttgtagtgccttgaggttcatcattaggctgtttgtcagaaatctgttgtcttttttgatatgggcatttaatactataaacttacctcttaaaactgcttgtgctatgtttcgtaggttttgttatggtatattttcattctcacttgtctcaagaaaaattttaatttcctttttaatttcttcactgacccattggttgtttaggagcattttgtctccatgatttgtgaagttgtcagtttttctcattgttgatttctagtttatttcttttctttctccttccttctttccttccttccttccttccttccttccttccttccttccttccttccttcctccctccctccctccctccctccctccctcccttctgtattgctttgtctcccaggcccaagtgcagaggcacgatcttggcttactgcaatctctgcctcctgggctcaagcaatcctctcacctcagcctcccaagtagctgggactacaggtgtgtgtcactgtgcctacaggtgtgtgtcactgtgcctggttaaatttgttttttgtttttgtttgttttgttttgtatgtttagtagagatggctttcgccgttttgccatgttgcccaggctgttctcaaattgctgggctcaagcaacctgcccaccttggcttcccaaagtgctgggattacagccatgagccactgcacctggcctgatttctagtattataacgctgtggtcagtaaagatacttgatattatcttaatcttttaaaatttgttaagacttgttttgtggcctaacatgtgatctctcctcaagaatgttccatgtgcatttgagaagaatgtgtatctgcagctgttggacggaatgttctgtaagtgtctgctaggtgcatttggtctatggttcagcttaagtccaatatttcttgatctctctgtgtgtgtttgtgtatgtatgtctagataatttattcattattgaaagtgggctgttaaagtctcttactattattgtattggagtttatctctttaggttgaatatttgctgtatgtatctgggtacttaggtattaggtacatgtatgtttataattgttatatcctgttgttgaattgatccctttatcatattatgaccttctttgtctctttttacagtttttgacttaaagtctattttgtctgatatgagtattgctactcctgctcacttttggattctgattgcatggaatatctttttccatttcttcactttcagtctgtctttaacggtgaggtaagcctcttttaggcagcatgtagctgagttttttttccagtcctgcagctactttatatcttttcattagataatttatttacattcaaggtttttattgataagaacttatttctcccattttgttacttgttttctggttgtcttgtagattctcagttcttctttctctcttgtttacctctgtggtttggtcattttctgtggtcctaagctttgttttccttctatctcttgtttatgtatctgttgtaattgctttctttgtgggtaccatggggctaacataaaaagtcttgtagttataataaactattttaagctgatagcaagttaactttggtcacataaaaatactctagacttttttcctccgccatccctaatttatatttttgttgcctttatttctttagtatgtgttccctagccattgtagctgttgttgtttttgaccagttgtactttaaaccttcatctagaggatcgacaggtttacatagtaacatgatatcactggggaattctgagttggatttatacatttacctctattggtgaggtttatattctcacatgtgttcatgatagttatcattttttcatttacagctgtagcactcctgtaaacattgcttgtaaggctggtgtaggagtgaattccctcagcttttgtttgtctgggaaggcctttattctcctccaggatagttttgctggatatagtatcttttgtccttggccgagactcgtttttttttgttcttttagcatcttgaataaattatccctttctctcctggcatacatcagtaatttaatgttactgatgagaaatctactgatagtctaattaggattcccttacatgtaacttgatgcttttctcttgcagattttagaattctctgtcttcaacttttgacagtttgactataatgtgccacagagagaatctttttgggtttaatctaattgggaatctttgtggttccttcatctggatgtctatatctcccccaatatttgggaagtttttagctattatttcattaaataggttttctgtgcctttcttcaacttttctccatctgccagttctataatgcaaaaatttctttgcttagttttttttaaactttgggttatttcacaaaacctattttcagattttgaaattctttcttctgcttgatctggtctattcttgaagctctcgattgtgtcttttattcactgcattcttcagatttctgtgttttaaatgatagatcttgttttaatttctcattttataactttcctgatttcattgggttgtttgtattctcttgtagcctgctgaatttttttaagatcattatttttaattttgtttcaggcattttataaacacccttttctttggggtctgttactagagactcactgtgttcctttggcagtgtcgtgtgtccttgctttttcatgtttcttgtgacatctgcacatctagtggaatagtcacattttccagttgtatgcagtagctttcacagggagagacttttcctgtagatgggtcctagagtgttggttgggtatggtacattggctttggtttggggtggattcagtaccatggtctctgtgtagtttcgtcagctgtaatcttcacagcaatgtctgatttcctcagtggcctaggctgcaggagtttttgatggtggtatagttttgctagggacaggcatgtcatgctagttgtcaggctggacacttgcaggctcggagggctgacaagctgtcttttgggctccccagggaagagaaagtatgattttccagcttttcttctatgtttatttaaaactttgttgtctggctcacagtgttctttatctaaagtctagccagtggtggtggtcatattgcaatcattattacagcttcagactttctagaccttttccattttagtgaccttcagccttcattcgcttccattcatgaccacagaatagatgtagtcatctctattgaaggcaaacccatcccatctcttcagcttcatctagaaatttgtttcatctgttacactttctttctttggtttttagccttcattctctaccagctctttcacttaagcagagatatgttcaagactctcccattctaacagttccctgccttgatcctacaagcttttctctttagctgctaccttgctttttatttttatttttttctcacttgctctgataatctcctagaaaaattggcttactctgaccatctccattagttcacctcttaattattcttcaaccatctgagacctggctttgttctttctctactgaaactcttcaggcagagattagcagaagtcttctaattgctcaatgaagtggaaattttcagtccttattttctgtatttctccttcatttgactttgacttaactctcttggtttttgtaataccaccagcacctagtttatcagtctctcatgggaacttcattctatctgcctgccaaatggtggagtcccaaggactgtggtctgatctgctgttcctcattacatgctttctggtcagtattgcacactgtggttctcatctaccatcatctacctccagaagtgccatatatttagtaagtttacaagaaaagcaactttccttgctccgtagactaactctgatcttttgttccctatcatggttatggaactcactaattattcagcatcagctgtcagaatgtttaactttgctatttaggtttgtgtaagttatgggacaataactaggataactagaattagcttgtagcttatgtgggttagataatacaattgcatatgtaagtagtgaatattttggcttaataagtgaaggagtatttaggaagctatctggaatgttatctaagtcaggattctgaaggtaactctagcctcactgtcccttactcactatttctaaacacccaccaatcctgcctactttatttacttggtatttctccaatctgccatccttctctgtccgaccaatcactaccctagctcaggccttcaaagtctctcacttgacctactccttcacctcctttgaacctgtgcacaaatgttagcttcttagtaaggctttctctggtcacctgtataaaattcccatctgctacatacttcctggttccctgtattgccttatattcctcagtggcatttatctccttgtatactatataatttctgatctctgtcctttctattaccaccccacttcaagatggcaaggatttgtctgttatattagtgactgtcctaataggaaaaaaaatggcacatttatattagagtaacttgagaagaatttttaaaagtcagtatttataaagctgtagatatagagatagtgaagtactcttgggactagtaatcattgggcaggtgataccatttttaagcccaaaagggcatagtgaaagagcaggtgcctgaacctggattcagagagactatgtagaggaggccactaggcaggagctgtggcctttgcctcagcttggctgattacctcactaatcctcactaatcctaaattacccaagttccttcttttctggcccatttcacagtccaaagccaactttaagccagagggcaaggggagcacttgatgcagtccatgcagtatggcctcccagtgaacagggcaggtggaggatagaaactaaatctagatggaggagagggaagatattcagaatatgttttttctttactgtcagcaccttgaagagtgcctggcatatagataatatttattgaatgaatgaatttgttactggtttactggcctcatgaactttagttttgcctattctattataacttggtgactacattcctatatacttgataccaactcctcattaactacaaaggcagtattcccctctccccctttttaaacatcaaaactcttttttaaaaaaaattcttaaatgaatcgccagtatataacacataaaagtatgggtgccttgattggagtggtgggtaaatgatcctgagtctgtctgtttgggttccctctttgcctagcaggaatgtgactgtcttgtttaaagcccactgaagtagaaaacaggatgagagacacactcttcaacatggcataagatttccatgcttggctcctgcctatctctgcatcctcatttctcagtagtttcctcatattttaccatcctgtaattgaaagaattacaaaactagttctctacacaagctttcttgctgttccagctgctgggaattagcttcctttgtgcttttttttatttgaatgattcatgtttacattcattaaaattaatgaagattcattacagttgttttctctttaggcataattggatctcctatactgagacattgaatgcaactttgattgtttttttcccccattatatgttaagctccttgaggttcttttcaactttgcgttattccaggatttctatcgtaagagttaaggttcatccacttctctgatgtgaggttcatggcaggaaggttccatgttgctcagctgcagagtagaaaatactgagcagggcttaaatagattaggatgctgccattataatataaactgtgtttacgaaagagcatcatcaattcagaaaatatctttttcattgactacagtggtgcctgatgatctttctattacaatcttaaattatggtcattttaattatagaatcatacatgggtttatttatgttaaaataaggtaattatcaagctagctgtgacctatgagaaaaatcctgaagaaatgatgaagggatcaggtgactgtttttgaagtcaagtgtgaaaggtcagaccactctgggtcatgggaccctgccaaggcagagcaggtcaagtgctgtgcccagtggggccaacccccagtatggtgccagggactgggtgtgagaagtcaaaaattaagaatacacctcagaaaggggacatggacagatgccacagacttatttgcgtatttcatgatttagcccttagcttgtgctgatactggatcagatattttcagagttcagtattttcaaaagcatcgctgatcacctgttggcattgttttacatctcaaccaaggaaaaacttttgggacatctgtttaacaaggggtaagcttttatttgaaatgttcgattaaagcagaagagtcaggcatttttttgtgcctccccaaagaaagatttgtttactgtcctgtgtgaataaatataatgtcattatttcccgtaaaggaaaagctgatggggagagtaagtaatgggtaagattaggcaatgttaagctcatatattagtatgtttaagagtgatcaatttagggatctctgtgacagagatgccaaatgctcacagtgctatctcatgttggaaacatgtgtctcctccacttttcctcagtcctctgaaatgacggccctttagggattgacagatactatacagatttctgtgctgatatgtgatttgtctaaaacaaaagtttcacaaaacaattcttaccattgccatttaagagtcactctgatatgctctgtttccattgcaaacaaatgctcattatgatttgtgaaattaacttcacaatttcctaatggataacaccttgaagtatgaaaagcactacaggatcttttatagcttccctcctccagctctctataatctgctcccatctgtggtgtaggaaagatttcagcagtggccgctgaaggccctaagatcttgtctcaacagatagcaaggtgcataacagactttggacaggttgtttaacatgtctgagttactgtttattcactggcaaaatgaagggcttatattatattgtctctaagtactatcagttctgaccacctatgaactttcattttaaagaaaatacctatttctatggcctttaggcattagggaattttgtcaaattaaataaatctcagtaaggtttgatggtcaatggggcccactgtctggtgtgtgtggaggggtgttgtattttacatcaggaacttcagagccctcatgaatttctaattagaggaaccacctgggaaatataagtcaaagccctttgctcgccttactcagctttagggcacagtgactagaggtgggcaatcgctttggtgtaggtattgtcattggaaaggaagaaaccattttctggaggaaaagaattggttgaggctagctttaagcagctatttcatgatggacaaaaggactagctcatccattcttcattcgtttctctgtatcctctatcaaatttctgagtaaagattttatacaatgcttgattagcattcaaatagtatgtttcaaagattttaaaaaaaataaaactaggcctttgaatcataattatggcttataactctatttttcatatacttactatctcaagttacaaatttcatgttatgtttttttcaaaagagtattcctgccacaactcagagctcagctgaattagagcagtgactagaaaatctgagaaggctgagcttcaaaataaggtctggaaagtgtttcttattgttacaagagagtcaaaatgattttcttgagctttaagtttatgtaagtatttacttgacacttagcagtttaaaagataatgtgcaaaaatatgaaaatgagaaaaaacaatttcaaaacaagagttggtgattacgtgagacttagtagagcaaagtatattctaagtattaatctgtctaagctgtttgggaacagatgtacgtgaaatggataccgggtgttctgttgtgtacaccccaagtgagacatctgttggtagactgtgtggtcagaaataatggaagcaggggttaaaccccaatatgacctattactcatgtgaattattgaaggactaattactcagtaaaacatgatgctttgattcatcagtctacacgttaagaaaaaagcctctttagaaaaaaatttagttctgtttctaagctgtcaaatttgaggaaatttttaagatgtatgcaaagactcaaatttccatagtaactgcaaatactatctgcttataaagttttaaaatgttttgacaggtctactaatttatcataaaaatagcctcaaaagttttagctttttgttagggtaggttgggtctcacagaaaacaaatgtagagtgaattttctaaagcagggctgtccagttagacttcctgaaatgatgggagtgcactatatctgaagtgttcaatacagttaccaccagctacatgtggctattgaacagaaacatggctagtgtgactgagaaactgaatttttaattatatttaatttttattaatttgaattcaataactgcatgtagcaagtggcaactgcattgtacaacacagctctgacacatggagagttgaaaatgtttgtttactttcttcccaagttttcattttagtctttgtttctacatagaaaggaagatatagcttttgaaaaatgaacctgaatgtagaactgatatggttatgcaatttgagctgcctatttaaagataaagcaactgagtttagagatttcaaagtggcagagtcctttaacatatttcgtgggctggccacggtagctcatacctgtaatcctagtactttgggaggctgagatgggaggattgcttgagcccaggagttcgaggccagcctgggcaacatagcaagaccccatctcagggaaaaaaatatgtgtatatatatgtatatatatatatatatatatatatatatatatatatatatatgcatacacatatatacatatatacacacatatattaacatattttgtgtgtacaaaaaatatttttattatgtgtagattagttggttactagtaaagttgaagtcttgtctatagaaatcattgtatttttcatggtcattgtgatacattgtttgaactgaaatttggcaaattcaatctgtttcttactacaagaatagtacatagatttgaaatggtaactctcttagtctgtgtactctgaccctgtgaacgtctggagactaatgttattcctaaatatgctatgtccacatggcagcatctgaaggcaaacactttttaaaactgatctacttttgtggacccttcctctctctctttcctgcatcccggatggggccctctggggctggaactggcacagaactattcccctaggagtgggttcattgaagccaagggacacacaaattgagaatcagatagactggaccaaggtcattaaaccagagagggcaatccagatggggttgtccaaagtaggaagttctgaagtgaattgcagaaatccaaacatggcaaagctaaaggaatagagaaccagggcaatggatatagagaacagagcaattgggtatgcaggaagatgctattgcctagactggatgtttttgtaccctctgtaatttgagaaaatggaccgtccttgttgaaatggtcagggatgtagtagataaattcattgcagttgtgtaatctcagcactagaatactgatcataaccatatcacttgttatcccacctagcctgccacttgattgggttattagattacatttcagacattgacaagtctacaagcatcattaaaatcctaaacacagacttctgaccgtattcctacccaagttttagaagcactatgccaatgacgggggtagtatatgctgagcaggtgagttttgattgtgtgtgtctacatgtgtacgtgggtgtggtgagcaacaggaaggaactctcagccatgactctaaatgctcttgtgttggccaaaattggtataagctaggaggagaaacacaaaggagagagaggcatgaagttgaaggacattaaaccatttgcaaacttttggcatgcaaaccagaatatgaggaaacttagtgtaatgggtgactgaattcagaggtagacaggcaatcaggaaggtataggcaccaaaaatagttaccattggtgagcgtttttgtttttgtcattggcatggtgttatgaacttatgttaagcctaagggtaagtctaaaataatgtaccagctggcatcagggaattcccatgtacattcctagattttcattagaaacagtgttctggaaactaccactgctgctacacagcagtgcccagtgcttgactgaaaatagtgaacacttagatttgtttactctgccaggttctgtgctaagtatcttatcttgtttaaccttagcaaagaaactatgtagtctagatagaatttttatccctagggcccagaggtgttaaataacttgcccaaggtcataccagtaatttcagttgctggggttcaaagctaggcagtctgactccagagcctgcactgtccccatttggttatgttgcttccccagttaagcaagcaagagtctatctgacatctgagttggtggtagtaaagcatcatggtctgaaccaaaataataaaaacctttgaaacaacattatctgacttctttcaggcttttaagacagttccatcatcaacagcttattccatttctctggccacttccagtttctgaacaaatgaagaaaatgggagtgataaattggagtttttaacaagtttttttaaatctaattttttttatggaaaccaccaaacatacccaaatgtaggaataattatgtaataagtcctcatgttcaaccctaagaggggtgaagctctatgtgacccattactgagtttaaacagttttcaatttatggccagtcttatttcatctatactctacccacatcccttcttcccctggaatgattgaagtaattcctaggcatcatataatttcatctgtaagcatctcagcatgtatctctaggagataaagattttctaaaaaatcatattactactcttcaaatttaaaataatctttatagttttacatatccagttagtgtccagattttcctgatattttctctattttttaaatatgtcaaccttgaaatgaggtccatattatagctgatggctatgccttttaaattttctcatccacagattcttcttccttttttttcctttcaatttatgttttgaacaaactagtttggcctatagtttctcatgggcaagaataaccttcagactgggatggccatcactctgatacccgtaaaggggatgaggcaggttggggaagggagagcctcagaccatgatcagatgtcacaagatttttgcttacctagggtgaggacttgggaaaaagattgcccattaggagtcctgccttgggcaaaagtggccaaacttcagctgtgctgtcacaggctgtgggctgccttggaaatgtaggacctcaactcctctgaagttgaggtggagcttgagggtacgaatccctggtggccattataatgactacactcattgggatggcatggcaagttcatcctcaaagatggatcctagcatccaccatgaccaatgaggtttttttattgttatgatcactataaactcaaggatttaaacctattaaatgtttttcaattcacagcaatgattatttttactgatcttcaaattgtcacattttggatttttagaccaatgggagccccttcatcttgacttctgagttcttttgacattcactcagctgtctgatagcttccctgctttctggaatggcaagatattccaggttcatcttgaacatttcatgcttgagatatggaatcaagctcatcatcagagggtcctggttccttttactggatagtggtattagagacctcaatttgagaactaagcaacatcattgctaaaacttcccctatgtgtaccttgttacttaggtttttcaaagaacagagctagaaaatatgttgggtttttttgttttgtttttaaagaaaaaatgtatcataggattatgctgatacttccaattcaagtgcaggcctaagcttttcacattgtctcttttctcctacccttaaagtcctgattcctaactataacaacatcattactcatttgctttatcctgcattatgtagacacaatagagtaacaacaccaatgctgccaatcaaaagtataattactgaaacccacttaagatagtcctgcaatttttttttttgttcatagagtgtacactactagggaggtgtagtcaaattactatgttttaaagacacttggaataattcatatctgtgaagttatacccccaacttatttgttttttgtattattgtttcattttgcttttgatgtttaggcatttcttttttaaaaatcaattttataattacgtgaaatacttatatggttccaaaatcaaatctactaaacaaactatattctaggaagtatagcttttatgtttcccttctatgcttttccttccttcctgtaggtaggaaagcttatttgttcctcaaagctctgggttgttcttttattttatataaataaacatgtgcatatattcttttcattacccccacagtacccaccgtcttaaacacatgtacaatatatgtgtttttctaccttgatttctttcttacttagcaatatgcccagaagttcactctgtagcgctttacatcagcatcaaaatccattatgtactatcgtttattgacctctctgttggagaaatttggattgtttctagtcatttttgttatcgcaaatagtggtttaataaaaaactttactttccgttttttgtttttcaatgtgcttttaggatagatgcctagaagtgagattgttgagtcaaagaataaatgtgttaataattttgctcaatattaccaaattctttcaaaagggttgtgcaattttgctttttaaaatcattattgtataagggcatgtatttcctgaaaatttctccagaagagtttattgccaaactttaaaaaaacagcctgatacataataaatgatatctcagcatagtttaaatttgcatttttcttgttaaatcattcatgtttttactgtagtcctcctaacatttagggagcaccaattatggggtctctagaaggttccaggattctgtaatcaatttgacatgatttctgtcttcagatattcacaatcttcaggaagatatattgacaaaagaataactacatgatctattttgtgtgcaacttagtacttacagagcattataaatgcacatggaaaaataggtaaaggagaaaatcattctctgttgggcgggctgagggggaagtcaggaaaagctacagagaggttcgagggtaaactttaatgtgggccttgaagtatgatttggagttagcaagacagacaaaggagcaaggaaaccattctagaaaaagaaaattttgaaaaatctccagaaaaggatgctttggcctatttggaaaataacattgtcttatttatgggggagatgacagtgctttgtttttagtcagtagtttatacaggactttgaatagcatgcaaggaagttggcgtctcaacctgaaaattgaggaaggtgtgacaaaggctgggcattaggtgagatcaagtatttctgtttttttttttggtaaattaggtagcaggatagattataaatgggctccacactgaggagcccagtgtgatggctgatccagcagatcagggggcagtggctgcaaagctgggagaatggcaaggtaagcctggatgcaagggatattgtcaaagacaaaatttgggggatgtgaggcttaaaagggaaataaataatggtgatggtgagatttctagcttgggcagtgggatagatagtagacgctgcgcaaattcgtttttaaatcagcagaatgagaagcatcttatttgaaatatattctaccaaatcttagcatcaaatgtgctagtgactagcaaaatatgtaaacagaagggaagtagcttgaaaagtacacaaactggagaaattgctcctgaaggactgtaagttgaacccttttaagcctaagatctgtatttcctatgagccctaggctctttccttgtgtatcctgtttcttattagagtagaggctacttaaaaataatcatagtttaaagcgctctattttcagaaaacattattcattagatgttagtaaataatgtaatctttatacattcataatatttctgcattattggagtgtaaaaagtcagtgaaatagtcatttgtaaagatgtcagtttttatctgtggaaaatagctgttcataccattttaagcttaaaagttcttcatttacttcttaaaatatccatgttggtattattttgtctaatacaagtaattaatatttaccccaaattaagcttttaagtttactaaatgttacaaacataattcaaagcactgtttagtgtccatctgtgcaggaaaaataagatcaatacaattgagcagctgttagcatgtattggtttccttatattttaagtatgttttcatgttttgaaggtgtaaagggatgacagtatgttttgttgtggttttcatcatacagataaaaacttattacagttgaaatcttggtgaacataatacattttaaaatttccattcctcacccatttatctagatatttagacacagtaaaataaataacatggatacatttttgtcatgtgatttatgttttttaaaaagtagaaataaatttctctaaaagttatttttattttttaaatttagcatttttcatatttgaggaaaaaacaatatgtcttggtaccctagcttctgaactaataacacacctgtcattttacaggttattttaatgtttttcattgggatcaaacctactctggaaatatctcatgggtgagctttatttttatgaaatgttcttggcacttgaagacctttgtaggtacatgccagactcatcttacatccagttcttctgcatggaaaatatgtgcattgaaattctaagtgccttttcaaatttgaccttcttagagaataatatgagtcccaacaattaggaaaactatggaatgccttttggcctttacttttcaaagattttcagtcagtaatgtttaattagcattcattgtgtacattgtccttttttgtgtgatatggctagttccaaaggaatattctagaagatctcagccttctgctattgaaggtgataatacactactaagttatgtgttgctttacattaaaataatgttgcagcagttacttattgcttaactagcgggtataggacatcaggttgaaataactgattttgaagtgaagagttcttgtttatatcttaaactaaccaagtatgttcattaactttgagaataacaatgatctttttcattattcttgagtagactggataaatcagaaaacccatgttagaggtccctgtaaaaacttcagtcttatttggtaagtccctttataagagtttcaataaaatcaggtaaatttaaactctgaaaattctacgtactgtctatcatgttcaatttactgttaaccagtactatgcactggaaaaaatttttttcaccttaatgagaccactggtcattactgctgctactgatgctcttttgtctgcacatactgttgcaacataatgtgttgtgcatttgatacggatattatcatattgccataaggagctgctattattttagacaccaactgattccatgatagtgtcagatttctttaacatatgcttatgtttttgtacaaatgaccccaagaaacatctgctagttttgtggtggtatctactgtttcttttttagaatttgacctgtcagtcactttttaacgtgaatctacaatatttgagttgtattcctttctcgtttttatgctattgatattaacaaaattgagtcagttttatggcataattcagagagaaaccgaagctgtctatggatgttattttaaaaatacctttttcatgatgattgtgcctttaaatttttgtcattgattgacactttaaaattgaaaagtgcccttttaatggatcctttaggttccaaaatcttaagttgaaaatttctgtctattggtcctgaaagtactctctgaatttgataagtatgtagtagttgtggtgtatccttggtcagtttatatcctgtgctaattgctaatcttacttagtttctttgatgcgtgtgtgaagacaggcaaagaaaaaggaagtggaatttctacaaaactgtgaaatctttactttatggagactagagaaatttctaagtaaaagaagacactcattctattgtagttaggatcccttcttttacttgcttttcatgatcttgactgaaaagcaacaattgagatttccattgcccgacgctttctcttctgcttttctttttgtttctcttgcatttttaaagacagctatttattcaaaaacaatatgaacttttatttattggacttaaacctggaacatcaacaaaacaaagaacaaacaaaactacctttccaaatttattttattagaggatgctatcaatacaattttgtattatgttcacacttgataccaaacctaaacccaagaaagtgtgtcctgtgttacagcctatccctctgtttaagataataactagaacaatttacttttattttctactcatctgctttctgtgtatcagctgttgtcctccctcagcctcgaagcatgtcatcatttccatctccgtgctcattcagtcatccttgctgctcttagtcccctttttgtcccttgggtgacttatgtcattaggacaaccttctgtccccacttggctgaaactgagctgaggcccttgccagttgcattaggtgtggcacctttcatggctcagtttgggcctctgtgatatctgtgtgccttctactccaaactccattctgccagaggtggcagggtgactggaagctttagtttcagtgacaaaacccaagcgtggctatgctgagtgtctaagtagctttcatttaggcctgaaataggagagtcaggcgcctctgtgtcccctgagaaagagagatttccctcagctctctgggcccagcactcaaccatttaagtcagctggttagtataatttccctaaattgtggtttagtttccctatgagtaggactggagtaggaccaagtaaggaaagtccctagtgacctttctgcctcctgaggagcaggccatttactttgagttgtagcttcccatctgtctgtccccactaccctatccaaggccctggaggagccacaggatgagggaggagattcatggaaaagcgccttcaggtactgggtatgtctggagtaacatttaaagtttaaaagactctttaacaattttcctctgatacttactactgcctatacttgtttggttttagtacagtaagttttgcctatcgtgggggtgaagaaaatagaaatattcccattaactttgtatggtgcttggtatgacaccctgaacaggtgcacccgtaattgtttacttgatgttctttttaataagtcaattatatcatcggaaattgaagaatagcaaagttaatttgtttaatcattctatgggaactcttgcatgctcgttcactagaggaacattgcgtttctcccttaaaggacaaggctttgttttgtttttaataagacacactctttataattaaaacaaaatcccagtgttaagggatttctgttttaaataattggatttctttcctttgttcctctaatccctctatatgagaaaaaaatctaatggtgtcttaggataaatatttttagattaaaaagttctcttaaccactgaaatttaataatacttctcaaagtttatggatgatatagaatgtaatgtaaggttgagaattttagatttggcaaaggcaaagatacaaaaactagtgaaaaacaacaaactggaaacacttttaaaatactgatgtatttatctttgcaataaattattcagaaatataaataaactcactatttacatagttttatttaaatttgtcctcaaaatactaaatttagtactatatattttcttctttcagataaatgctttcctgaaaatggtattttaatatctacagatggtttagtttaacaatggttggggtaaaaatgacatagggaaaagcaaaatgtgacagcccagcttggttacctttagagaaactcagaataaactctattcccatttccttctctttcccctttccatactcgagagcccttttctgagactcttaagtcatgtttgggccttggagaggataaatagcagggtgggtggtaaaaggggagagtgctttgcttgaggcaaagttttcctccatatgggaccttcctcaagccctcccttcaaaccctttaaatgagagcatgagctcctaggacagaggtcatgtggaaagcagcattagcatgaaggggggtgctgtggaggggtgtaaggtgcaaaaagcagcattagcatgggggaaggtggggtggaggggtgtaaagggaatgagatgtgaagtggttaaagggccatttttctagttggcctctgggctttgatgaaccttttccagtgtgcctgtttctccacttagccctgggctaatcttgactcttaactttccaggtgtgtatctatgctgatttctcctgggtttggaagctctgagaagctctggttctagttcaatcacaagacttttaaagaaccagaaaaataaaacaattttttaaaaagtaatgaagaaaagacttttaaagaaccagtgaaaacctgggagtaaaaatatagaagacttgagaaatttcatctttacctttcaagtgggcagcatgagaaattcttgtaaatggtgctttcaaatcttacacaaggttctcagttacctttatttgtactccctagactgtattgcatcccttgctatgttgactaattcccacctaaaataattcaatggcctcccaatataatctggcattctaattaataagctaagaaattatttggtttttcactcattggcgttaaatattcttcagtgcccacatttggaaatattggaacacagaaatgaaaaaagatacaatcagtttctctgcttgccatgttttccttgatatggcaatacgacaacaggtcaccctttgaagaaaattcagagatgctaaagtagaaattaaaactgaagataagtcaaggcaggatagtataggagtctgctacagctgccatagcaaaatactacagcctgggaggcttgaacagaaatttatcttctcacagttcttgaggctagaagtccaaaatcaaggtgccattggggttggtttctgaagagggttctcttcctggctttcaggtggccaccttcatacagcatcctcacgtggccttttctttttgcctgcatggatagagatctctggtgtcttccttgtaagaacaccagtcctattggattaggaccctatgctatgacctcatttaacctaattaccctatttaaggccctgtctctaaatacagtcacactgggggttagggcttaaacatattttaggggaacacaagtcagtccataacacgtgatttgctatagttttcctttacctaaatcttttccaaccttgagagtggattttggccaggtgtggtggctcacacctgtaatcccagcactttgggaggccagggaaggtagattgcttaagcccagaagttcaagatcagcctgggaaacatggcaaaaccccgactctgggggggcagggggagtgggggaattagctgggcttggtggcgttcacctctagtcccacctactcaagagggtgaggctgaggctggaggattgctacagcccaggaggcagaggtcacagtgagcagagatcacaccacttcacttcagccctgggttacagagtgagaacttgtctcaaagaaaaaaaaaagtgggttttattcttccccttaaattcctattaatagtgaggtgaggcttcttgtgttttttttttttttttccaagacaatggttaatgtgtgattacttaaaaatgatatataacactaagaaataaagaattgttaagtgagaaggaacatattaaaatggcttggaaagatgggtaattttttacattttaagtaggttttctcaactctaactctgtggaacttggtcaatctaatcagtctaaatatagcacaaataataatagttatatggacaggagaaatagtagccctcaaagatagtgaaatacatctgaatatcactaacaatgtcatgaatttgcttgttctaaagttttctgaaagtatgaattcataactgagtttttttttttttgcctatgactactaatgtttgaggagagagtagtgtcagaaccacccccccatttattacatgtttatttcatattttggtactgaaatcagtgtttattttgtgtcttcctgataaatcttgccaataagtaattaccttccatactgaaaagttcttaggattaccaggttgctgggggcaaccttaaaaggccatgcagaacattgacttaggtggctattaccctgctttattcaggtctgagcatttactttcctactacaatcagaatactgacctacatttaaaagtgcaacactgccctgttatctaaatccactgtgttcctgagaggaaataccagaaaagagggcaccaatattatttttctgctgttcttgatcataagtgattacctttttttttggttaggcattctgcttctgaaagataactgaggttgaagttaatagaactaagattcttatataaaatcataggaaagataattttcaggattattgaatcatattgaaaaatgatataattgtgttaaaagataaggactaaaatgagttaattcaatttggaaatagttaaattagaatttgcttctgtttttgatgaatactgctttttgaaaaatcttctgagtatttaagcttttactactctagtcattctctctaaagtagacatagaagcgtgttcttatcttgatttggtaaggctctgaaaatgcaaagcaacagatgttgtacccagcataattatatgtatcctggaaacacatctttattgagtgggatttgttcttggggaaacaaaaatttggcaaacaaaggacattaacttgctgatctcagcagtaattacttgggttagattataataatcttgtgtaggtggtaactgcatgcatatattacaaaatctaattctaaaatacgtacattaaaaggaaaatgaacttgcgcaaactttagatcatgtatccccttgaagagcagaaaagatctcaatttcattatttgaaagttgtttgaacagctttttggaagaggtttccaggattccaaatcctaatatgtgtattgatactgaggctttggactaatctttgggggttactgccttttttatgcccactgaaaatagagcatttcaaacaaatgaactgatctctgatctttaagcatgccagtaactctttggaacaaatccatagttatttttaccaatgactgtattaaaacagtactttctgtattatctcttccattccaaggccattttaaaacaccctctttctcttctcccaataggtaaagtacgacagagctccttaggactgggttatggagaattatctggaggtcaatttgagaaccactgtgcaaaccatttcttaaataagtagctacaaggttgtccttacaaaaatttctgaagttgatggtgttgcgttttggagtctgaagcttaaataagagtttgtcagtggtcatggtctaaatagctgattactaccaaggtcatctaatttttttttaacacaaaaaaatgttctgagcacaaatgaaaccttcaggacaagacatttatgttttgagaatgttcttaaatgattcctgtcgtgtatcttattttacatatcttaatgatcagcatgtattttttgttgttgatgatgattttataaatgtgctatcacctagtttctaattcctaacagctccttcatcagtagaatattgctgtagcacagttttgccatctgttaagaaaagatggtgactaataagagtggcacatttcagggctggtgtgctatcgcaacatctagtgttttagtactgaggacagtgatgtatgcagtgttccttacagccatggggtgtgggaatgttttcctcttcggcaaagtctgtgtatttctatagctgaactctcaggatccagaggaaaaccacaagatgatgaaaccagatgattgtcatcaaatttctattccccactacatgattattagttttcgtcaaaagaaatactcatcctatcctgggttggaattggtaaagaattttgcattgtgactaggacacctaaaagtttttaggatgagtacaaatggaatttgatagatttccccaaaatgtttgggaaaagatttattcctccctaggaacagcaagagtagcagcatcacatgaggcaactcctggtaattttttcttcttgctcttatttcaatgatatcttttcattcttttctgtatctctcaatttctatgtttctcctcttaatgtatcctgtaaatttcttagtagaacctttttactaatgagggtttcctagtttgctttaggaggcactcaggatgcccccttttgtaaggcagtaaattgaaaataagaacttggtgaaggtccacgtgacggttagtttccattctccattgtaccaaactgctacagggaaagaaccatatttaatcaacctcaaatcctcaatatttaggtcagaaaacacttggcatagaagagacactcaaattttgcagctaaatagattattgatagaaaatatgtttcttgcctctacaagcaatatgaaaccaatacaatctctaaatatcttcagactactaggggcaaatactgtattataagaataattcttcagaaaggaaaatccagctactctcatatcacctctctatgttgaaagctagggaagataaactggcttccagccagtgagagtccatgtggacctagtgctggctggagatccctaatccaaaggcaagagccagatactggttgtctgctgaaaatcagaagatgacctctctggtagtaaggccagtgactcatccctgcatcttttatcctcttctgatttgtataaggatctctcctttttccccagtacccactctcaagaattgctttcctttttaacatgatcataccaaaatgtatctaacagtaccttgatttcctttctgaggaatttagggagcatatttactttgtcagactcattagaggtttggcttcttggtcgggttcttaaatggacaacttgtttgggtgatttggcagagaataggagaagccagtcccctctgatagagcaaacctggggagctgtggttgacccacctgctaactgtcctgtacaattaggcatgtggcatcagtgggtgactgaccagagccaccatctcaatggcggctgttctttccttcctgtgccttctcagatctcttttttgttcttgttactccactatattggtttttcttgagtttttttcaagcaaatatcattattcacttctactgcagttcctctgttgttcgctttttctcttagtcttcattgttttccattttgaacattcagagatccatcaaaaaaagtaaaataacaggaagggagaggtaaacaccagtcaaatgaagtattataatagtgtattactatactctttaaagtaattgaagggtggttttttggggtcagaatatctgttagaatttggaatttgccactcttgagactggggcaagctatttaaactctaagcttatctgtccttcctcacaatctgtaaaatgggatcataataatggcacccagtttatggtgtagtgagcattcactgacacaattaatctaaacttatttgcactacatagaacagaatttttgtctattaaacaatatagcgttttaggcatgaaagaaactttagattaaattaaatatcatttttcttaccacagggtaagtttctgttttgtttgcccctgtttctctaactcctagaatagtttccagcacatagagattaaacaaatattcgttgaatgaatgaatgcatctattctaatcctcttgttttaggaatgacccgtcaggctcaaaagtgaaagcatttccctcaagattggtgacagagttggggactaaatctaaggctttctcttcctacaccagtgtcctttctgagaacacgatgccattttctcaatatttgtttatttatatggtaaattggtaggaagctgtgtggtactataagaggataaactttgataatgaggtatacttgctatcaaattctaacattctcatttaaaacatggcataccatttgtcttctacattttcatatgtaaagtgaggtgatttctaccttatagaactattgtgaggattaactgaactaatctttgtagagcacctggtcccatttattttttttttttgctcaccccaccccccaactttctagctagataacttatacattcactctgtttttcattccttcttgaatctcctgtggccagacttgacccctgtcactctacagcttactcgtcaaggtcagtcctcatctgacttgacctactaagagtctgacaagtagtcacactatgctccttgatacagctttcttcacctaccttcttggatgtcattcttttggttctcctcctaccccattgggctgctttttcccagtctccattcttgggtattctcattttcccatgtctgtcctctgacttcttattgtctctgtttctgttttctctggttggaccttctctagtttctggcttcaaatactatctaaatgctcatgtctttcaaatttgtaactctagtctagacctctcctctgaattccagttttataaatcttctacttaaatattagaggtctaataaacttctcaaacttatgttctacaacaaactccacattttctcctgcagcctctaaatatgtacctcctatagattttcccatttcagtaagtgggaacttcattattctgattgtccaaaccaaaaacacttggagacttgctacattccaccctttgtctttcattctacatccaacctatcaacaaatcctgttgcctcttccttggaaatatatccacgcttgagcagcatcattgtcaccacttggtgttatacactctcatttctcacctggagtattgtatttctcatctggagtagtgtctgtccaacgatgtcccccatcagtctgttctccatgtagcaatttcgtttttgtttgttttaagattgggtcttactttcgccttggctggaatgcactggtgatcatagctcgctgtagcctttaattcctgggctcaagtgatcctcctgccttagcttctccagtagctaggactacaggcacacaaccacacttgactaatttttttttttttttaacttttactagagatggggtctccctttgctgcccagtctagtcttgaactcctggcctgaagtaatccttctgtgccagcctcccaaagtgttgggattataggcatgagccaccatgtctggcccagatgttaattttaaagtgtacattagagcacatcgttcttctgcatgttcagcataaaatccaatgtccttaatgtagtctatattaccctacatgggctacttgtgcctgatccctctactcttatgtcttatccctctcctgctttctcactagcaccagccacatcttaccgttccttgaacacaccaagtatgcatttgccacaggaccttgatgcttactgttccctttgcccagaaacccttggaaccagctatgtgttaaaattcagatatttactgattttagagagctaaaatggggtatatataatatattacataacactcacagctggtttgtggtagcatttcataattaaataatatttctgaatgaaacattaagaatgcccatgctaagagggatgagtaaagactcaactctcattgtcagttcagctgcagaatgaggtcagctcaagatttgctgccaaatgacttaagaaaaaaatgtttttggagctttggggatttcagaattgcagatgagagattctagacccgtacctacacagcatgctcccttattttgttccaatctttgttcaacgattatttattgggtagtcaaggaagatctctgtctaaaaggcttctctgtgtggaacaagactggcatgtggaaggtttccaattaacgatattgaaagagtgaagctcaaatcatttttcactcaaatacatactatttagaagacagtggccagtttaagaataatcattattggaaacaaagtactatttgattagggatagttaacacaaacacttattagtattagggatatgtgaaatacttaatggatgagtcatgtgctgacataaaacccattatccattttagttcctggtagcctaactggttgaactctgttttattgatctattattgatttggcctgtaacttcaagttacattttaatgtaatttcatccttttctgatcaccttgtgtcttcaagcatttttaagcagttgatagatagttgaaagatattatcactatttcaatctaaaagatattatcactattttaatctacttaaaatttttactacattcattttaagtatgacttatggaacgaatcgaaaatacaagatagtgaaaaacttgtgaggatcacctgaaattttagcattcactttccttacatagaggaacttagtctctctaaagaattatgagtaataaagtatcataatgatatttgtcttagttttggttaagtgtactccacaggagaaagttaggcatgagcaggaattattgtagtcccacattctcaaacagttctccagtaagaaagattttatgtgtttccagaaatcattttcctcctcttcagagctttgggaccataattgtatttaaattgctaatctgttttaaggaatcataataaattgtttaacatttatattcaatcaactttgtaatttgtataaatttttcagggtgacatttgaacaatttttaagaaaatgggaaatacagaagtattcttagttttaatatattttaaaaagatgacatgtgatctactgactgaaatccttcaatcatttttgtttttctccccaagattagatagaatggatgtgattttatttttaatttgcattatggagagtacttttggggggttttatgaaaaagacttcatttattttgttagtggtacttcagttgcataagaaaatgttcttttaaatatagtggtcatttgtgtgcagccttcaagttagcaaacatgcctttgagtagtcactatttttgaaggtctttatatctgattgcaatggcttatattcaatagtcctcctactaaatgaaataaaaatggatgcctcttctgccacagaggcacaggtggacatgttggtagcaagccccatgcggtgtgacacatggcacagcccaacatgggggcaaagagcatgcggcttgagctaggagtcactttatggctactttagtgtagatttgtgtttttctgtggaacagccattattgaagacatttatatagtatgatgtttgtttttcattaaatgctgattgtgatttcttaaaaatagttaagacttgattagcagaacctatttagaagccagagttcccctgcttcacctcttgctatctatataaatgatatttttgactctgtcctttataatgttggcaccctgtgcatattagatgtaatcagggctgaaaggaaacttgaatccatctggaagcaataaacttttctaaaagactgcacagtgttatttaatcctgtgacttcttactgtgagtgaaattaaggtttgatgcagttgtgtcacatcgtattgatatcaaatttatctttctaaaaaaaaactgacagtattacagcacagaggagaagatggcttgctgtaatcctgtaagctattttacattgattacatgctacataatgtacctaagtatataaaatacttgatctagaatgtttatgttttctccaaaattttctcatcaggtaatactttctcaacttcacctttagttttggcttcttatcatagtactaactatgcggtagtaattgtgttatgatgaaaggcatggagaagaaattataattttaaaactattataaagtggagacacacttgtataattaccatctatgtagactgccaaggtataaacatttagcttattttagtatcagactctttgaatcaatttaaggctttttcaataaaattggcttcctctaatttctactccaaaatggttaaaattttgttttacttcaaatacgttgtagggtatcatatttcatgtgactaggagcctaaactatatcagctgactggcataatttgtgaattatatgtgtgtttattaaaatttaaagtttttattaagacttacaattttattaagacttaatttttttccttacattttgagtaagtccaactgaaaataacttagagacttaggaaatttgactacattttataagtaatttccttgtaatttttctttcttgtggaaacaattcttactgatttacttaactcttttttcaatggcaaaaatgaaaaccaaatatatttgtcaactatattcttttaattgtggaaatgaaaggttcatatcccccatttgcctagcatattaaaaataaacatgacctttgtcttgaatgttgttaacttggattttaaaaatcaaaccaattataagctatattaaaattgcttatcaccttccctttgtcttcagtaagtctgggcctaaaaatactcatcatatgaataaataaagttttacaaatactttttagaacatcttgaattatatgtgtgtttgaagcttacttttggatgttcggtcaacaaggcttctgacagtttctttttatcttccctctattccctgccactgtgcaccccaaagtgatccctgaccacagtggtcccattgctggcatcaggaaggtagactgaggagttcaggtatcctagaggctgttaggtgaatctcttctacctctttcctggtcctaggaccactggacacttcaagtaaaaataacaattactttaatctctcaggtaaagtttcttctcccttccagcaacacagatctgcctgtgccgagttcaaatactctgaactttcaacagttgttctgaatacttttttgtcatcttatgatcaaatattgagagcattgaggggataactgaatgggcatggtataaaagtcagacttttagtgtttctaagtagcagaaccctttggacaatttagagggctgtgcgatatcctcaccgtgactgctgggaagtaatgggatctgacctgcagaggtactaccttggctgacaataatgacaaaagtgagagcaaagtacatatgactatccttgaggtcctcaggaaaaaaagagtattagtgagttgaactgtatgtaagggtctttaccaataaggaagcccatgcccagacataatccttacaccctggcaatagaaaccatcattgtggtttacatctcatcctgttcctacagtccagcaagttcaggccacaaaaggtttaagcactttttcctttgttctcatagcaacagttgcccatggaggttcagttacactaatattaacattttaatatacacaaagaagtgcctcgaatgtagtaggtattcaaacttgttaaatgaaagaagtaaactttcagacttaccttgaactactacagttttattctttctctaacctctcccactactaccatcttaaaaccaccatttaattagtattttataacaagttattaaaggctttcaaagacctttgaaccttcaccctctggtaagttaataacttctgatatgcgattaaatgtcaactgagtagtagtgggccctaagagctcagagggactgagaaatgaaggttattgtttagaagagtggctcaatgtgcttcgacagttggttaatatttgaaaagactagagtcaagaaagccttccatgtgctaggaaatgaaggagcaaaggtccagaggtggaaatgtatacagtgtgattaagggattttctgattgatagtaaatacagtcaataaaaaacttttattggaagcctagcctgtgtttgaagcattaagctaggtgctgggatacagagattagagatgaagataatgatgaagatattgttgaagtgaattgctgagaagctggagaaagggccaattaccataatctgaggctcaggaggaattggtgcaaagatcatctggtatgatatatatgaactgtatatacaaactgatctgtgtagctgaactgataatgccaaaaaaaaaaagactaggtttttgattaagatgaatccattaaggtcatgttttctgttggtgccattcttggagacctcccccaaccctatacatttataaatgtttttcctgagggactgagatggaagtggacatataaaaggaaaggtctgggcaaatacataagtaggtagtaaaatcaaggaacaaatgatctcaacaaaattgcccttcttgaaatgaatgaaaatgatgaaagccaatcacattgcatgatgaacttggggtatagaatatgaaatatttaaaattgctttatttcatgatgtttcagatgtagtaggaacttgttgcatagatggtgtaaaaacaatctagtaataaaatcttaggtatttaatacaaggtgaagaaagatgcaatgcataaatcatgccattttaggcttaattttcataaggctatgcctgtctttataagactatataccaggagttctcaagctttttggtcttggaacccttttatactcttaaatcgttgaaaaccacaaagaccatttatttaagttataaccattgatatttgttgtattagaaattaaatagacattaaaaatatttactatttaaaaataaccaaaaagatgggcatggtggcccacacctgtaatctcaacactatgcgaggccgaggcgggtggatcacttgaggtcaggagttcgagaccagccaacatggtgaaaccctgtctctactaaaatacaaaaattagccaggtgtggtggtgggcgcctgtaatcccagctactcaggaggctgaggcacgagaatcacttgaacccagggagatggaggttgccgtgagccgagattgcgccactggactctagcctgggcaacagagtgagactctgtctcaaaaaaataaaaaaaataaaaataaaaataacagtaagttcattgcatattaacataaataacatatttgtattaaaaataactattttccaaaacaatcaaaaaagcagtaccactcttctattttaaattttttcaaatctcccttttctaaaaaaaaaaaaaaaatattgtgtaagtttaaggggtacaagtgcaattttgttgcacggatatattgcttagtggtgaagtctgagaatttagtgtatcttcacccaaataacatacgttgcacccattaaataatttttcaacacccacccccttctcactctcttgagtctcctttgtctatcattccacactctgttcctatgtacacattatttagtacccacttaaagtgagaacatgtggtatttgactttctgagttttttcaactctggcttaatagaagacagctgaaatctcagaatgcttcttcatccagtctgttgtgaatatgttgctttgattcaagtatctaaggaaaatacagttttacacagatgtgcagctgaaaaggaaacatcttttaatatgttcagataattgtggatattgtcctttgatactatagcaaaacttatcaagtgctaatttcttaaaggctggttataatttgaaatctgaaaacatatctatttaattgtagtttgctatttgaaaatttattggtctgtcttgtactttgaatggatattttgcccacgtatgattttataacatcctgtattggccttttggaaaatttggtttactattatacagtttctaaatgttgataatttttattataatatattttaaaaagtctaatgtcactgccagtctcatcagaaaattctttgagattagaaagctgttaagatcatcatcacacttacaagttttacaaaattttaattttactcaaaactttatattttatcattgacaaagctctcagttgctttgcttagtgactgactcactttgttcattttccagaaagtgtttaccaaatgctgctgcctcaataccagagtctgtattgtcagttgatctttcaagtaaaaagtggtgttctatgaaaaacagctagttcagctgcgactgaaatgatataagtgtttctcctggagcaaaccaccacttcgatttgtagcagaaatgctgtatgtatactttccattgttattactcataacatttttaaaaatatactcaagggtggagatttttttaaaaataagtgttattgcttcatcaagaacagttaaatgaaactggattttttaaactgagtttgagttaatgaagaatgcagcaattattagtaaaatttggtgctccaccttgattcatactgacactccaggagttttacccactatttcttttgtacctttagtgcaaatgttaatatggtaggaatggtaaatgacatctttagtattattataaaaatcgtttttaccctgtatactctttgagactacacattgagaattgctgatgaaggtgttttaatttatcataagcactgaaaagatttacttaattcaccaatttctcctgaatatttgtttatataaaacaagactatgtgtatacacctacctttttattaatggtagagatctaggaaaattaatttctaagaactagccaggatatttggaatgtgaataaatcatatatccagaaaaaagctttagaagattgtctatgattgaaagtcaaacagctctcatttctattatactgttctttttcaaagaatttaccaattttatgtggtatttatgattaaacatacaccatgtaatttaacatttttaatgtcacttttacatcataggtattaaagattagcatttttattgtctgtattttaaagctcaaagaataacatttaggctgggtgcggtggctcacacctgtaatcccaacactttgggaggccgaggcaggcggatcacgaggtcaggagattgagaccgtcctggctaacacagtgaaacaccgtctctactaaaaatacaaaaattagccgggcatggtggcgagcgcctgtggtcctagctacttgggaggctgaagcaagagaatggtgtgaacctgggaggcggagcttgcagtgagccaagatcgcaccactgcacttcagcctgggtgacagagtgagactctgtcttaaaaaaaaaaaaaaaaaaaaaaaaatttagatttttgactgtttcattgattcatcttagacttcacatgaaaatatctgtatatcctcaaatgcttacattcttaagaagtatctcagccatttacacatgatagaaacaactaaatggaaaaaaattgcagttggaaattcactattttttatttgatccgataacaatgtgacatttgcgattggactgtaattttctgtctttctctctgaaaataagttcaaaaatttccctctaattcttttactagataagaagcctacttcgttgtaactcttgatatatgtatgtatttaggaacttaagcttttctgctaataaatgttatgtcataattcttgaggatagtattatattgtgatgggttttcagtaaactacaggagcagccctatttgtttaaaccctagtttaacctgattattaacaattaaattgtgttttcttctaacaattaaagtgtgtttaaatttattggtcccttgcttcacagatttatctcagtatgtggtgtattcaaacagaattttgtatttttaattaggggattagataaccaattctgaagagccaaaaaaattgttagacatcacattgcttaaccatctaatataccataagtgtgtgtatacactatgttgtgggagccatctatcaggcaggcctgtttttcaggcagtattttaaaaagtggacatgtgcagaaactgtgagcacaattagcgccaagcagataaatccagctctaatcctgtttacggtctacatcagacagatgtgccaagattgatttagacaagcccgaggcttacagtaatatttttaaaagtgccattcgctgttctatttttgttaaacctttgctaaatattcttaagtcttgttggttttgctcttcttattaaccaccgtaagtaacctactttaagcaggtcccgctttgctctcatggtgacaaggtaacctgccaggagaggttatctttattccctgtaattaagttgacttttccccccaaaaaaatacaacaataggaagtgggtgctgaattaaataaatagcatgatacccagtagatgtatacttaagttccttgcaagaacagatggtccccagtatctctgtaagtaatgtgagaggacagttaatgttctgaaacaactagctataaccagtatgatactaatgaaccagtagatttcaaataataaaccacatgccgccaagcaaaattatatgtcattcataaggatttaattatcataacttgcaaaaaagtgtcaatagatgatttctatatttttatctactgatatcaaatatcaatttatgaatagagtttcacttcatattttttaccaataaaggtatgttttaacattaaggtagaattaaagttatatttaaaatacatgccccaaagtatgtggtgatttttttttaactcctcttttactatactgtctgtatgtattgggctgtatatggaaatgtagcttttacatacaattaggaaaacaattgcttttatttctagcagaaacttgtactataacagaagtggctagcatgggaatcagagtagttatcttgtagatgacaactgaagcagacataaaagatgtaatattttttcagcactcaaaaatttataagtaaaattttataaacaaaaagcagtatttttgtgattcatatggaaaataaaatgagtctgagtcattcttaaggtgataccgtaaaggtgtatagataagaagtccatttttaaatatacccaagacaacagttttttctctcagtatggtttgttttcccttttttctctttaattatgtttcccataagtatttgtatattctaagaatgtccaaaaaataaatgttttgcagtgggggttgaaaagaaagaaagacctttttagatttcagctgatcttatcagatgatctctagaaccttgaaccttcaaccttcactgaagttagctggagggcttttcacctggaaacctgagaaacctcagaagccttctgctttagctctctctcaagtctaggaagccagtggcctgcgaccccacagagccagctggtccactcctcatataagaacttcggtaacaatacaaagacatagcaaagcaccatctaatctgataactcattaaacaatatttagatggctcaagactttaaataaaaacattttaagcttgtttatagaatactaacaagttttattcccaaagactatattcagagtgagaaaacaattttccttaaaactaatattatatacatgttcatatatgttaggaactagttatatgcaaaatcaagtgactcttgtgattagaactggtcacatttattcatgtagcataaatggttaatattgccaaaatgagtaatagatcagattttctatgtgagatattgacacctgagagatttacagtgtttcactgttgtgaaaaatggagtgctgaagaacatttgtctattgttatacatttgtaaaagaattcacaaattactaatttcaaataagaactaaatatttcttctaagcctatagtttttctttttaatttcttctaagcctacagtttttctttttaatttcttcttgtaacattggcaaaaagaccattcgtgtgaaaacctcagattttgatctgtacacaaatgcaggagtagagattggaagcttgagctggaaaagcaggaaatactgctcagagccttacaaggattttcagaattttcactgttgggtcctcctggttgctgcagtctaacctcgcatctccttgaaggcagccccagtttctgatgaaatactcttcagttaatttatacatatgctgtcttgctgttttcctaaggactgcaggcagaactgtggttcacctactgttttaaatttggctagatttaaaaacagatgatctcacttatatgtggaatccaaaaaagtcaaacttatagaagcagagagtacaattgcggttgtcaagagctgggggaggggaagcaaggggatgatggttaaaggtataaaatttcagttagacagaatgaataagttctggatctattgtatagcattgtgactatggctaataatgtatacttgaaaattgctaatacctgaaaatcactaagagactacgtcttaaatgttcttacaacacaccaaaaaaaggtgtgaggtaatgaatatgttacttagcttgattttaatcatttcacattgtaaacgtgtatggtactgatcttgtacctcatttcattttccatatgaatcagaaaaatactgctttttctttataatatcttatacagcatagatacaatttttagtggtcaattatattgtaatatatacataaatatatatgattttcattggtcaattatactgtaataaaacagcaaaaaataaagttgtaattaaaaaataatttggaagaaaaaattagcaagtggttggagattgaggaagatgggaccaataagtcctccaaggagagtcatacattagttttttttaaaagtccattattaatcttataatatttaatatgtttaatttcttgacacttattaatccaattaagtatgagaacactgtggataaatctaaaaaccttaaagttgagtaaaataaaccagatacaaagaagcacatactttatggttacatttatatgaagttctagaaaaggcaaaacttagctatagtaaaaaaatcatggtcctgagggaataactagagagtggtatgagggagctttctataatagtgggaaaattctgtatctttattgggatagtggttatgtgagtgcatatacttaaaaaaactcatggaattatgcccttacaaatctgtaatttttgttggtaatttataccttaataaaaaacaaaacagatgacagggttagtgattgtttccttgaagaaggtctttacatgggtctgttgttaacgagttgtagtaaaaatcatccaaaatgcttggattcaaatcttagatctgttcctaccagatgtgtgaccacagacaagttacttacattccgtcttcagtttcttctcttttaggaaaaagcatctagtttttgttgtagagattaaattagataatacaaatgaagtacagagaacagcgtttggtgtgtaacacatgttcattattagctacccttattttttagagaatggaaatttttaaatttaaactaatcaaactattttaggataagcaagtgaaacaatctttttttcaatcgatcacagaaatattttcactgaagacaaattagacatttatataagcaaactacagtgtcattaccattcaaattttcatatgcatattcatgcttacatgcatatgaaagcattacacatatgtattctataaatatatacaaaacagtaatggaaatgtgctgtactattttgaacatctttctagtcagcccggcattttatttacttttgagacagggtctcactctgttgcccaggcttgagtgcagtagtgtgatctcagctcactggaggctggaggtcctgggctaaaggaatcctcctacctcagcctcctgagtagctgggaccacaggaaagcaccaccatgcccagcttatttggtttattttgtttgtttgtttattttttatttttttgtagagatgaggtctcactatgttgcccaggctggtctcaaactcctgggctcaagttatcctcctgcctcagcctcccaaaacactgcaatcacaggcattagccactacactgacctctacattttaatagctgagtagccttctgttatatgaatatacttttttttaacaaaaccaatactccattattgtacatttaggttgtttccaagtttcactcaaataatgcttgggtaagtaagtatttttatttattattattatttttttgagatggagtttcactctgttgcccaggctgaagtgcaatggtgtgatcttggctcactgcaacctccgcctcctgggttcaagcgattctcctgcctccacctcctgagtagctggggttacaggtgcacaccatcatgcctggctcatttttgtatttttagtagagatgggatttcagcatgttggtcaggctggtctcaaactcctgaccctgtgatccgcccacctcagcctcccaaagtgctgggattacaggccgtgagccaccacgtctggcctggataagtattattttagctaaattgtgcatatttattcccttagagtaaattcctggaagtaaattgctggatcaaaaccaggtatattttaaagaattttccttttctacattaaaaataattataattctgattacaagaaaggaaaattatggagcttcataagaaaaaattagtctcatatttcatacctcatattgcatatttaataggtaaccagtgttaaatttgttgtgtgttttccactgggatttctttttatctcctttaataaaagcaggatcagatccctcagattactttgtaacttgcttttattctactttttcatacctcttagcatgaatgtctttccagaccagaatacagagatttcacttactcatttatgagctgcagaagatgactatgatttattcaaccattctcctattgaagagcatgaatattgcttcagatacttttgttattataaatattagtgcaattaacattttaaagtcttttgatacatattcccaacttgttctccagcaattaccatttttgcattcccaccagcactggggctacttccctttagttgcaccatcatttagcattatttttgatcttgtgccaatctaaaaggcaaaaagtggtatcttgttgttttaatttgcatttctttgattactaattagattgaactttttcatttgttcattggtcaatttgcatttcttcttttgtgaaatgcctgcttgggtcttttatgtactttaccattaaagtgtttttcttgattaaatagattatgtaactgtcatatgttgcaaatatttctgtccatttggcctttgcttatgactttttatgagtctttaggacttttgaggtctttattaggtattcaataattttaatgttaaatatattgatgtctgtcttcctttgtgtcttacggcttttctatttaaggttacgtaaatttctaatatacaaatattggtgtatattatgaaatagggccctatttttctttacaaaagattagtcagttctaaatcatcctttgctatttctagcggcgcttagatgccaccattatcacatcagtgaatttttaaatgtgtaattgtttcctgatctattcatttctctattcctagatacttctattgtaatagctttaccaaatatatctgatagggtgtgtactccccctcattacttcatttatttatttatttatttagagacagagtttcagtcacccaggctggagtgcagtggcatgaacttggctcactgcaacctccgcctcctgggttcaagggattctcctgcctcaacctcttgagtagctgggattacaggtgtgtgccactacacctggcaaatttttttttttttttttttttttagtagagacagggtttcaccatggtggccaggctggtctcgaacttctgatctcaggtgatctgcccttctcggcctcccaaagtgctgggattacaggtgtgagccactgtgcctggccccctcattgcttttaaaacattttcttactgtaatatatttattccaagagaattttcaaatattttatgagattccttgtccattccttacatcaaaaaataccacggagattttgattgaagttctattataagtagttacttggggtggggggaggggggagggatagcattgggagatatacctaatgctagatgacgagttagtgggtgcagcacaccagcgtggcacatgtatacatatgtaactcagctgcacaatgtgcacatgtaccctgaaacttaaagtataataataaaagaaaataaagagaatactggcatggaaaatatgtaatcttggaacttgttgtatctccacttattcaatcctttgtctctcagtagattttgaatggctctttatcccacacgagtctagaatcattttgctaagtttattcctagatataatatgctaattgatatgggaattttttttatctccattataccttcttcttgggtgtagacatatttgtagccagcttcctcactgcatattttttattaggcctaatggcattaagtttattattttggattttacaaaaaaaattatgataacatctttaaatagttagtttcaactcctcctttccccttaaatccatcaattactgtcttttatttcactttccttatgtactgactagaatgcctagaataattgaatgctatgagtaataataggtattcttgccctgtttttggaaatccttctggatttcagtaagtgtgatgttggcttttggtttagtatctttaaatttgcaatttacaagatattttacattggaatagtcattgagttgttaagtaaagcacaaacatgttaaattcagactgaagtacaggacttcaatgaaaagttaaaagagtttatttcatcactttcattttttctttccctcagtggctgtttgtcccctccccccaccccgctccatcccccagcttccttcctttgtgctcttattgttctaggtttgactacataaaaagagactctcaatttatatgtgatacaagaccataactaatattataaaattagtctagaagaagttatttgcaacctatataataagggactaatttcaagattatttgaaggactttaaagattggtaagaaaaaaatagacaaccgtttagaataaggcaaagcatgtgtagaggcaactcttaaaaaaaaaaaagtgagctgggtgtgatgatgcacacctgtggtcccagttactagggaggctgaggcaggaggatcacttgagcccaggagttcagggctgtagtgcaccacagtcacacctgtgaataaccactccattctagactgggcaaacataagaagactctgtgtcttaaagaaaaagaaatgaaaagatattcagtttcattaattgtttgactagctgatttttggaaaatacccacaaatataaccaagcctacaagttattttaaggtgggtaagagatacatcttatctatatgcattcacctatgtgaagcggacacccagtaacacccccgtgtggaagacaagcttccttaaacttcacaggacagtatttcccatgtagtccatcatagggtgaggatttttcaggacctttggtaagcctgcttgctttcattcttgagggtagaggaagggtgcaagacttccctggtctctcccaagcattttggggaccctggccataagcctacttgctcaacaggtgcaaatgactggtaatatgctgaccagatgcaagtgtaccaccaatgatttgctgtgactgagtttggtttcctttgcatatactatccagctttttgtttctaatatattcttccttaagggaaccaggacttcttggggaatccagatgagcttgaaacactgtttttataagagaagggctgttttcaaaaacatctatagttcgtaacaaaggagttagattgaagggactctcactgttcagtctgtgacaagcatgagtgttaaaatggagacaagaattttagttaattgtaatgttgaatttgtaaaaggctataacttcataatatgatcaaggggaacaagcaatctaaaatgtgttaaagtagcattttcaaagtgcggtccagggactctcagggttggtgaggtcacaactgtttttataatattgctaagaatgtatatcactctccttctctccaaggatacggtggagttttccagaagctatgggatatgtggcgatagccttgccctaatggagtgtgtgctttgtgctttgcatttttgtcctttaaaaatgcttggttttaattttgaatacaataattatagatagatataacctacataaaccaaagttatttgcggccctcagtctttaagggtgcacagtggggcctgagactaaagagtttgggaattgatgttctagagaaaagtcagtcttactgatgagggttaatcaattagtatttactgaccgggacaggacaaaccattcattttataaagacacacagagcatttcactaaaatacttttactctgattaagtggtgattttagtaatagtaatgattgtttgattttctgatacctgaaggaaaaagagcctgttgaattgatactttgagggtgttgagttttaggtcactgggtgactgtagaaatggaccaggagaagaactgaaacttgagccttctaagaaatagaagaccaaaaaatgtttagtgttaccctatcccatgaccacaataattgagaaaaaggcctttccgttccctcttccctaccctcccccttctcccctaccctctcctcccccctcccctccccctcctctcccctaccctctcctcccccctcccctccccctcgtctcccctaccctctcctctcccctaccctcccctccccctcctctcccctcccctctcctcccccctcccctccccctcctctcccctcccctccccctcctctcccctcccctccccctcctctccctccccctcttctccctccccctcctctccctaacccctcccaacctttcccctccttctctgtccccctccccctccctccctgtcttcctcccaccccccactccctgtcttcctccttgtcttccatcctcccttccttcctttccttcctgtctttcttttcctttctttcctttttcttctttccttcctgtcttccctcctctccgtctgtctccttctccttgtccccttctctctgtcttgcctttcctttccttctgtctttttctttctttctctttctttttcactcttcctttttttaatttcccttttacttgccttctctctttcattccttccatgctttcttttttttagtggtatgtatactttgtgagcaatcagactatagcttgcagaatagttgggagaggccaaaaatgcccctgagaatgcaagcaaggaacttcttagtgagcatatgaacatcctcactccaatcggaggataacattgttcatacttcaaggactaaaaagctgagagagggtctctgctttctgttacttttagcactcgagtcatttctgcatgtatttctactgattactttttctcctattttggttcatatgttttctgcttctttgcttgtctagtgattttggattagatgagtgacattgtgaattttactgtgcaggatggctgaattttttttctattcctgtaaatatttttttggcattgttctaggatgtagttaagttacctggaaaaagtgacatccttttgagaggcttgcttttaagttttgttaggtggaatcacagcagtctttagccagctcactaaggaccaatactcttctaaatacttaccataatgtcatatgaatttccatgtttttccacttcagctggtaggaacacctgtgtcatctctaagcattgtactgttaattcttctagtagttcttatctggctttgtacatctgctgatcaatactttcagctaaagtctcaaggggacctctgcaaatctacagtgttcactgttcagctttctcttctgtagtaaattgcacagtgaactctagtccccttagccttcctgaacccccagttctccttaactcagggagatcaccaggccccaccaggattcctgtatctgccctgtgacctggagattctctgcaggcaataggttggggcggtcgtagggtccactttgttttcctcctcttcggcttcactgtcctgtgttacctgatgtccaatgtctgaaaactactgtttcacgtatcttgtgtgcttttgtagttttaggtgaaaggtaaaactagtttcttattattccacattggccaaagcagaagttttggaagtctttttttaaggtctaaaacacttctactttgagagtcaattgaaatggtcttttccacaataattattttctgacctatggtttaaagataagtcatgaaaattttatgccactatttttttttaagtctgattatggttaaattcagggggctatttcctcctagattgacagagtttataatgtttcctactcacaataattgtacttctgcttcctctttgcatgtgttactttaatgggaatgtatatttccttttcgttaaggctgccttcaacaatttgtcataaagtcacttctgttagtgaattctattttttctgttactttactctatccttagtaccaaagagctccttatgtgacaccaatttattactaaaatgtcgctttgtttatgttcttggaattcttcatacattgactatcctcagatgtcgaatgttgtaggcctgtgtggcagggactctcttccatttattctatttttaatctaattcttgacaaaataaacccaatttttcttttcttcccctttccatctcacgtagggactggcataaagggcaatccataaaattacaaatgatgaatttttttggttttaactattattcatacatttaagatatggtcacaatttttatttcttactagtaattcattttattttttaacttttaggttctggggtacacgtgcaggtttgttatataggtacatttgtgtcatgggggtttgttgtacagattatttcatcacccaggtattaagcccagtacccattagttatttttcttgatcctctccctttgctcactttctaccctctggtaagccccagtgtctgttgttcctttctatgaaacacaatggttttaattggaaaatttatttttttttcaggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggtaagtactcctcatgggaaattttaatcagcccagtttccttgatatacatgattaatctagacatgttttgagtaaaaacaactttagtgatgttgagatagtttccttctgttcctagtttttgtcgtgagaaagtgttgaaatttgctaaatactttttctacattaattgagataatcatatttttccctacatcctgttaatgtggtatcttatattaattgattttcatatgtttaacatccttgcattccaggaataactccccaatggccatggtgtataatcttttaaagatgctattgaatttggtttgttaatattttgttgagtatgtttgcatcaatattcataaaacatattgttctgtagtttttctgtactgtttgtctgactttggcatcagggtaatactggcctcatagaatgagttaggaagtaactcttgaatgactattttcatgaagaagcttcaataatctgaaataaaatacttaaataatttagttcacctgagagttgtttttagaagcgtatttatttttctattaatgtcttttttgaactatataagaatgtattctccttccactcacacattgatggcaagtgtgtatttgtactctgtggcctgaaaataagatttttttgaataatcttaagaggccatgctttatactctggtaattgagaattacctatttcacagtagctttttctaaaggttaatttccagagaaaagagaacatgtttattaggatatatctcttaatgaattcagtgtatctgaaatttctaaatgacattttcatattttgcatactaaataaaattcataagtacaaatataatgcaattcataagtacaaatataatgcaatttggatttctagaagttatctagttaaaatatgatcttaggatttattttttttgtcttagatttatgaatcttgcttgtttttctgttaattcatttcttcttgtttgctgcatcagtcagatcagagtagaggcagcttgtatagttgatggcacagtttagggttagatggcacaggatagaaatgggtgctagacaaagagcagtcacagaggcatgttagaaatttccagttccagcatcattgatgaagaaaaccatgaggacccaagttgatcaaaggcagccagccaataaagctatgctcatgcgagatgagctgaagtgacattacattaaaattggaagaccctcttactaagtggctccatgcttccctgctagcccctttgggacttccaagaagacttggttatttcaagaagacaagaacccacagaggctgtagtttagtttatctctctggaaacatagagaatatgtataattaaataaaagcactttaatagtgaatcctttacagtgttatttgaaatttatgtcaagtgatttaaaaagtaaaaatgaaaattaataatttcagtggaagtaaattgattaacatgaccaggaatacataaaacttgcatggtcttgtctataaaataaggatatgtcatttaattaggagagtcaaagctcattcttgcgcttaaggtctgaggaactcttctcccatggggcttatgaagggctacactgaggcaacttcctcaatatatctcagccataaaaccaagagaaagtaagaagcagaggacatcacaacaaagctcaattcagtaaaagcaattttataggagtagagggacttgtcaaaaacaaaaacaacaacaaaaaacaatgtccaaatatttattcagcttaatgagtgatgtttttgtttgatctagggttaaaatctagacaaattacagagatgaataaactacatatcctttagtctaccatcctctgaaaatgttactttttgaaactttgattttgataagagctggaggcactcagggagtcattctctggcatggtctttgagtacagagtgattttgctgattaaaagcaaatagattgacttttaaaatcaactcatacaaacaaactgttaaaatcctctaatgagagtgaagaaacctaaccaagactgactgatacattactgctccatctctgcaccaaagtggactcagggaggcctgtaggagatgccaactccttatcctactccccacaaagacagttcttggctatcttcatcagacacaaatgaatggttgaggctccaaagctctctaccaattcttgtgttacactggcacttttaaaaaattttgtttattttttatttttaaatggagtctcactctgtcaccctggctggagtacagtggcgtgatcttggctcactgcaccctttgcctcccgggtttgagcaattctccctgcctcagcctcccgagtagctgggattacaggcacccgccactacgcctggctaatttttgtattacttagtagagatggggtttcgccatgttggccaggctggtcttgaactcctgagctcaggcaatctgcccaccttggcctcccaaagtgctgggattacaggtgttagccaccgcacctggctggcacttctcttaaaactaatatctcaagaagttttttctttaagaatcttctttcaattgcaggtccatgtagttctggtattcattaaagtgcctatcccaggggttttggtatgttgtgtttcaattttcatgtttcaatttttttgatttatgcattaattttgttttttcagaattcaggtgcaggttgtttagtttccatgtatttgtgtcgttttgagaattcctcttgttcttcatttctaattttatttcattgtgacctcagaagacacttgcattgattttgattttttttatcttattgagatgtgacttacgactatgtggtcaattttagagaatgttccatgtacagatgtgaaaaatgtatattttgtgttgttgggtggaatattctgcagatgtctgtcaggtccatttggtcaagagtctgatttaagtccagtgtatacctttgttagttttctgccatggtgatctgtctggtgctgtgagtggggtgttgaagtcccccactattattgtatagctttttttccccataggtctagtagtatttgttttatgaacctgggtgctccaacattgagtgcatatttatttaggatagttaaatcttctggttgaattgaaccctttatataatgccctcctttgtctctttttgatgttgttggtttaatgtctgtttcttctcatacaagtatagcaacatctgttcttttttaattttctatttgcatgctagatctttctccatcccttcactttgagcccatggttgtcattacatgtgagatgggtctcttgaattcagcagaaggttaggtcatttaaaaaatctaatttgccactttatgtcctttaagtggagcatttaggccatttatgttctaagttaatattgatatttgaggttttgttcctatacatttgatatttgtgtattgttaagtagttgctttctagtttgaattgtgtaattgctctataagatctctgagccttgtacttttgtgtgcttatatggtagcaagtattgttcttttgtttccatgtttagaactccttggagtatttcttgtatggcaggtgtggtggtaacaaattcccttagtgttttcttgcctgggaaagactttatttctccttcatttatgaagcttaatttggcagattatgaaattcttggctggcattttcttttttctttaaggaggctaaaagtaggcccctgatctcttcttgcttgtaaggtttctgctgagaagtcctctattagtctgattggatttcctttataggtaatttggcccttttctctagatgcctttcatattttttctttggtgttgaccttgcatagtctgatggactatattccttggggatggtcatcttgtatcttgcaggtgttttctgaatttcttgtatctggatgttaacctctctggcaagattagggaaattttcctgaattattgcctcaaatatgttttccaatttgcttacttcttcctcttctccatcaagaatgccagtaagtcataggtttggttgctttacataatcccatatttatcaaaggctttgttcatttttcagattctttatgtttgtctaactgggttaatttgaaaaggtggtcttcaagctctgaaatcttgtcttctgcttggtgtagtctgttgttaaaacttccaagtgttgttttgttttgttttgttttgttttgagatggagtctcactctgttgcctaggctggagtgcagtggcatgatcttgactcactgcaacctctgcctcctgggttcaagcgattctcctgcctcaccttctggagtagctgggattacgggcgagtgccaccacccccgactaatttttgtattttttagtagagacaaggttttgccatgttggctgagctggtctcgaactcctgaactcaggtgatttacccatcttggcctcccaaagtgctgtgattacaggtgtgagccaccatgcctggcctgcttccaagtgtattttgatgttccctttagtgaatttttcaattccaaaagttctatttggttttatcttaatatggctatctcatgtttcatatcctgcattgtgtttctggtttatttgaaatggattttaaatttctcttggctctcactgagtttccttgcaatacatattttgtttttttagtctgtcatttcaaagttttcaacttggttaggatccattgctatagagctagtgcaattctttggaggtatgaagacactctttttgtagtgttggagttcttgggcagattccttcttatctgagggagctgttgattcttatttttgaatttcctattggttgggcgggacttaaactttttttttttttccccttgagggtatgactatggtgtatgttgtgtgtgatcattcaactttgtttctgggtgctttcagggggccaaggctctttatggattccttgggcgtggtagctttcttaaatgctgcttattgtagcaatgtattggatttgtgagctgacactctatctcatgtggggctgagggtgcagaagtctcaggaagcttattttgtggagtagtgctaagcctttctggtagtgggctttttatttgatagtacagttcaggctgcaatccagtagatggcacttaaaaaataagaaccagcttgccctcagttaggctgatgtccagtagaagcacctgtcctgacaggggagtgacaggaagagattctgttggtgtgtgccgaggcctttggggtcgctggttggggggagatagggggaggtgcactagctcctcatgcaggaatgtgatctgcttttctatcataccccatcagagggctcatgaccttcagttcataaagattttttccttgggttcccagccatagtctgtctgtaggttatgcatatgcccctctgaaggcaaccaccaaaatggtcttggggcagagcctcttcccccagtctagggcagacaactccatgacttgtatgtcctccattgctgggacactgctgctctgtgtagggatggggagttgggccccaccctttatgtaagcctaagtggcattctcactttcagcaggggtggagccatcttgaaaaccatgaaaaactctttcttcgagtacctgtgctggcccccagtgggaagaaccactgctgcgtcttcaacagcgtgtggggtgggagggtattgccacagatgaccccctctccatatccgttccttgacatggtgttgccccctttagcgattggcactgtgcccacctttcctttgtcccaaaggggttttggcaagttgtgtccctctcccttataggtggcctacactaggggggttagatctctagaggttccatagctccctgggaacttgctggccccctgggcttttcaaagtcagaacaggttatgaggtatgtttgctggggatctggtgctacagagactcaagggtagagaatccctgggcagagcagaggcccaccactggtgcacaagcaatatggtgaccaccatctcagtttgtgtctgaggggagtatgggaacccctgcaggagctggccacccagttctctatccctgggaaattcctaaattaccaccaataacattgccctgggtcacaagggtggggccttgaattctttgggggttgatctctgccagactctagctacttttcctttctgcaccccagcttcttcccatgggcactccaaaaggtcctggctctctttccccagttttccattagaaacttgtccatttgacagtaactttgatcttctttctaagaagagctggcatccaaggtctgtggtcagctatgttggaaaaaagaaggagaaaaaaactagtttgtattaaattctgaaagactagtggcactggttaagtctttaaaggattgttaacaaaagaaaatctttttaaaccaaactcctaattttatcagaattgtaactgaaaatataaatgtatgaaaacataggtattatgtaaaatttgctcaataaaagaataggaaaaactactatttatcttggactgatagcatgttagtttgagatttgaaccctttctactctagtaagtagtggtgggaaaaattcactgtaggagtctgcagacataacaaactatcattagactgccaagacctccacataataaagcaagcagagaatgtcaaataagtatgtgaaaaatgatcaaaaaagagaaattgaaaatataaatagggtgctattaaaaaaggatagcatttatgttatgacatatgtacacatgaatatcactttttagaatttcatccttcttaggacttattcctgagtccgaggattgagaggttctgataaaataagtctcagtgggttccaggcatgggctttctttaaaagtctctccagggattctaatgtgttgccaggaccaagtaccatggacagccaagatctcatcagcacagtttgattgaatgaacttatgtagaaccctgaatgccacacttaaccaaagaaacctttccagggattaattataggtgacagaacatgctatattcttattaaatattattaaaagttaagcaatacccattcctgattcatgtaaaattctcacttattttccaagagttttactgtatgactggtttatgggatgcttggaaaaggttgacagacatggcaaaggttcctgcagtgtttctctttgtccatcaacagccctagctcataacctctaccctttcagctaaaagcaattagctcttcagaagtgattcattctatttatacttgggataagtaacatcaggcagtcttccctagggcttctcacgggccctggtggcatttttattctaagagagggttatatttttacatgtaattggtcataattatactaaaaacaagtaattggtgtcttatacaagaaaattatatttctgctttagtcattgacagagtatcctgagaataagagttaagaagtatattcattgtcatcttatttctgatatatttcaaattcttttgctaggaagaagcccttttgactgtgctttgtgtaacaaaacttcttcggagaaacaatttagataaactttgtcagatcttatgtgattatattcaaaatgctaattgaagattctctaaacattttcagtaaaatgttgaattgttttcatgctgttaaataagttaacatgtcttcctttactaaagtcattattataaaaatgtaaatcctaatgataatagctgatgtttattaagcatttagtaggttccattttttgatagcaacttttatgaattatctcattaaatcttcataataatagcatcaagaactacaaatatgttttcatgtaagaagggaaataaaattatgagttttgctgtgaggtttgaagaatgaaaacaatgcatgacttagaaaatagtataattaagtgaattttattatcattatcatctcttagtttataaatgaaaaaactaaggcttacataatgtaaaaatcagttaacaaggttaaacaaccggtagatggtagaggaggagctgggaataaatctgtacatgtctgaatctggagcaggaacccttaactgatgtgtcattctagcaggtcatcagttactctacaatacctattaagtatactttatttactgtgtttagatttatagtagatttagactctactgtaaaaacaaggacttcatacacctgctagaaagtatccatatcatcttgtttgaaagttgtcccgctctagtgttcttttctaatcatgatgattcagaactccaaactcttgaagcagggcaacccgtagggtcagcattcataatttctcaatacttaaaaaagtttcctcatgactgttgctattattgagatttctcaaatgtcttggcctgaattgggtgtgcactatgaaaaaaaaaatggcagacatttctttttgttaaaggaattttaaaaacacatataaacacactgatttgtgacagattaccaggctttatgtttagcagggtttcctaagcaaaacacaaattctgtaaatctacagaattagataaaacattgactcaatccttagatgagagtataatggattatcacttaataacttctgtcactgaaaataaatgatgtaaaaagtaataaagttctactctcacagtatgaataaataggaaatacataatactttaaattaggcaacaaatcattaagcccccagcattcattagactatcattaatgataataaaattgtgtggtatttatacagatattatatgtaactccaggaattttgttataattgtgtatgaatatatttgttgtttgaggcaggtagatggatatttgcagcagctatgtgctgaagcattctggtaatagttttcaaatcaaccatttttttctccttgtcgatcatctttaaagcaaaagcaccgttttttactatattttttgaaaaaaatacattaggtgtaaaattatatattttgaagaagttcactttctgtttttactagtttcacacctttgttattttttcagtggaaggagcagagataggcaaaggcgaagcctgtgtgtgtggtcaggttcctgggcccttcatagcatctgatgccaagctgtgttctcttttgtgtcattgccttcccacttgctaattacgtgacagagctagggacttccctctgtctagaatgccccccatctcttgtttgcctagtgaaatctggtttgaagttcaaggtctgatacaaaccaggtgatcctctgcaaaactaactgtacctgagcaaaccaggcacttactcttttatatgttcctggcactgctgatactctgatagaaaacatcatcacttaatgctaactgtgggctcacaaaggggatacttctactgtaagaagactgtaactcttcttagcacagagattagtaagtacttgaaacagagtttcacatataataagtgttcaataaattttattttttatttctaacacttggcacactgcatagctcagtaaatgttggtgaagtgaactgagtattctccttatctattatgtggtaggcattattctagttgcttctgttataaaccaactcatttaatccttatcacagcacttttattgtggtcaatattttttaatcctcacagatggctaaggaatcagcactctgagagattggttgacttgctttgggtaaggtgcttataaagtggtagaacaagattcctatccaggccttctgattcaaaaatacattctttttttttttttttttagtagtgttttctggaaaggcagggtataactgactatgctgtgtatttgggactaagtatattattgtcaagtatattaaaaatgtcgcaacactggaaaggagtccatcaatgggctatgcaggttgagggatttgtagatgagaaactgataaatttggttagcaaggaaagccatcaagctgtgaaccctttatattggcaaaagagagggtcctttgaaatctaagggaacagaactttcctgttctccaagtttggagcagaataggtaagctctaggcagtctaatgcccaacttttaccagtggtgttttagttttttttttttttccaaaaggaaatgatggaattctttatatacttctgaattgtctatcttttcaaaaataaaaattttcattttgcagtacatacagaatcaaaagactttcaagtcctaactccacaaatgtttattttgaagctctttaaactgtttaccacggatattagtaaatctgtcagaaatgaggtgacttacttatccttgtcccaccagatatgtgggaaggatgatcacgctagatagcatggatgggtcctctatttatctctttttacttgaatggaaaacacatcattcagattaatcaattagtcattgtgactgatagaatttttatatggataatctgggtttggtccctagctttaccacttacttggggtctttatgtcttctatggtctcctatctgtaaagggaagttgataatgccaatctagctaggttactgagatgcttaaatgtgtaatgtatgcaaagcagcaggtactcaataaagggtaactcttactattattgtatagctctccaggtatgtattgagcttctatagaatccatagccccaaactctttagccctttgagaccaagattaagcattgtctttccagaggagagggtgagagagattgccattatactaatagaattcatcattatcaccgtcatcatcatcatcatgatttcttggtgtgtcatggaatgtactgtgtttcacattaccaacagatgttaattttcacaacatccctgagacaagaaactatgattacattttacagataaggtcatgcagctataaagttgtgaaattgggattcaaactcaggcagtctgtccccacagtccatgttcttaacccaccatgctctcctgacacttgaaaagttaggaggcgtactccatagcctgtaatgttgctgcagagagaatctaattttaaatccagtgaagcatattagttgctgtctttgatatgccattcagattgtgctatccttatgatgcctaccttggttgtatatgtaactgggcgtcaaatatataaatactcaaaaagtgataggtgccaataaaatattttatagttaatacttatgtaatctgtgttctctgtgtttgagggctggttctaaaatactgctctatatttgacttctggttaaaacaataaactttgctcatattagttatatagttgataccattctcatgttgctaacatgtctgtaagtaacagttgaaattgatctggcaattttagagctgtcagacccaggagatgagagaaacatttaaaatgtttataacattaaatcagctgagtcaagagagagaaagagaaagatgattcagatttcttgtactggtggatgtaagtgcttggaactgaaataaaggagaaggtgtagggagggagaaagataaagaagtcttccctttatacaagttgaaattgagttttctttgagatatagaggtgaagacattttaagaaacttcttaaaactctctaatgtggcttttcaacctgtttccatcaatttggcacatctcacttttcggcacaacagaatattctaggtttatctcacaccttccttgccccagcccaggaatcagccatttctctaagaaactcttgtttattttggtggggaacagtattgggaaaccaacatctgggagctaaatatactcctagtggttaggaggtcataccttgtagactcttgtagctgacggagttaggacatatttattagaaatcataagtttatattgatcttgctaggatctatccaatcctacaagattcttccctgtgtctctcctttgtatttgtgtatcctttcttccatattaagaactgtggctcccaacaacaaggcatgtgcccatttgcccaatcgtatgatgtataaaaactactttgagaaaagtggcagccaaaccactaagaaaaataaacttgctgaaatgagttcaagatttattggcagctctttttttggcccctagactgaaagtatatatttcaagtattgtgttcaaaaattatttgggttagctttttccacctttcataatagtaatattatttacttgaaatacagttggctttgtttctatattcagtttttttctctctatcttcattaatttcattatatatatttaatatgtaggacattaacatgtttccaaaagaagaaaacactccttcctgtatcatttccacctcatctctcttaccccttataggtaaccaattgcactggtttctagtttatcttacttatattcctatttgaaaagttacctcatatatgtatgttttttaaatttttatacttttttacacagaaagtaacgttcagtatgtactttgccactttccttttaaacttaacagcgtatactggaaatcactccatatcgtgtcacagagagcttccttatattttttaatagctgtataagacttcattgtgttgtctgtaccatattttattcacttccccatgtgtggacattttgactgtttctagtatctgcaattactaataatgctgcagtaaactttgtgcatatcgtaccttggtaaatttctagacatagatttctgggttaaaggttaagcacatgtgtagttttgttagatattgataaattcctttccatggggtttatatcatttttaaaatatttaccagcaacgtataacagcgtccattacttcaaagcctcaccaacagattgtatgttttaagtacttttatgttttagaatttttccaatgcgataggtaaacaatggtatatcaatatagttttaatacattaaagttcagcatcttttcaagttcggctagtctcagggctattcttaatatcttgtgaattatcttcatattattttcccatattccataatacttttggttttttttcctcctcaattctgacaagttctttatatttcaggaatattagccattttatttgatatgttacaaatatttttctcccaatatataacttttctcttataacgatttttttttcatgaaaagtttttaattaaaaccttttatgggcccaggtgcagtggctcacacctgtaattccagcactttggaaggctgaggtgggcagctcatttaaggccaggagttccagaccagcctgaccaacacagtgaaaccctgtctctactaaaaatagaagaacattagctgggcttggtggcacatgcttgtgatcccagctactcaggaggctgaggcatgagaatcacttgaacccagcaggtggaggttgcagtgagtcaagatcgtgccactgcactccagagtgggcaacagagtgagactctgtctcaaaattaaataaatatataaacaaaaccattatgggccaggtgcagtggctcattcctgtaatctcagcactatgggaggtcaaggtggttgaatcatttgcgccaaggaactggacagaccagcctgggcaacatgggaaaaacctctctctaccaaaaaagaaaaaaaaaaaaattagctgggtgtggtagcatgcaccagtagtcccagttactcgggctggtcacatgagcctggggaggtcaaggctgcagtgagcagtgattgtgccattgcactccagcctaggcaacagagtgagaccatttctctaaatacatacatacatacataccttttgtggagttaaatttacacactttttctttattggctctggcttttgcattgtagtaagactttctttacactcaacttatagataaattcacccatgttttcttctagtacttgcatagttgaattttagatctctagtccatttggagtttattttttgtatggtagaaggtattgatcctattttttcccaaatagttgttacccagttgtcccaaaacaagttattgaaaagtccatctttgtcccagatagactggaacaaaatgaattaaagacttaaatatgaagatttttacttgtgtatcctttcttcctagaaagaaaacataggcgtaaagcttcatgacgttgaatacttcatgccattggtctggcaataatattactattatgaaaggtggaaaaagctaacccaagtaacttttgaacacagtacttgaaatatatactttcagtctaggggccaaaaaaagagctgccaataaatcttgaactcatttcagcaagtttacttttcttagtggtttggctgccacttttctgaaagtagtttttatacatcatacaattgggcaaatgggcagatgccttgttgttgggagccacagttcttaatatggtagaaaggatacaccaatagaaatatttatatttaagtctggcaatcatttttaagatgtgaacttgaacaggcaacaaaagcaaaaataggtacgttggattacatcaaacccaaaagctcttcacagcaaagggaacagtcagttgagtgaagagacaacctatggaatgggagaaaatatttctaagccacacatctgacagagggttaatatccaaggtatataaagaactgcaacaactcaatagcaagaaaacaaataacatgaataaaaaatgagcaaaggatctgaatagacatttctcgaaagaagacataccaatggacaacatgaaaaaatactcagcatcactaacaatcagggaaatgcaaattaaaaccacagtgagatatcgcctcacacttgttagaatggctgttatcagaaagataaaagataagtattggtggggtgtggagaaaaaggaactctagcccactgttagtgacagtgtaaattagtatagctgtgatggaaaagagaatggaggttcctcaaacagtttaaagtagaactaccatatgatccagcaattccacgactgggaatatatccaaaggaaatcagtatattgaagagaactgtattttagtgattattgcagcattgttcccaatagccaagataagggatcaatctgagtatctatcaatggacaagtgataaagaaaatatggtgtgtatacacaatgggataccattcagcctttgaagagaaggaaatcctgtcatttgccacaacgtggttgaacctggaggacattagctgagtgtaataagccagccaccaaaagaaaaataccacatgatctttcctatatgtggaattttaaaagttgaactcaaggaagtagaatagaatggtagtgaccaggggtatgcgataggctgagggatcaaggagatgttggtcacgggatacaggatttcagttagataggaggaagaagttcaagaggtctattgtataccatggtgagtatagttaattataaagtatacttgaaaattgttaagagtagattttctgttcataccacaaaatgataagtatgtgagataatgcatatgtaaattggctcaatttagccatttcacaatgtatatatatttcaaaacaacatgatgtacatgataaatatacagtttatttttaattaaaaattttaaactctctaattggtcttcaacatatagtacacaagtcttttcacgactctttataatggaacatatgttcttggaatgctaaaaattattttttttggaggccctgcaaataactaaaaatttatcttaaaagccacacctaattacttacatatgatccagaaaggatactttgaaaaagctttttaattgataaaatcattaaggtaaaacatattcataaaagtgttctctaataattttataattttctagttcatgaaggattaaatatacaactatcatttgaattggattttttatgaggttaattgtatttaaatgctaattattttaactaattttgtggttgacttctatgtagagtagggaaaaagaatttcctaaagccagttacgtatatctctttttagtctggatttttaattaggaaaagtgatatagttaaataggtctactctatagcatcttctaaaatgagtaaaaattcattatatcaggataaaaaatgataaagatatatggatgacacatttggctgaatttttcttcttcgctgttctcttgctctctatttaaatagtcttagctcttttatcatttaaattctgaagtattgaggtgattattccggcagcaggtgattctgctaattactgttcagtcagttttagctattagaaacagagatatgtttacattgctgggctgcatgtaaatttagaagttacatggctttgtttttactttgacttacggcattaaaattattttcatctgtgtatgtaaagatctgcatctataagcttttgtggataataaggtgaaattgatgcattttaatataaattgccaatataaaatatctctaactcagacctctactggaaagttgtcaaatcttatgtaggaaaggcttttaccatcactgttacacattaactgggcatagtttaatattaatagctcctgagacttgtggttaactgaggtttctatttcctgtgtttgggttttatctttgcaacaacttggttgcttttctgtgtaaaatagtggtgaatatacacaagagtatgacaaggttctgggctcttaactttgatgaacaccatgccatttccatcatgctgcactcaaaacagcacagatgtgagtctgggagtggcgtccctgccgctctcatgagcctttgtttggagaacaccctgattaacccccacccttcacggttcattgactcactgatagatcaagtttaaactagtatatattagcacatttgttaccaacagaggaacagttggccattctgttttacattgctggttcattgcaaactggcgtgctaaaaaggtctgtactctagagtatgaattgggaagttaccaaaggactgagaaccaagtcagttgcatattaatgttgaattatacctatattttaatcttggattgtctacttgggggatgcttacactgttgtcaagttatgaataagtgataattaccactttgaaattcatctttttttttcaaggagtttaggggatttaggtgtctcaatatagctttcatattaaacagtttgtcataattggatgagagcagagcaaggtcatgactacctgatgccttgtgttggagcattttaaaaatgttttccagagagttatttgtacctaatgactttacataagtccttacattatactttatttctaggtcacctaaaaatgttaattgtttagtcaagagggttaggatgtgtgtctgttttctcatgaaaaaaattaagctgttccctttttatcaattttcttgcaatctaaaggcttttttttcttaccttcctaacctagtgactaaggtcatcttattgttacagttcctttcatgggagataggtttactgcatcatttggcagtttcatagggtgaattttgtcttggcttcatctttccttactggttgtcatcccctgggccacctgcttttttgcattttcctttctcttgtgagatgatgaagctctgtgccccgatggggatgagagacagcactctgagttcaagtctaggataaggcaatgggcttgcttttcaaaacaaactagtgtcatacgggctgctgctttcaggtccactgtctgattttatcactgatgacttgtttctggaaggcaaactgatttaagttctgagcaaaagggtcggtgtttattttcaatgctactattaatttagagttttaatttagaaaagattttttaccagttctcaaatatgatttttctattgactttaagtttgtagatataaggagtagacatgagatagagactgaattgcttttttgtttttaaaacttggcagtaataaggggttgcttgttttttcatgctaaatattttttctaagggatctagatacctatcagaaaacttaactttgataactctggttctttattaagtatttttgtcttattttaggaattaatagaaatagttgtaattttagacttcctttataaaataccaatttaaagagaagctttttgcttaaatgattgttttgcagtgttgtgcttttgttttctttaatgcagttgaaatcgcagctttataacttattttttaatttggggtttttaaaagaatattagttatttatttatatttattgggcacctactgtgtgccagacactattctaggaactagtaaacatagcagagagcagaatcatgaagttcttgacctcaaggagcttaaatcctagtggtagagggggaattcaaaaaaatcaaataaatgtatttctattatgtcaagtgatggtatgtactaccaggcaatcagatgaaaatatttcctcttctatacacagtgggcaaggaaggcttcattgactgtggagttttagaagaaagctgaaagtaatggggaaagagagccatatcgatatatgaaggaaaacatggtccaagcagaggaaacgaaaagtgcaaagaattgagcaagaaagtcatgttcaagtggagtcagcaggggaaagagtaggtcacaaatgcggctgagggtgggtcatgaagggccttacaagctttgtatgagtttttacttttattctgaaaaaaacaaaaacaaaaacaaaaaaaaccggggagctatttggggattttaatagaaaagtaacataatttccttttaaaatggatatgtggccactaagtggagagagtggtgtatatatgagtggatggaataattgatacaggcaagcaggagacaggttaaatgaaaaatggattaatccaggcaaaagatggtgacttaaattaagctgggagtgggagagatggtgagacatgcttagactttggattcatttttccagatagaactggctgacagagacatgtcatttaccaacatagacatggcagattttttttttcttttctgagacaaggtcttgctctgttgtccaggctggagtgcaatggtgtgaccatagctcatggaagcctcagactcttgatatcaagtgatcctcccacctcaacctccctagtagttgagattacaggcatatgccactgtatccagccaactttttttttttctgtagagacaatatctctctgtgttgcctagggtagcctttaactcctggcctcaagcattcctcctacctcagcctctcaaagtgctgggattataggagtgagccaccatgcctggccaatatggcggttattaagaggataagtcaaagattacatgaatattctgttatgaaaagtgtcaaacatatagaaaatataaacagtattccagtgggcacccatatttttatcaccttgattctacagatcttaacatttttctgtatctgcttcaaacattttattctgccaatgtgttctaaagtaaattgttgatattgtgatagttctctccaaaatgctgcagtgtgtagctctaaaaatagatatttttcagataaccaaatatcattaacctgccaaatcaatgaatgataattgcttattaacatttaatacttggtccatagtcaaattctccatattttccataatgtcttttatagttaacttttaccaactagtgtctgatcaagaatcattcatttaactaattacatttaaactgtaacattacaacatgttttttcgtatgttttattctctctgacattgacttatggaagagactagattatttgtcctgtagacattttatcatacataagagttactaggagagctctgattactagtccccactctcagaaattttgattcagttgctctttccagtgagctgctggtgatgctggactttcattctgaagaccatactttgagcactactgctgtaccactatccgatggcttctttgtgatatcgtttaacttgttgttctgttgcctgtatttcctctaaactgaattttcaatctaaaggcttactgagattcatgtttgatactttgggcaagaatacttcataagttctagtgcttaatgttaggtagcacttaattctgactatttcactattcatgaggctaagctaaggaggtgacagcctgatccttctattgtaatgtttcatgtgaaactactagataatttgttgagttggggggtgggtagggaagagatatctagttttcaataaatatttcacctaatggttttaacacacattgatcatccttgcctgaactaattatttaattagggatggcaacatggagactttctaattcaatctttttttttttttctaaatgaatggccttgtttttatttttaaatggatgttacttcgcaactggggttatttgattacccagaaatatagcgcatattaaaaaggtaggataaatgcttagttaactaattaagcaatttttaattaccagttttcacagtaaggcactaaagtttctgacttgagcaaagataaagtggaaagataaagtggtcgtttagtgagatgggcaagactgtggataggtagactaggtttggtgggaaagtcagaatatcagttttgaatatgttaagtttgagatgtctattagaaacatatgttgacgaggccaggtgcaatggctcatgcctgtaatctcagtactttaggaggctgaggtgggcggatcacctgaagtcaggagttcaagacgagcctggccaacatgtgaaaccctgtgtttactaaaaatacaaaaattagctgggcttggtggcatgcacctgtaatcccagtaatcccagctacttgggaggctgaggcgggagaatcacttgaacccagggggcggaggttggagtgagccaagatcccgccagccactgcacttcagcctgggtgacagagcgagactccatctcaaaaaaaaaaaacatatatatatatatatatatgttgacaatatttcagttgaataaaataaaatattctagctattttaggtagaaaggcattttataccgatactactactaaagggtaagaagatatgactgtagtacattaaatatgctgatggcctacaactgttgctgtgttgctttttcctcttcaccacacatatgcagcctcatgaaacattttccatgaccagcacactgaaggaaataaaaggaacctagtttagagatggttctgcatgatacaacaaaaatgagctgctaaagcattacaatcccactcaagagtattcccccatcaaatagtggggctggtattttaatcagttgatactaattgtcaaggtgtgatggccaagggattgatgtttatcagtgtatggacagtggttcagagtttggtgaattagtcgagttgaaagagaaagattggtgacaaagatgtatgaggtggaaagtatactttcacagaataagaacagaaaatgagatttatgtttttttgtaaacgttcaacaaagaaaattcattcagaggaggaaataggtaggcaagatgccctattctacagatgttagtcagcatcactgcaaagcaacctcagggcttatgcagtggacacttaaaatagcactggtgcagggatgggagaaataaatggatttaataagcactgctgcttaccaaggttgattgaattgccactattgccaagtgttctacctgcaaacagatcaaccttgagccctggatatggcaccatgtcccagagcaaccagccagccacctggtggcaggttgattgcattggatttgctccattatggaaggtcagtggtttgtcactgctgcgatgaatgcttactgtacgtttggatttgcattccctgcccaccatgtttctgtcagcaataacatggccttattaaagccttattcaataatatgacatcctatataatattgcttttgatcaggagactcattcacatcaaaataagtgaggcaattggctgtcaactacaggattcactggtcttaccatgttcctgttgtagcatattgtattctacctggaagatgaaaccttgtgacattaaagtagtttttagttccataaacataatacaggggtctatgaatcaagaagtggaggtagaagtgttgtcttttacttcacatctaatcacatgttcaaaatattttttcatcttgcctctgcaactttgaactttgctgacacactgaggttttagtgtgaggaaacaatactttcacatgggaacatgatagtcgttcaattgaactggacatttagaataacctggccacattactgaactgtataactgaaacaacaaatgaaaaaaatgaagatgctacgctggcaaagatgattaattttgattattgggagaaatagtattgctactgttaggaggaagactatatgtctagaaactaggaggaaacctgggttgcctccttgtagcagggtaaaatgagtgagtaccttgtctaagaaagggaacatgaccaaactgaacccagaagacataggaaatctaaacagatcaattaacaccaaagaaacgggcattttttggtacttctaaaaaagtaccagactgatattttcacagagatgttcgttatacccttaaggaacaggaacagaaaacttctatactatttaaactattttagaggatagaaaaggaaagaaaactccagattttatttatagaacttgcatgaaattgataccaaattctgacaatgcaagttcaaaaaggaaaactagagatcagtgttacttatgtcaaacagctcttaatagaatagatggatatggttatcaacatgataaatatgtttatcacattttaaagcctacatggagaaacatttgaggttttcttattctagaactgacaggaatgtcctttattatgagcactattagtcaaatttttctggtggaactaatgtaagtagactgctgaagaaaatgaatggtatgaacattggaaaggggaaattaaatgattattatttacagataaaataattgttaagctggaaaatccaagtgaataaagggaaggcctacaattaagcagttaaggaaagggctaggtatagaaatcaatagttttgatatatgcaggctatagccagttaggagatcagttaggggaaaaacacgttgacagcagcaacgaaaagctgataaacctagaattgttcaccacttatcttaaaatgtttaacatggtactgagggacacaggagattatttatgtggaaaaacataccatgtttctatacagaaaaattgaacatcacaaaagtattatttgatcttaagataatttatatttaatgcaatctcagtgaaataccaggagaatgtttttaagctagacaaacttatttcaaagatcatatgtaaaaataagcaaaaatagatgtgaaaaattctttaaagtaatgagagaccagtcttattgactattaagtcattataaaactataatgtttaaaagatggtactgacatatgaatagatcagtggatctcagatgggcagtgcagaaagagatccaaacacatacaaaaatttagtacctctaaaggtggcatttaaaatctgtggggaaagatggattttccaatgaataatgttgggataggtagatagccatctggaaaaaatgaaagtcaaatcccaactttttaccttttatcaaaatgaacttcagatacaattgaaaatataaaattgagaccataaaagtattagaagaaaaatgcagtttttaagtctcaaaaggggactcttaaatatcatacaaagcccagaggccataaaagagatgattgataaattcaaatataggtccgtgtaagcgaaaactttcagtatggagaaaacataagttattaaggcaaatgacacactaggaaaagcatttgtaactcataacaagcctagttttcttactgtgtaaagtactgccataattgacaaagaaaatatgaagaattggcaagtgacatacatagaaagttcatggaaaaaataactcttaaacatttacaaaattttacaacctctcatgaaaagagaaatggaaattgaaattagagtcacatacagtatttcacttttcatttgtcaaagatcaaaaagtttgaacatactgtgggtttatgtttataaggatgtaagaaaacaggcaatctaaattccttgtagagtgtaaattggtagtaataagagaaaaatttactgaatactttgtgccaggtgcttttctaagcactttacatttaattatctcaattaacttatccagaaagtaccattatttctgtattacacgtgaggaatttgaagaaaagttagacaagtaattcaaagtcacacagttaataaatgacagagtgaagatttgagaccatttcctttttctcaagtgtccacttttggtcgcaactctgctgtttctgtagtgagtgatttaacactatatgataaaaccttaagagtacgtactctttgatccagtgattctacttccagaagtttgtccattttgcatcaaatagatggagaatagcattcattgcattgttatttgcagtaaaggaagattggaaacaacctgaacatttatcctcaaggactcatccatacaaaagaattgaagtaaattcatccagatgaatatgaggcagctttagatagagtgagatggcatcctatgtagtgatatggagtcatctttaaaatacagtaaaaggaaaaagcaagatacagaatagcatgtagggaagctgctgtctatgtgaaaagctgtagaatatacgtgcatttttgtatatgcatagaatattcctagacaaggacaaacatggtggttcatacctgtaatcctagcactttgggagactgaggcaggtgattcacttgactccaagttcaggatgagcctggccaacatggcaaaaccccatctctagaaaaaatataaaaattagctgggtctggtggtgtatgcctgtggtcccagctacttgggaggctgaggcaagaggattgcttgagcctgggaggcaaaggttgtagtgagccaagatcatgccactgcactccagcttgggtgacagagcaagacaccattcatctctctatctcttttctctctctctctttctctgtctacacacatacacatacccccccacacacatatatatacacacatatatgtgtgtgtgtatatatatgtgtgtatatatatacgtgtgtgtatatatatgcgtgtatatagatacatttctagaaggattctcaaagtgatatcagtgattgttgtgcaagaaggaaactagatatcagtgaatgcgctaaataaggtgattttgaattctgtagcatgtgtatgatttacctatagagaaagcagtctagcatgagcgtgggtttctcaaatatagaatgtttgcagtgaggtcacttggtgaaaagtatagccatgtcagacagatgtaggttcagattccaggacttccaggactgctgaaagggaaaggggctttggatctccttcagctccaggcagcattgctcctttcccagctttgacattagctggagggaagacaagttcttagagctctatgtgcttgggacaagaccccttccccctactgccttactcgccaaccataactgctgcaaacaattcttacctcttccaccccatgtcactgcctaaaacccttcatcacctggcctcccatgcctctaagtctctgtacatcccctagcctgatactgtccccaaccctcctcaactccagacaccattttactctaccctctggaattgtccattattagcaaaatctcctttattttcaacctcctttctaagtatttcccccacattcttgttgtaatagagacacagctttcccaggactgtatagctttccttgcagtcctctaaagtggtaactggtttctctgccatacatttcataccactggtcctggagatattgtcaatatcttaatgtcttccttccatctcacttaaattttgagaccataattcctttttcctctcttaaaagttctcagtgttgaagctcaatccattagatacctctagctggcactactagttgcagtcctgtgcagactactgagtcattttctttactccctgaagacttaaactctatcttactctcactctctctgacattactcctattaaaatgttatgtttctttagctattctttcagtttttggtctcctctccttcaacgaggatgatttctagaatgttggttctcaaaatgtggcccctttgcagacatcgtcagcacctgggaacctgttataaatatgaatctgcagaccacaccccagactactaagcccaaaattctgggggctggagcccagaatctatgttttaagaagcacgtcaggtaattctgatgaatatgccagttccttagatcttgttattgtcattactgacaactttctctgagaccacaatttgaatctaccaatttttcactagtactcacccatcttaagtccttactttccccttaccagccagacatttgaatattccttgactcttctctttcacatactatatccaaagagtcaacaaatgctgtcagctataccttcaaaatacatgtagaatctaacttttaacctccactgcagtcacttcagtccaagcacaaccatttcccacctggagtattgcaactgttcttgtttggtggcccttggccctactttatctactttccgcaaagcagccagagtgtttctttcaacacctaaggttatatggcttcattgattgaaattcaccgtgcttcacctctttctctacaaaagccaaagtccttgtaaatgcctgtaaggctcgagggtgatctgaccttccctggcctgtcgtgtttcggtaaaagtaagctgagtctttcatagttaaaggacagcaatattgtcctgcatgatattttaaaaacccaatcaagaatcacacattgcatttaattttcatgcctttagtctccattaaaagtgtgccctttgtattaataattggagtgatgagggacagagtttaagaatatataaatattttgtccccaactgactgtcactggatggctttggcacccattggtgattcttacctgaatcagtaattattgtgatgactgaaaatagtgatttttctcactgtataattcttctatatttattaattaccttaatattatcctatagaacagaatgttcccttctcatcttttgtttgtttagtgtcagtattactcatgaagttgggtgtttagaaaattcaatgttgtataatactgttattattcaatattgtattttctcagtttgagtcttccatctgcgtcctttcatgtaaatagtataaagatcagtaatagaggaacatagagtaaagtgtgagcagagaagccttactctgagacaaacttcagagaggtgaactctgttgctgattaagaaaggcttcactgaggaagtgttgtttgaagtgagctttgaaaagtcataaaattttgacaaaagtggggatggggtggagcttaaaggaaaaactgtctgaacaaaggaaggcccggcagactaggaatttggcaataatacagtggttttggaccttgatgaggaagttgaaatggaacataaaaaccctctgcatttagctccatttatttgctcaggcagctctcactgcctaaaattttcacccctgctgttttgctcaggggtgggatgaggggtaatgagggaggaaattttagggggtgaaaacagcacaagccaaaaaccctgctcagatactcccttctcttgaagccttttccagatccctaataagaattaaccaccctctctcacacactctgttgtactttgtccttctctgttaaccagcctctgtgttttgtgctgtctgtatttgtggatacatcttcctcctttaaagcacgaatcatatcttaatcccttggcccttcttcccagtacttagcacaagtgctcaatacatgtttctttaacgcgtgtaacagaggaaggcgaggagagtgagtgggattgggagcaggaggattctgaatgtcattttaaggggtttgggctcgctcttcaggcagcaatgagccatagccgcctttgaactgtgcagcactgaccagagctgtgatgccaaaggatgcagtggaaggggaggacagccagcatgcctgggcatggtccccaagtcagaggacatcagtgggagaagggagaaggcatggaagcaagtggctaccatcttatgaatctgagcactcattcaaaggtggcaaggaaaaaggaaggcattgagcacggttttgaggtttccagcctgggtgattggaggctgatgcaggcttcttaccaaaaagggccctaggcagtttcaccaggaatgtttaaggagtttatcatgaccctatctcttcctcgtctaaaactctccctaaaatcaaaacagtatgtcctgttgaaatactttattgtatcaaatataatgagaagtaaaatattctctctacttgatgtatgaaacactgacttcttgtagtggacaattttcacttgtctttttagtaatggtttttattaaaaatagatgttaataactgcttgtttaatctttaaacgtggccctctgagagcagcttaccgtaaaagaaacggttgtcagctttctttttgctcctcagtccctcctgccccttcctaacaacagaaaatttgctttgcacctgctccaactgggttcgaagagataagcatcttgcaagcccagaaaattgtagtatcaaatctcagccccaactgtgaggcagcactatcattgaatccctgctgagaggcgttgctttcccaattcccaaaagagttctttctcccctggccccttttcaggcttgaactctgaccgaaaccctctttttaactcccagcatgcactgcacttggtactgacactgacccatccctgcttcctctgttctgcactggactcatcagtaggtcaggcgttggtagccctggggtcactggggtgcccaattccaataatgagcacatttagctaaggagaggaaatgtacccttctatttgttacagtccattgctttttttccagaaacaaatgctaaaagaacatttgatatattgtggtttggtaaatacacatagcactgcctaatattcacaaagttgcctcttttttttgcatcttccttcataaattaaatatattgttctaactcatgatttattttaagagggatatacctatttcacagctaggaaaatgttttcaaataaagttatattcagaatactcttgcaagaatttcaaataaaaatagcaaatactatttaaatgcatataacattctaacagacttgtgtgtcattttaaagggaaagaaaaaaaatgatgacaaggactttacaactttgtctttaaaatttcttcttaggctttccaaacagaccgaagtcattaaaaatactccttaacccccaaagtcacaaaaaagaagctacccaggtttattatgagaaggttgaacctctgttgaagcttgcaggaataaaaactgatgtaacaagtaagtaattttcagaatataatttcaccatctacaaaaacatacaaaagcaaaataatctgaatttgtccttaatgcaaacttgggaaactacttgtaatatctatagcatttttacgtcttcataacctactgcagccagctcgagggttataatttaattatttttgttatttttattagaatattaatattttctctttagaattttttcagatattttttcagacttaaacaattgttagatataattacaaaggaagctgtatacttgtttacatcttcatggagatgtttgctacttacacgttaattttgcagttaggcaagaaattgattttttgctcacttatatagttgatgtctttccatggaattcttccttgggttgttttcgttctgactctgacccctggtggttaggtcaaaactaagcactgaactgctggttttattaatagatgaatttagagatgctagaagcttaaatttgttgtctaaactaagaaatgtacttaggtttgtgccaaggaaaatagaaacttgttaatgctaaacttaatagatgattagtaatatcctttttgatttttttaatttggtagtcacatttctttgtttctttgagacttattttcgtatggtggggaactgagtagaagagtcgatgctatggagaatcgcaaccttcctagctttatttctatgtggcttcgctaacagtggaaatttgcaataaattttaattgatgaaaagtattataaaataagcctactcaggggacaagcccagagtgcaattggaacttcctagtcccagttatagattcctagggaagggattcacagtgatgtggctttactcagctgtaaacaaaggagataagtttcaagatgttaataatatcattgaaacctacacctagtgatctgatggattgaggtagaagaaagttcaaaaaaaaaaaaaaagcaagttttgtaggaaggtcagcccccatgaaatgtgcctataactatagaggttcgagagaaactaccatgaaaaactcaagaggaatttttgaattaaaataaagttatagtgaagaagttaacctttatgtttgtgaccttcggcttatttagaggtgatttacaagtaaaagagaaaattcagatttatgttttctttctactgaagatttccaaagattggctgaaggaaaagtttgagatttgtattagggtgagacaattaaaagttgaataaacatattggcatactcaatgactattttgttcattgcttttacatgtgaatactacaaagcagcttaacatggatattgctatatagcattcacttcaggaatctcattgtatgcttgctctgtgttcaacatagtgcaggatgcgagatgaataagctatcatacttggatgactttctacattattagagattcaaaaaaatgcttaaaaccattataactggggtatacataaaagaactttgatgtctcagaggtgatattttgatcggaagattcaagaaaagcatttgaactaggcagtttttaagaggcagacaaaaaatgagggaaggaagtcaggctaacaggcatgtactgtaaaagttgggagggggggcggagagagagagtgtgtgtatgtgagagagtccatgtgtgttacacccatacatctggagagtttgtgccataactttgctctactttcctcagtttttacattatctgaaatcttactctatcatcataaaatagctgccagtgaatttcatcctttcttattaatatccagtgggatggggagaggtgtgcatatgtgtgcaagagagacccaacatgctttaatcctgaagatgaattaaaatttccttttttaagtttgggcacagatactgtattagcgcagtcaatctggaataatcatttatttaaccatcaagactcttcccaggggctgaggacagatccccttttcctgatgactgaaatgcctcagctgaatctggattctgttagggagaagaaagggcaaaatgacttctaggaaggctctcaacaatgtatactacaggaggtataattccaggttatggatggatccttaagctgcactcagcagtttactcatcgtgtattgatccacagttggtgtaaatttttttttatcatactgttgcaatctggtttggcaaagatgactccaccagcagaattaaaattaaaaaggaagagagaaaaagagattggagacaagaaaactgatatacaaggcctgaactaaggcagaggaaatcatctaaatgtgctttccttcttaattgtattggagacaaaactattatgttctaggatttttttctctaaatttgtaaatattactaagtaccatatttaaacataaaacaatagaatattccgtaaagcaaatttagaatttacttacatttgtgcagaatggctaattattagctgcctaacactcctcctacaggcaaatttataaaattacatcatttgcttataaaaccattttagtatgcatattggctcaatatttatgaaaaatatttcttgaataaacctgtgaatatttgaaaagttttagtcttcctgcctatcttacagtgttatttttgtagttgaaataatatatttgaaactttgtatattatactacagaaaggtggtcataatactgttagtttcagtttcaaaaattatgtcatagtaagatcgaattcgtactttatttgaaagtatatggaagagtaaagcagaaagaggacatatcttctgcatgtccagtgggacattgttttaatgtatccttgtgtgaatgggtgagtccaaatggaattggaattacaaaataaaccctatatgatgagttaattaggaaatagtgctatataaatatgaagtataatatgaagaattacagctagatatatacactataaggtactgtaattttttcataaatttattttaaaaatggatcttaccacattaataaaaacacacttctttcattttgggttgtgctgaaatcctaactacttctgaatatagatcagcatcttttgaaatatttgtgctaaagttgcatccccactctgctaccaccaccaaggtagtatcttatctaatagcatcagaaaaacttccgggagaacctggaaagaattattttttcctaattacctattcgtacacaaatcaaagaagagtatgaacgataagcccatgctggcatatgatatcatttctcttgcttctgaaacaaagcaagttttagagattgtaccattaaaggtgtgacagatattttgaggatcagagatccataggataattcatagtacaatagagtgaaaaagttaaggcagcagagaaatcagactgaaaagaactttcgaggccatatggttcaatttttctccttgtgggtggagcacaggtgtgtggcactcaactttggcttggccacctacactagaggcagagtacgttgttactggacaatactgtttgacattcttatgaatgttcagagttactgtacctttgggcagattagaaaaggcacctcctctgtgctgacttacaaaaaggtgccctttcttccagactaattcatcctttgcttataaaaccatttcagtatgcatattggctcaatatttatgaaaaaaatatttcatactttcaaaatattcatatttcaaaaatattcagcccaaggtcactagattcagcctaaagtcatttgttagattgcaaatccgtcattcccgttagccaagtacctttgtgctaggcataaactgtacaaaatgagaacttgtcagctgacattcgcctctttgtaatttttatgtactagagttaatgttatctcttgtagtaatatgaaataaatgtgccccatctattgtataggagtcattgagatatttgaagagagatatcctgtctgcccctcatctcttgttcacgataggtacttccatcgccttcagttactttttgcattaacagagctgctagaccttatcatggtcattatcattatcatactcaaagacatttatctgaaggaaaccttgatctctgccagctcagggctcttgggagtgcctagtcaccagataattttacctcctgggcagagttgtcaagaaagtggtgtttgttatcattttccccttctttctcctaaaatcacgcttctaacatggctgttaacaagcctcttcatagtgtttctctggttgtttatggctctacttgaagccttccatttcttggaaatgcctcttgcctttctaaatctcacccagcagaaagctaggccatctaatgaaactgtgtcacaaaagattccagtagcctgaggcatcactccttccaattttacctgcattttaatacaaaatctgaaaagtaaatgttcatgcatcatatctagctagagagaaagataattctgtgtaaaagattctttttgttacctcttaaataattgtgggtgtatatggccagtcctgttcccagcattcagatgtgagttaggaagttggaactttatacctggggacgatgaagactcactaatggggtatatacaaaaaagtgatatgattaaatatgtatctgaaaatggttattctggctagagtgggggagaggtttgagggagacaagataaaaggctattgtagtacaggtggagtatcccttatctgaaaggcttgggaccagaactgttacagatttaggatgtttttagcttttggaatatttgcattatacttaaccacttcagcatctctctaatttgaaaatcatggacacaggaaggggaatatcacactctggggacagttgtggggtggtgggaggggggagggatagcatcgggagatatacctaatgctagatgacgagttagtgggtgcagcgcaccagcatggcacatgtatacatatgtaactaacctgcacaatgtgcacatgtaccctaaaacttaaaagtataataaaaaaaaattaaaaaaaaaaaaaaagaaaatactccaatgagcatttactttgaacgccatgtcattgctccaaaatttttagatgttgaagcgttttggattttagatattctggttacagatacttaacttgtctacacatgaaagatatttagtgatcagatcaatcagctaatttagggaattagctgggagaaatggaggaatgctatggcataatttaaagacagaaacaactggccttggccatggagtggttctggagagtggaggaaagggacactctagaaagaagtcattttcctgtcttggggtagatgatggaacacaaaaagaacaatatatttgagagagaatatatttgaaggtatacataatggattctgttttgagcttactaactttaaagtacctacaggacaggaaagaaaatgacatttcagtatcatatcccacactagaattttatcaccaaaccaagaaatgtttccttatgtccaaatcaaatctcacctgattttatttcaggtgattttctcatcaacattgaatatcaaccttaagactttcttgtcttcctgaggaagttgcatttgcaccaaagaggggagggggaaattcccagcagtgagaattgtgttcaaagacctgtaaactgtgaaggcttcacatctcctatttagaaagagcacaggttggcaatctcataggaaaaggcaaatagatgaaagaagaggctgggttacattttttgaaattacatttatctagcaatcctttctttgtttgtttgtagggggatgatttgaatctggctgtcactgattccagggcccacaatagcctgtctaaatacatatttggtcctttctactatatttaaatagtaatccagatcactctttatccttttgcctaacattgttttgtataaccacctattacttcatattataattcattatttcattagcatatattgtctatctccagaatgcaaattcctgaggccaaagactaattcattttgttcattttgctaatatattttatagatgtagatagtcaggttcttttcattttgtttctttgttctagatctttgattttattggacttttgcaatgttacttaaaaaattgctattttcaggcaggttgcattagtgtataatcaaattccacccacaatatcaaaaaaagactattacaaattaaaaaaataaaaatagcattcaataataacacagttctaaagctcattattggatctgaaaaactttaccaatgtaagctttggtataaaagtaaggcttggtgaactgattcttagcataaatattttttcatgatattcttatttttaatgtgtatatgtaagatgttttattttgcattttaaggttgtaagtacttgctgtagttataaatgaatgatcagcacacatcttctttgataacctttcaactttattaatattaatgtttcatatgtagttttattatggctttcttctgattggaatttaatatagagaggttttattcatgtgagtgttaatggcattttgaataagctatgggagaattacaatgtaacactgctggatacagaatgattcttttagacaccaagactaataatttttaacaatatcgaaaaacattgtaggaaaagcttgaaccatgctggcaccagggacagacaagcatgaaagattaatgtaatcttgcatataatgacacacattcttacacaaaaaatccatctgcaatgtcatgtcagtcagcagaaatctttgatgggtggatacagctgggctgtctcttctggcagagctgccctggaaaatgctaaatgtggttgtgatgcttggtgccatctgcagtgtgcccgtttatcctgtcttcactggcatttacgatactgcatagggcatcagtgactgtggagacagcgatacagagtgacagattcatttcctcggagggtctgagctctggtgggcctgtgtgccaccctccttcttgggtctgggtctcttataattggtgttggctttactttgtattttcacatccaactcttcctctttttagtctaacagttccagtacacattcttctggtttgtaaatcttacactaaccttttgactaatttattcatgtaaggttgccaaaccgatttaagattgactgttcaatgccagctaatatgccttatttccaaaatactgctcctcctaagcctctgatttaaaggacatgtgtcttatttagggaatactaaacaggcaccaggacaaattgggtaaccactatgcgtgggatattcccaaatgactttatgtagttgaaacaaatatatgaccttctcttacataaagctataaaacatcaggccagtaacacttagtcctcttgcccatgattaaaatataaatattcaagaataaatgctgttttatgacttgaccatatgtttatcatattattttgccagaacaagttaaaaagtgtgatcattgtttaaaactgtcactttgtgtatgtgtgtgtgtttttttaatagtaatggaatatgaagggcacgctctgtcactgcttaaggaatgtgaactccagggatttgatgggtaggttatattattaatcaatatatgttatatcatttatgtattaaatgccttcactagttttagctacatatttggaacctaacatttaaaaatatttgtagtgtatgtactttggctctatcttgttcatatctatgtaataataattaatgataatatgacatggtcatctatctctcaggatctggcataggaaagcaaaaagaggaatctaattattaaaatactgggaaatgacagtgtactactctatacttactaatgtgcatacatttgcatctataattatttgcttttaccatatatctagagaagcactaatggaagatgttatactggtcacatggcataactatatgatgatcttcttttgcaaattaattgataggtttaatagctacccattggttaacttgtctgtgatagattgagggaagatattttataaatacaagtaaataaatacattatttccagaaacaataagaaataattttaattatctcataatgtagtgactacaatttaggtatgttattcacagtgggcatcggaaaccattgttcgcaatacattggagtgtacagagattgttcactggcatgcaaacgttagaaccaaggcaagtgatataaatttcattgccattttttaaaattaggtgaaccaatttgctaaagtgttggactgatgtgtaagactaaaacatattatattcctttagggaagttctttttacgtgagtagatatttgagaatttaaaaagttgacaagtgtgtgaattatttgtgttacatggtgatgggcagggggcaaagacccataaggtcaggaaagggagttaggtctgtactttcaccaaagtgaaaggcattaaccttcccaaagactgatttgaatgtgctggggagggaagtgatgcaatcaaaatggagtattggcagggctgtttttcagaaatgcttatttatttatttattttttggatgaggagaaaacaatagctgttgagaaagaaaatgtggtaagtaaaacatgatttttccaaaaggaatctaattgagggaagtaaatctagatagcaatattatataaacattgggaatcaaaaatatggggtaggagattacttcagaactttatacttagaggtagacaaaaacattaataggcttcatttagaaaattgtcttacaagtatacaatttaagaaaagtccttgtgggaatcatgcataccaactacctatttgaatatgctgcatagtccctcactagacctcatgagtacatgaaggtagctgcattgcaaatgagtacctgcttcaaaacttgattaaagaatgagaataaagatatcacagatattaaacttgttcttacacagcagcattacagaatgttctgctgaatgcagtatctatcaatatgttttactggtatttgtactgggtaaagggatgaaaagaactttgcagaatgaagaaagacgattgctgaagtgtagtacaataatatttttctctttacctgaacatatttaatccttatttatttttcatggcaggtgttgttatttttcagtgtagagctaaaagatgtatagatttttcagttattatattttataaaccaaatagtttggcctaaccattatatgaattgagttatgtaagtgtttctaaactctatggcatgctgatttatttcagacttacaataatttcaaatttctactgaaagtcatcttccgtgttctaagactctttaaatcaggggtccccaactccgagactgcagatgaatatcagtcagtggccttttaggaactgggaggcacagtaggaggtgagtggcaggagagggatcatttccgcctgagctccacctcctgtcaggtcagcagcagcattagattctcacaggagtgcgaaccctattgtgaactgggcacgcgagggatataactggtcatgcgagggatctaggttgcgtgctcttgatgagaatctaatgcttgatgatctgaggtggaacagtttcatcctgaaaccatccgtctcccaccccaccctgcagtccatggaaaaattatcttcccacaaaaaagtccttggtaccaaaaaggttggggaccactttaaatagcttatttatttttgtggggtcagttttcccagtagaagctgatatggtagttggagtaattatcttaataaactggcaattttaagtcactgtacttagaattacatagagagatatatgaggagaataatagaaacatagtttcttcaggtacttcaaaggaacaattctcttgcaagtaaaattgtttgaaaatggaatattctacattggtgagttttctattcctgaacctgttctaaagagtggctaaaggaaaattttgggggaaatttatagaaaaggtgcagagatgagagaaggttaaccccaaaatgctatggcattttgatgagagacagactcaaatttctttaagaactttggcctgaagcacctccgtctgacactagtggaactattaatagggagtgattaggaaatcacctaacagtttggtttctagatacaggctgaagaagttaagagccaagaaagattctatgtatagtatttagtaaagcaaaacaatttggtaagtaatgtttaagaaatgctatttcctaagattttggagttgtatttattttttttaatgaattacatatgtttctatgagacatcttgtgacatttctaaacccaacagaaacagtgtatcagcacttatgacagctagttctccactgcagtgtgtcctaggaaacactctaagatccactgttaaaccttatgagagcttcagattctatattgctccctattttactgggcatgagtaggaagttttaggaaggaaaataaaagaatatcagctgcatagacttgaagcagtaacacttgcatttataagtgtgagtatagttttaaaaatctatagattttatgcaattgtaaatatatgaattcctcgctattaatatttgtttcagaatttttaaaaaaattgttgagttacttttcttttgttcatttcaccattaattagacccataatgttgtagacattatttggattatattgacattttatcagattgaacatatctgtattacttagtaaggtaaaaagcaaaaacaaaaacaaacttttccagaaagaaaaaaaactgtgaatcaaaactacaacaatatattgaacatttcatagatgatgggttcatagataagtataaaaacattcattaaaaaaatctttatcactctttgaaaaaggatatattatcacccagtgtttcttttctagacagaataattctgtttggagccatggcaaggagtttacttattttaaaaacaagatttgtcacatgcaaaggattagttactctaaggtttatgttttagagtgacacaagtgtgattaactcactataaatgattgaatactttgctttttgcctttcttgtatatttagactcttgtgatatttttgtaagaagctgttgatgaaaaaaaccaaactgtaaaatatttaaagaggtttattttgagccaaatatgagtgctcatggcctatgataaccccaggggggtcctgagaacatgtgcccacagtagttgggttacaacttggttttatacattttggggatacagaagttatagccaaagacataaatcgataaatgtagggtattcattggtttggcccagagaggcgggatatcatggagctggtgggaaggggagctcacagatgaattcaatgattttctgattgtcagttggttgataagctttgctgaaagattagaagtcagcagaaagaaatgcttgagttaagataaatggggtggtgtaggctgggtgcagtggcttagcagtggctcacacctgtaatcccagctctttagaaggctgaagaggggagatcacctgaggtcaggagtttgagatcagcctggccaacatggcaaaaccccatctctagtaaaaatgcaaaaattagccgggtgtgatggtgtgtgcctgtagtctcagctacttgggaggctgaagcaggagaatcacttgaacccaggagggagaggttgcagtgagctgagatcacaccattgttctccagcctgggcaacagagcgagactctgtctcaaaaataaaataaaataaaataaaaaattataaaaataaagataaatgaagttgtggaagcacaggttcttgttatgtagatgaagcctccagatatcaggcttcagagagaatagatggtcaatatctcttatcagaccttaaaaggtatcaaactcttagttaaatctctcctggatcaggaaaagacctggaaagggaaggagattctctatagaatgcaaatttctcctgcaaatgatagctttgcagggccatttcaaaatatgtcaacaaaatacattttgggataaaatactttgatttcctctagggcctgctatttgttatttaatgctataccagagtcaggttggagttggggatcttattgctaccaagtctgttttgtcagtcttatgatctattttttttttttttttgagataaattctcaccctgtcacccaggctggagtgcagtggtgcaatctcagctcagtgcaacctctgtctcccaggttcaagcaattctcctgccccagcctcctgagtagctgggattacaggcatgcaccaccatgctcagctaattttttgtttctttaatagagatggggtttcaccatgttggccaggatgatcttgaactcctgacctcgtgatccacccttggcctcccaaagtgctggaattgcatgcatgagcctggccaatgatttacatcttaatgccagtgctggccatttgcgcctaaactccaaaagacaagagggtataaggaggcatatccaacctcccttcctgttatgacctgaatagtttttcagattttctttgtgaccttcatggccaaaaggggaggatccattcagttagttggcgacttagaattttatttttgttttacaaaacttatttcctaggttgagtcactttacctgaacatgatcttaatgattgaatagttgttaacataaataaatacatattttttctaactcacttaatttcacactggttctactggtaaactgtttttcaaaataataagattctcataaggctatttttattaggtttcatatatagaaaaggtatctaatatattgaataatattgtagcttctaagaccaaaatgtcttatttcaaatccctgttctattacttactagtggtacaatcttgaaaaagttactttatctttctatgttttagtttcctaatctgcaaattgaaggtaatattacctattgcatacagttatttctccacttaaatgagttaatacatggagagtgcttaggaaaatgtctgatatatatatatagtaattattcactaaatatttctttattgttataattgtcatttgtattagtttcaaaagatttaacacagaatgtattatgacaaaatttcagatgtttcagaacatgctcatagggaggccacctctaataactctagcaatatgttaacatatgcatgacgctataattgtatgcaacattctaggagttaagtgttcgcatcctatgtatgtaagggtcaagttatttggtgctaaattagatttttttgggtatgactccacatagtctttttggtcacacccatatgtcagcatttagacagccatggattgagggttacgtttaagttcacagattagaaatctcatagagatttttgaaatcaggtaagtttcaagtcaaaccttggtttttttcattcataaagatgggactgtggcctattttgcagacttctgaggatttaatagaaattagtaaacacattacctgatatatagtttgtccttagtaaacatcattccttttctctgaataggtggtcatattgcgaacctctggaatcagtttagacataagaataaaacacacctaatcaaacatgacctgggtcatatcttgagtcttctaaccagagtagccttggattgcccaggctatgtggagctagtgggatgaggaagatggggactagagggaatagatggccgagagaaagatggtgggaactgactggaaagacactttcagcctttggtcaccaccctccagagcttcctaaacttagagaaccagtaactactgctgactgtggcccatagacagttttgtttgaaatagtgtttttaaatatattgaatgctagttgcttagtatttacaaattaggagactcagccttaaatcagaatctctggcttctgtagaaaaaccagatctgggtccattaggcctcacacgtgatgtgagtgggccacagcaaagaagtggctgcgcctttagattgagcctactcttccattcctgctgggcccttgtagcccttgagttgtgacacctgctttcactgaggcaaaatccactttccattgggttaactggtgacattttgatacgtaagaatattttgcttcttttgaacataaatgattatgaaatgaatttctggtacttctgtgttattttaatggattctgcccccatagtctacttgatataaagtcttaaaaaatatactagtagtactatctaggatcaaaggctaatagtattacatctagaagcaccgtatagcaataatgtcaaggagatgaaattcaggtcaggtttgtaattactacattcatatagtaatgataattagcagtttcttaaagcttcatattttatatgatttttattgctatctgtcttttcagagctttattgagaattagcaggattttatgactttggttggtgttagttaaatgaattgcagatgacagtattattaacaagaaatgagaatgatatgcttttggatgttaacagagcaaaacgctggtcagatgtgaattaacatgttcaaaagttttcatatctcttaacacacttaaagctattttgtctatggggaattatctagttattatatttgtgaagtaaacttacctgtgttgtgtttgtgttgtcttacccattgacacatattaacatgtttaaaggtacatgtgagcagttatgcacatagactacaaattagtaaactattttgaagtctagatttcatgacttattaccaatcattctgaagttttgccttctttgcttgatttgtatttttctagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggcaagggagtggctacagattcattaaactgacccttctccctcttttcctttcttacttgctaatctagacagcacaacacagaattaatgaacagactttgaaagatccagacttctggcatccccactagcaaatgtgagacttttgacaagtcatttaatctctttgagccttatttttctaatctatagaatagggatcacagatatattattcactttattacaaggttattgtagtactaacgtttggtttagtaaagggtttaatatatagttaaaccatcagtatatggaatggttattattctcccttcgcataaaaaatctgttgattacacagtaccaggtaagaagtttcaaaacagggccactccagtctagctgcttacaattccatatgaggtgaatatggtaacttgcataattgatgtataaccagataaccttgagaatgccaaaattacttgtgactggaagggaggataaggtttggaagggtgagattcttaagggcaaggctttttaatctttctactcactgccatttttcagcatctagaatagactatgccacagtgatgctcagtgaagcctattaagtgaatgcatgtaaagaagactttatatagtaaatgacacttggattaggtcttaaaatgggttggagctggcctgaaaaggtgagaatgagttattttcttggctgcaaaagtaataaagcaaaggcaaaacccaggagtgtttgaggaatagtgaaaaggccattcagtggaagataatggtatcaaaataggcccaaccatggaggctcctacatgccacagtaaggkctctgaattgtatttgataagcagtagggaataatgggatgtttcagagcaagggggcaacctgattggagcttgttccaggaggattcattttgcctcaccgtgtggaatgattagaggttgggagcaggagaaagtagaggtcagagacacggagaaccgttagagcaacactgtgatccagaaaagagggaaacatcattcaaaagctgattgtattacacaatcactcatccctatttaacgaacggtgctgggaaaactggctagccatatgcagaaagctgaaacaggatcccttccttacaccttacacaaaaattaattcaagatggattaaagacttaaacattagacttaaaaccataaaaaccctagaagaaaacctaggcaataccattcaggacataggcatgggcaaggacttcgtgtctaaaacaccaaaagcaatggcaacaaaagccaaaattgacaaatgggatctaattaaactcaagagcttctgcacagcaaaagaaactaccatcagagtgaacaggcaacctacagaaagggagaaaatttttgcaatctactcatctaacaaagggctaatatcctgaatctacaaagaactcaaaagaatttacaagaaaaaaacaaccccatcaacaagtgggcgaaggatatgaacagacacttctcaaaagaagacatttatgcagccaaaagacacatgaaaaaatgctcatcatcactggccatcagagaaatgcaaatcaaaaccacaatgagatatcatctcaccccaggtagaatggtgatcattaaaaagtcaggaaacaacaggtgctggagaggatgtggagaaataggaacacttttacactattggtgggactgtaaactagttcaaccattgtggaagacagtgtggcaattcctcagggatctagaactagaaataccatttgatccagccatcccattactgggtatatacccaaaggaatataaatcatactgctataaaggcacatacacacatatgtttattgtggcactactcacaatagcaaagacttggaaccaacctaaatgtccaacaatgatagactggattaagaaaatgtggcatatatacaccatggaatactatgcagccataaaaaatgatgagttcatatcctttgtagggacatggatgaagctggaaaccatcattctcagcaaaccatcacaaggacaaaaaacgaaacaccgcatgttctcactcataggtgggaaatgaacaatgagaacacttggacacaggaaggggaacatcacacactggggcctgttgtggggtgggggaaggtggggagggataacattaggagaaatacctaatgtaaatgacgagttaatgggtgcagcacaccaacatggcacatgtatacatatgtaacaaacctgcacattgtgcacatgtaccctagaatttaaagtattatatatatatataatatacagccttatgaacatatatatatataaaggaaaattaggcaaaatagcattacttgaggtactcaatagcctggcagagcagacattaagggtaagagagactggacttgaatttcagtttggtacttgactttgggtgggtaattagcctttattagtcttgattacacatttaaaaggtttaataaggccgggtgcagtggcttatacctgtaatcccagcactttgggaggccgaggtagtggatcacctgaggtcaggagttgaagaccagcctggccaacatggtgaaaccctatctctactaaaaatacaaaaatgagctgggcatggtggtgtgcgcctgtgatcccagctactggggaagctggggcagaagaataacttgaacctgggaggcagaggttgcagtgagctgagattgtgccactgtactccagcctgggcgacagagcgaggctgtctcaaaaaaaaaaaaaaaaaaaagtttaataatgtccatccccatagggccattacaagaatcaacttttaaaaagtcacacattatcactaaaaaagcaaaatatttttccctatgattatagaaaataatgcacattgttgaaaaaaattcatattttgataaccctattcatttagtatggattttagaatacttagtattgttgataagttgacagagcataagatattcaaatgcccttttagagtgtaaagtctttcagaaagtcagaatttaaaaggagagagatattcagatataatctgataattctagagtatataggaaaacctaaaatggtttctaagtagaagacaccaagatgattttgactcaaagagaaaaatgatgcattttgggccatcttttcatggcattttatttcttgacctttttgctttactttagtagttctgactataatggtggaaactttccaacatttccttccatgcaaagtggatgtgcttaggacacttcattagtacttaaattcctgaggtcattcattgactgccatacatcagaaatagaaagatgggtgtccctacaggtatgcctttgacataaatttggtggttggctataaaaactggtggttattcttatgttttagtatgtaattcagattttataaagaaatagcatttagttttatcactattataattttgaagagtatttctgatttggggagcattttatgtattctttggatatttgtagtaatgccattttaacctgtcttgtttagaagacacagtatgctgccaaaattctggtcattgcataggagttctagcattctaattccatctaataggaggggaaagtcatgtgtggggtatatttaatatgatgactgtatgcctagtcagggcttttgatagagaatgggaactagaactaggcaggaagttttcaagctgaacatgaggagacagtgtgcctttgaagccatttgcctcctggagagagacacccagagggagagtgtttagtaaattaatccactgagccaacagactaagctgctgaattatggtcagactcaaatggatcagatgtggagaagcctgtatttgaactgctggccattaggaatggtgtttgttgctatgggaactggtgctaaggaactatactgagagactctgattaaaagggggagggggaatggagaaaaaagcctgagaggacataaaaataaaaaagcaatccagttgttgtaaaacaaggctcaagccacatactgatggctgtgaaccatatattcctatagagtttgcataaataaattcatgctttccaattaatttgaggagaataaaatattgccgagggactgttaatttctatgatatttcaggcaaagaaccaaagtgtaggtgccgttttcatgagaattttagatatgcttgactaggaagtcattacatcacatttatctgtttggatgtgggagacattaacagccttatgaatattcatggtatctggttaattaagttaattgttctgcagaagtgcttgcacttccaaggacattttttttttttttttttttttgcctccatagtttctccctggtatttcatcagtaattctttacatgaactgctacttctgtccttacttttttgtatttggaacattttagcagctctcaggaggaagtggtaggcaaagtttctggtagtgttaagaaaaataactttcaggctaattaaaatgtttaccttgaggtagaacatttatagcttttgtgagaacattaaaattacgccattgttatttatgtgagcagcatgttcttttggcatgtagacatcttttcaaatagagtacagtttcctgaaacaaaatgtaatccatctttcagattatcccaacaaaatatagaacaagctatcgttttgcaattttacatatactttctcataaactttccttttttcttcagagtgtcaaaaaccacatttaaagactaagatacagattaatgagtagtcaatgactaaaataattttctgacttctagtcatgtctgttatcactgccaacttctacagaattagagaaaagttgcaaagcctgagaagacataaacaatttttaaagccatctctagcattctaaaaaaattttgtacttgggcatacccaccgtacttcaaactcacagggaataaatggtctttattttcttaagtcatgatatgtgtcattctctattgcacatgacattacattatgttttttaatagcctttctagaggaatgcttttacggtctactcataattaaccatggtaatggaggaaatgtgtttcatggagtactgtaatccatcgataatcctaaatatctgactctaattatgtggcctcctccaaaatctttaccacaaatctgattgggaagcacaatggattgacttgtttcttccttttctcctgatccattccagatttattagcaattagatggtcaaagggcaggctgtagagggccacaagatcattggaaagaccttgataaagatccactgagtaacaggtttctacactacttgttctcaaaacttagggtccatagactcaccttgtgaacttgctaaaacagagatacctgggtcctccctcctccaaacacattctgagtccatgagttggaggtagaacccaggaatgtacgtttttaacaagctcccaggtaatgatgctgcttggaccatgcattccagaggagtttctcaccaagtcactgtgcatacaaaccacctggggatctaataaattgcagactctgaatcagtgtgtctggaatggggcctgagaggcaacattttaaaaataatatattttttacttccattaatactgctattactgttttaatacctattatccttatttttaaatggacaaaaattgtatgtatttattgtgtacaatgtgatgttttgaaacatgtatacattgtgaaatggctaaataaagataaacatgcataaaattgacataatgatcacatactgattttacattgagaacacttaaaatctcccttagaaatttccaagtatataatgcattgttactaactattgttttagcctgttctcatgctgcaataaggaaatacccaagactgggtaatttataaaggaaagaggtttaattgacttgcagttcagcatggctggggaggcctcaggaaacttacaaccatggtggaaggcaaaggagaagcaaggcacattcttcacaaggtggcaggaaggagaaatgctgagtgaagtggggaagagtcccttataaaaccatcagatctcatgagaactcactcactatcacaagaacagcatgggggaaaccacccccgtgattcaattactcctacctggtctctcccttgacatgtggggattatggggattaaaattcaagatgagatttcggtagggacacaaagcctaaccgtatcaactgtagtcactaggttgtataacagatctcttgaatttattccttttacctgaaattttatatcctggaccagtatctccccagtccttcccacccattagccccagtaaccactattttactcttcgcttttatgagtttaagtttttcagattctacataaaagtaagtatttgcctttctgtgcctgtcttatttcacctagcataatgtcctccaggtttatccacgtgttgtaaatgacaggacctctttaatgccaaatagtattccattgtgtatataaacaggctgattgtccctaatctgaagacttaaaatccaaaatgctacaaaattagaaatgtttgagtgccagcatgatgccacaactggaaaattccacacctcatgtgacaggtagcagtcaaagtgcagtcaaacctttgtttcatatagaaaaatattttaaatattatataaaattatcttcaggctatgtgtataagatgtataaaacttttatgtttagacttgggtcccaccccccagatatctcattacaccaacagtgtaaaagtattcccatttctccacagccttaccagcatctattgtttattgactttttaataatcgccattctgactggtgtgagtgtggttttgatttgcatttctctgatgatcagtgatatttagctttttttttatatgtttgttggccacataaatgtcttcttttgagaagtgtctgttcgtatcctttgcccactttttgatggaatttttttttcttataaatatgtttaagttccttgtagattctggatgttagacctttgtcagatgggtacattgcaaaaattttctcccattctgtaggttgcctgttcactctgatgatggtttattttgctgtgcagggattgttttcttgatttctttttcagatagttgtaagtgtacagaaatgctactgatttttgtgtgttgattttgtgtcctgcaacttaactgagtttgtttattagctctgacaattcattcatggagcctttagggtttcctaaataaataagatcatgcctacaaacaaaggcaatttagcttccgtatttatgatttgcaagccttttatttctttctcttgcctaattgctctggctagaacttccagtactattttaatgacagtggtgagaatgggtattattgtcttcttgaggaacaagacattgtttctcaactcatgagagtaattttaataagcactcaagtattgtcattcctgtttgacagtaggccgtattttgagtaacaagggtcacagcataacttgccttttggtgaatcagttggaaccagtttgccatttagttaaaataaacttttctttgcactggtattactagaagtaattgtgcttatttataattaataataattaaatatgcttattcttagttacctaaaaaattatgatattaatgacctcttggttgataatggctaagctgcctcagcttctccaatttagcaacccaagtacatatcagttcaaagtaacacaaattgaagcaattatgtatgatcacataggaatgcttctgattaacaaaatccagaggactggtctttgccttcataaccggaacacaccacatgcatggtttcacagctcttggctattattggacttacttattatattctttaattcaagaaaaattgtagcttcattcattctgttcttaataattttaaattctctttagcctcctgggaatgggaagggctagctggtatagtcccctgtatctcagatttcagttacacataaacattaaaggggcctgacttagggcgctctttgcctctgtggactggtggggaaaatccaggtgtgtcttaaattctaataatcatgaaaatcagaaatcataatgtttcaaatacaaatcttcatacatgggaaatacaattgaattaaacattttcttcaatgtaggagacatttgtcagataacagaggggattctcatttggctaagagcttacctctaagattcattaaatgtgtttagagcatattttttgtagtttgtagttattttatttttctgagttattatttggattattttctcttttatttatgtatgcatttgtcactgctccccagaggcacctcattttggcattgaagctaaaaacccattcattaaggttgggatggagtgggctttgatatagctagcatttgggaggtagaaaatagacattcgtgatcaaaaaagctgtaagcggttactataaactatttttaaatttctaagtattttaaatattgaacaaatgtgtagacatttgatgtgcatctatactgtgaataagaacttaaacttctaatattcacattaactttcctgattttataaattctcgtttatttttcatctgaacattgaagaatgacatctacataaagtaaaagcaaatgttagtttgaacacattctaccctaatagtgcatgttttaaaattgctttggcaggatctaccaatgtattggcacattctcttcatggagttcctcatgtgataactgcaacattgcacattataatgggtaagaattcttccaaagcagttcatattttataaggaaatgttgatttatataaggaaggccatcttatttccatcagactttaagaaaaggcaggttctttgtctcttagagtagagaaatgtttgactaaaaaaccaaaaggcaatgctttactatgtggattgcctgtcttttcaaaatacttgctttgtaaagagcagtaaatgaagttttattgtaatctgtacagaaaaaaaatattgtagtgtgctcaaaattataattttataaccagatgaagaacattaatgaatactccttaagtatatccaacactgatgtaggactgtaccaagactctaggactaggattatgttattaatgaaaaaacataaccagaaaaaaatttcagccagtagatgtctatagatattttattatccctattggtaaaaagcatataagctcaggtatatgtaacactaaactactgttaaatctgtgtttaccttgcctatctactttaacttcgtttctttgaccatgttttataggaaatagcaataagctgaaaaatttagtactctgtgtttcttcactagtacctgaacaagttaaaaatggtaattattgtagttataggtaaagggaactgaagagaaagtgaggatgttcatggtctacagtacctttagatattctcctataagccaataaatatgctctcttatgtttgctgttttgatacaagtcctactgtactcactgattaatatttaatgtaatattcaagggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaagtaagtctttttcttaaaccaaaaattgtatcccaggttcaatgactgttaataacaaatttcattacattttagggcagaagactgtgaaatatcatttttaccatttaacagctctgatgatgtgcaagaaaggtaggtaaaaactcaatgtaatacagataacctgtatctttaaagcataaaacattctgacaaacaattgatcagacttaggatctttggttatttttctaacatagtagtaaagaatatagaatcacagactcttacaggtcctagtaagcaaacaactactcactcagcctttttctctttttccttccttctttcctcccttccttccccctgtctctccctccctccttccgttctctttttcccttcccttcccctttctttcctttcctttgtttttttccctttctttccttttccctttcccttttcttttgagtgcctactatatgccaggcactttgaatacaacaatgcaccaaaaaatgaacaaaacacacagttttgtccctcgtgataattttggtctagtgtgtaatacaaatattaaagccatattaaagaagggttatagtctttaaagaaatagtacattattattccttataatactagtttacctttaaatgaatcaacacattatgttggcagcaacaaaattgtacgtttttacttactatctaattgaagaaagtatttaacatatataatgatgagttctctaattttctcatatttaatagatttgtgtgtgtctgtgtgtctgtgcgcgcgttatctgttttatgtctttgttttgttttctttcttttaggagggcacagggatctcccaaatctggtgagtcgaaaagtatctccttgagaactgtgccaggttctgttgacattttgttctggtgagggaaaataaccaatcactttcattacctttagactgtaatgatcaatggcaaatgatccagggtcagttcttgaatgtcagcattatggcaattccttgcctgtgttcagtggcacctagaggcttggcacctaataccaggttagtaagcatttttattgaattgttgatacatttcttatagaccattttttttccagggtatccaattaactgttggttagctagaaacttaacaggtagtttatctttgtatattagagattctaagggatttgtcatcacagtaggttgagaacaactgttgaactggaataattatcagataatcattgactatttaacgtcactgaggctaaaataatatttcctaagttttattgatagaattttatgcctactttacttgatttattcatttagttgtggagaacattatattaaatactgatatttcttgtgaatgtctttgctttccaactttaatgcaaacataaatatccttagcatgaaaatcacacatatgtatatttgatactgtattagtctgttttcatgctgctgataaagacatacccgagactgggtaatttacaaaagaaagaggtttaatggacttacagttccacgttgctggggaggctccacaatcatggtggaagatgaaagtcacatctcacatggcggcagacaagagagcttgtgcagggaaactcctatttttaaaaccattagatctcatgagacttattcattaccatgagagcagcacaggaaagacccacccccatgattcagttatctcccaccaggtctctcccacaacacatgggaattatgagagctacaagatgagatttgagtgggaacacaaagccaaaccatatcagatacttttagtcaaaagaaacatttcagttctatttaatgtgaatagtagtgcatatcaatctcctgcccacattttcaattgaataaaatatgagacatcttatatatatctttttatccatgggatatagacattccttctcttgcacattcttcttaatcagctgtccattatggggctgaaaatatttctttcctgaatccaatcctgtagagtgtaggagaaaggatcgtgagtgttgtgaaatataggcaataaacggggaaatattcaaagttagagaagaaaaaagagaaactgcaaacttcgatattgaaaacccagatggcaaggtcctcattaattacatctagtgctaaaacttcaaaggagtattttgaaccttgtgtgatttagaaattgagcctggtggttttccccgacaccttcagaaatcctagatagctgtgtgctttcataatgtagtttccctgactaaacttgaagacgtggctagctgaccaaggagctatgtttggcaggacttgagacaatgtttatctaaccctgtttgtttaaggaccttcttgggagggtagacctgctcttctgggaacaatcgattcatagctccttcaaagccactccataaatgttctgcttgactagaattccactgttgactctgcaggcttaatcagtattaatgaatttttcagagaaggatgactaattagagatttcttctgtggtttataatcacaacatgccatctttgcaaagaccttttgatcaagactcatttgaccggagatttttcagagatgtagcttctgatgattcaggatgattgaacaggagatttcactttcttctttttcccccaccatgataaataataatttatgttagaatatctcagtgcaaattgccagtaggaactaatattcttatattctaagtattctaagattaaatgtgttcatatatgtgagacatttaaagcagtgccagccatgtaagttgtgtttctatttcaagtaaatattgcaaagcaggcataggatagtgcttttaatgtttataaattatgcaattaaagatgcacagtaacactaccatgaacgttttggtgctgtttatttttaattgggaagaagaagcatgatggaaagcatactgagcacctggagtattggtgctgatgaccattttttctctgtgtgcctttgaacaaatcacttaaacttggagttgtcttttccctctacatgaaatgagcgaatgatgagataatctctaaggtcccttacagctctgacttgagctttcataagatactaagagctctttttttattttgttgttattcttaaattaacttcatgtttgcactgaaatcaagctagaagtcatttgtatgtatttctgcaaactgcattctatagcttgatgcatttgtgagtggctgttttggcactaaatcacacctctgaattttcactctcttatattggatggaacagttatgcaagattaaaatgttcagtcatttaactgaacatgtgtggcagcatttgttcactccatttcatccatccaaaggccactttgatttatttcatttcctatgtcacttagaccttctgtctataaataaatatttaaatcacactttagattttagaaaatgttgagctatttgttacacaacttgtgcatattaactcttctataatacatcttttaacaacatagtttcacatttagaatttctaattacattgtattttaaattatgtcttgatatgtgagtaggacgcttgatggtttgctttgtaaaatgctctaatgtaagagcttattgagaaggaagccagtgatttaataaaactcatttgaaagcctgcatcatttaaaaaatagcaagatacggtttatgaattttaggtaaacgtaacatggtgatttatctatcttgtccaatactttcagtaaacagtatacttgttataaggaacagtatgtcataatttttggtataatctcttagtaaatttcttgatgtctaatagaaatatttaatttcagattaaataatggaagtatggctcttataattgcccgaaacacttctcggccagaatttataaaacacctgaaaagatatgccagtgtaaaaaatcaggtatagtaaattctttttgttacttatttgcaaagctattaatcatgtagaaaaagatgctgcaagaattgacatcgaatcctgcctcataagaaggttttattttcttctgaatatattaatcttctttttcccaatctatttcatccaaattttgaaaagcatccgccaggattaatatagattggccttttttgaatgatgaattagtggttatgtatctgtaaccacaaagataaaataggaaatgtagtgttatattgcaatgtgaaataaattaaggataaaattccatactcaggctgttcttcagaatgaaaagaagtgaaatttgagagtttagccttcttgatattatggcagcagactttctaaagttatgatctttagatcttcctgacatttgtttgcatatctgcattgattgaaatagatctgtagatatgtatttaaaaatatgacagttttatacaaatattcattcaaaatgagaatatgtgaagatatacatttccacttaagtgatttgctttaaagagaaacagtaactattacaagccatattattttggcagctgttttgacctgattattaggaaaatgatccttgaactatgtgaatttctgaaattgtgagtctttgaagtacataggtatggttgtaaaaccctatagtttcacactttttctttttctttctttttttttttttttttgagttagagccttgctgtgtcacccaggctggagtgcagtggcgtgatgtctgctcactgcaacctccacctcccacgttcaagcgattctcctgcctcagcctcccgagtaggtgggattacaggctcacacctccatgcccagctaatttttatatttttggtagagacagggtttcaccatgttggtcaggctggtctcgaaactcctgacctcgtgatgtgtccacctcggcctcccaaagtgctgggattacaggcgtgagccaccacgtccggcccacacattcttaaaggtataaaatggtgcttggatagagttgggagataacagacgggaggaggaggagagtaaacccagccaatgactggcagctgaaccttgcttatgtaccttagccatagcaagtctctccatttttgcctcattatattttaaaactttcttaggccatcttcatgaagtttgatctgtcagtaacattatttgatcctcatgtattgaacaactaactgggctgcttaggaacttaaatcataaaaaattacagtcccactttctttatatgtcaaagtagatcagcaggtataatgtaggttgtgagcctacataacagttttatgtatgtgtttgggtggaatatggagatttattgattttcaaaggaatatatgccctttcacattttaataaatttctaaacattaaaaccaatttttaaaaaacccaaagcactatatattcattgctgtttttaagtcagaaaatagaaacaagaaaatgattttaaagcactcaaaattccatgttcctcaagattagtgtcattaccttggtagaattttttccgaatccttttttattaaataaatgagaagtaaagtaagtattaacctcattcatgtacctctatttgagaacttaaatagtattaacctattaatgtacccctgagaagttctgtatttattttggggaggtgtatgttgcacaaattgtttatggaaggtctcttttgaaattgcctatggggcaagtctctcaggcaatttttgtaaacattcttcttcttcatttttttaaatcaatatacctttcttctgattttaaaagcaatggttaccttacacataaagacagacatacagaaaataataaaaatctgtatcgataggaagacgttttctaagagataatattatgcaggatttatcatattttctcatgtactctacgaggcatatcttgcttttgacacaagaaacagttgcctgtgtgtgattcactggccttaactctgatttatttatcaactttcaaaaattaaaatccatgctattttttttttttttgcaaagaattctaaaatattttgcatagtgtatatagtaagaaagattgattcccagggtgactgctttcaagcaatgttaatttgatttgttaattatccacacaggtgtgtttatttaggctctttccttcatggtgacattaaaaatgtgaatttatataaattttgtaagattatgaaaatcagatctatgtaaaaatcatgtctactgcataattcatagcagtgctggtattcaggaaggaaaatgtggcaattcagtttaaggagagtaacatctgcttctctgaaccatttttaccaggttgaataagcgaatgttactgtataacactgtaaaatagattgaaaccaccatgtgcggagtggctcctgttccttccccatctctgtgtaaaattagatagaggctgaacactacccttcaaagtccttgcagctccatcctattgctttgccccccttctcactgtccacacttttctctttcattgtgaccatttttggtagggagtttaaaaccttaaatgtgagtgcttcccccaggatttctttgcagccctctcatcttctcaggatgccgtctcctggatggcctcattgcccctcacttttgaactgtctgaacatcatgcactcccaagggttctgtcatctcgtcttatctgcaggacctctgtcttcttgtatgctgaagaggttctgaaattcaccggcatctggaggccaacatgtctacagccgaccttatcttttcccctaaagttgttccttctgcgttgctctgtgcgggtcaatggcaccactttctacccatccaggttaccctgaactgttccttcttcctcattcctcactaccagtcccctaacttgttctgttggtctcctcttaaatgtttctaaaatttctccctcaccttaattcaaactttaatcctttcttgcttacagtagcctccttttggccttcaggttctctggtcttgtcttccatacctctttttagagaaacttttttctaagacacacattggatttctctcctgcttaattcttcagtgcctttctcttgttgtcagaataatatggaatatcctcagtctggaacacgtggcctttgtatccaggtccctgcctgtgttgcaaccccacctcttattaccaccctccaccacattcccagtgttttggcattttattcgttggctaaggttgccataacaaataccacagaaaagatggcttaaacaaacagaaatgtatttctttcatggttctggaggctagagctgcaagacaatgtcagcaggtttggtttgtcctgagtcttctctctctggctggcacatggctgctttctcacagcacccacaagtgagtggtctttcctctgttcatccccgatgccttttcctatgtccaaatttcctcttcttataaggacaccagtcgtattggatgagggcctaaagacatcattttagcttaatcgtctctttaaagatcttatctccaaatatagttatgttctgaggtatacagagcgaggatttcaatacaggaatttgagggccaaggggcatgatgttgagcacctaggagtcacactgaattctgtgtagttgcttgaccatggtttgcctctagttttgtaaatgcttcctctctccagactttcttctccaggctaaatcttatatgttctttaaggctcaattcaaatgggaagctttcccaacatccatagcctgtttgcctcctcttgtttcctctgttgaactccacacttgcaccatcatggcactcccctgtatcaaaattgtaactgtttacttctcctccccgtgccccaaacataccctcacacaggatactaagctcttggctcccgaaagtcccacttaacagcgtctgtggcttcacagttaaagcatttgaaggatggctagatcttcattttgtgaggagtgcacatgacaactgctgatttaagataatagacttactggtggtggctgtcaattcttgacattccttggcttacagctgcatccctccagtctctgactctgccatccttggcattcttctctcataaggacatcagtcatattggattaggtcccgccctaatgacttcatcttaagttgattctacctgcaaagaccctatttctaaacaggggacattcacaggtaccaggggttaggacttgaacatagttggggtggtggagggaaatataatttagatcataacaggcagttgtgtgttttaaatgaattatcaactaacatgaatgattatgtagataattctacaaggatgaggcatgtagccaaggctttatacccgaggtaggaggtctaacgcagttactgtcaaacagttttgcttggggccctctaattctgtacctcagtcacaacagctgatgccatcatatcatctactgtttaactgtgtttacagtataaactggaaagttggctggaccttggtatctacatatgtaaaatatgggtgttggggaaaatattagttttctgtcaacttttaaaactgtttcattgaggtttacatgtggaaaaggggaaaaactatgtagatgatgtttaattaggaatgtatctcatgtcatttttctgaaaactgaaatgagtagttatacatttctgctcaagttatttggctatattttcttaattatgtcagaaaatacatagtgctttttcagtatagtttccttaggcaaacaagaaaaaacgcaagttgaagtttaccttgcaccattctatagtggtaagtaaacagtgatcttgcagcttgtgtccattgttaaagtgggaatggggcaggcaaacaccttttaaaatccatatttgattggctttctcttttaaaagaagacatacatcccattttatcttcagaagtttagacttgcgttcttccaaattaaattccaagtgtgaaacttgtactagtttgctttatgtcagctaaactaattgacaagttgataatggattatatgtcttctgtatctacaggccagtattaaagattatctttaattgaaaaatctacagtatcactattttatgtaacttctcacagatatgtactatttgtcataaaacaagatttctaggtgctagatctaaaagaacccaaaaggctttggataagagattccttcttccaaaaaaacttggagatccctgttcatagtctcaaagctattaaaatgtcagcatacatgctgatatttacttgtgagagagggctcagtgaactttgattcgcgttagtagctagagataaaccaagtataatgattatttgtatttatttttagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattaggtaagtctatttatttcaccgcttattgtcaaccagtaaacataaatctaatattacaacgaaagctctcttctctgaactatcaaagcaggcagttggttagtttttaaaaaatcagtaaatcagggaagcataaagagacatgcacaaatttcaataaataaaaagcaactttacatttattcaactgttatgtagacccaaggcattttctttggttatgcgtgtctacattggctttctaatttattgttgtgcataaactacagataatgtctacaacttccattttggatttttaaaaatggatcaagatcttaaatcttttagtggagccatctgaatagtaaagtgttagatttttatccttccatcttagtttcctctcactcataattactgtaacatgttttgttcagtaatttgcttttattaggcctttacagagcattcaacttcccttgggaacaattttacatagcaactggtataaacaggtttaggaacctgcaaacgcattcttggtaggcattgtgacactcagtggttagaagaagcatgcaggggtgcccactagacatgggtgttctagaggcataactgactgttttacagaggtaatggagagcattggacaatcaaggaagtcagttaaggaggttttagagcaattattgttgttgatgatttatcaatcagaccttctcagttttctagattacagctctgttgggaatgctgtgtttgttatcaatttgtatttggcattggcattgtgtaccatacttattaggtgtatgtgaaaaacaacaaaataagttgatgaaataatgtattttctttacagattgcatccaagacttatcagtctttatggaggaagcatggaagaaatgattccaaagtaacatgtaattgtttctaaaagaaatgtacaaactagaattttaatataaagaaatgtggccatgctttaaacctgtggtccccaccctttttgggaccagtttcatggaagacaatttttccgtggatgggggaatggtttcaggatgaactgttccacctcagatcatcaggcattagattctcttgaggaacatggcactctagatccctcacataccagttcaccatatggttcgcacttctatgagaatctaatgctgctgctgatctgacagggggaggaactcagtaatgctccattgctctaacctcctgctgtgtggccaaacggatatcctaatagaaattgatgttactaacaattagcctctagggctttaaaagtcaagatgaaatatcaattcaaattctgtttttagatatcaattcaaattcttttttttacaatgtgtttattggacacacaaaaaaactttgcaaccatcataatacatcaatatttaacctagataattctgaaataatttggattctttcatttttcaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttcttaaagtggtagggttttaaaattcatgatacaagtaacaaagtaagttgataacaaatactattttgaactgggcaaaatctagcccaatatgtaattgtgttccccttgtatctgagaggcctgtgttggacaaccatagtactctgctttcactgtgctcagataacctgaaatatatagttgtttctgagtagttctgagtaggaaagaaccaaatgtaaatttccttagagaccatcctggagaagacagttctaaatcggggcttgatttttcatctatgatcctagatgttctcctgaaagaatgactagcctttttataacgatacaaagttttttaaaaatacataaatgtcataaagtttattcctgtgtatacacactctgggttcaggaggttttgtgcttacatttcactactcaaatgccttcgcaaatctcagaacattcctcaccatcactgcaggcctgtgaacagataactttcatcaattaggatggctggctagtggcagggacttcatataaagaaatctttcccagaattgtttttccacattgccttctaatttgatcactccctataacagatgttcaaaattcggccacagctctcttatgaaggcagagtcagataaaatgatattctgcaattatctagatcataagcataaaataaatattacaaaaatgattgtatttaaagaaattttttaaaatccagaaagtcatttaaaatagaacctcatatagtatgaacaaactataaaaatattttacatttca

SEQ ID NO: 7 - DNA, 145347 bp, Homo sapiens
  mutation 121205: a/t SNP in forward strand
attgctatttgggcaacaatatggctccttcagaactggtcgagaatttctgtggtctttgcttgaccttcaagttgggagtttcaaatcagaggctttgaagtctggaggagttcgcagccattaatccttccggggttgtgctaaaggcgtttctagaaagagatcggaaagacccgttcagcacaggcccattgcatcttctctttgaaaacgcttgtctgaatcaagtatcttatacagacccgagactgaggggagcaagagcgcaggtccggctgtggcgaggtgtccaccaccgtacttgtggtcaatgcctggactagagagccgaggccgtccagggcgggctggccagggaaccagaagcgtccctggactggctgagtgagggtgccctttccagcaacccagtggccatggttaaaaggcagaatacaaccgtcaaagaagtccccagctcccacataagagagcgcaaaggccaatggaaccaaggcctcctcgcgagaactagctcgctttgaggacaagatcctggggatggaggtggggactgacgtagtgagagggtctggaggaacagtcgtagctgaaggtcaggacatgaagaattgcacgtatggtagggatagaatggcaggtacaacttttctgtactgaaggaactgggagaggacgatccggttagggaggttggggaactaatctcaacgctgcgtttacagatgaagccgcttttatatggcgtatatgtttgcttagaggggccgacggagattaggagaagccatcctttggcgccaatgatcaaagcgtctgccaaggagaagaagccaagggatgggcctttcagagagggcaaggagtcatgctgctctggatgccagtgtcaggacaagaaatcgaaaggagcgaggactcttcactgcgtgcctcagtctccccgcttctgcctctttcacctctgtcctacttccggcgcgaaagcaggccactcgctctgatctagacctagttaacattagcttttcccttccttccctcaaatcccctcccccctctatccccgtcccttctgccgcctgaaagggttaatctctcctgcgggtaaaaacaggtccgcggagtctctaactggcgacagatgggccactttcttctggccacaaaggggccggaatggagcgctccgcggcatacaaatgggcaggtcacgtggttccaggctcttggctggaccgggaagaccatatggcgcatgccggggaggaaggaggaggggcgggggtaggggtggagggtgaggggagcggttgtcggaggagggcgggagacgagcaaggcgtggggagaagtggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaaggtaattacagttctttcatttttttgccccagaatagaagcaataactgaagactgatgaacctacatattctgtatgtgtgcgtttgcgagagtgtgtatgtgtattgagaccagcatccccctccataattgcccataagtactcacacataatgagtcgtgtcactcaagtaccccctgcaggctttctaatttaaattttaaaaatttgggtttcttttgtggatagcataggagcttcttggattttttaaaagaatgcacggtaactatgattatctgctagtgctgattttaaagtcccaaaagcaataatgacttcactttctcacttcttacagtaagaaaaaaaaatctatgttatcaatatatattttgtgtgcatgtattttacgcacattgggagtgtcaagctgtgttttcagtgaatgaaagggacatggataccttgagtattcacaccatggaaaataaatcaggttcagagatagtttagttgagaggggggaaagtggagaaagggagagggactcactcctgctacctgttaccgctccagaggcggccaagtccccagcagccactactggagccagaaattcagttgttttactaaaggctttttattttccttactagaagcggcaacttcgcggttgccaatcgctgaccattataattactcaatcttttaaagggaggtttgaggcgaactttgaaaagccccaataaagagcgggcggccctttcaatgggctgtttattagagaggagccttccgcacctgatccccggcgcgtgggagagcgctctgcgccgcgcccccagccctcgccctgcagctagcgcttttgtacaaggtggaaatttagcggtgggccagagatggaaggcaagaaaagaaaggcgagggaggggtggaagaccctgtccacttttgttgccaaatgttacattgatggtgaaacaatttggtggaaactatttttcctcctttctgcatttgcttttcagtatcccgtcgatgtaatcttcttaaaaatcgctgccagtattagtaaattacgcaatggctgttcaacttaaatcgctaagtatctggaagccaggacagaaatggaagtagaatgtgtgattttacagcttttttttttttttatggagttgtgagtaactttgaacacatttggataaacatgaagtcgctgaaatgtacagtcatttccacacacattatcctgtcgggcaaccaccataaacacatttaagttaatcactaggatacaaacacatatgcgtgagtggtgtacacatatacatattcactaccctcccccagtcctgtcctcactcctacgtactagcggggcacacgcacgcgccattataaaacactgcatttaactttttctcagaggcattcattttgtaatgggcaggtacttttcgcaagcatttgtacaggtttagggagtggaagctgaaggcgtatctggcttttgaatatagcgtttttctgcttttctttctgtttgcctctcccttgttgaatgtaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaaaccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtgagagcaattgttgcatttcttcttaaagggattctgtttttatttttggggaaagtagttgcttttttgctgagttaaaaaatactaaacactatatgtagaataaaagaaaagaaaaaagtttaccttggcatatgctcttgtctgtttatcttgcacagggagtcaccagttctatgtagataatgaaaagacctaactgatatttcattatttggaatatgggactggacggcagtacaaacagtgtgtttttttctttgttttaagtggcttagcctttaggttttttatttccatttttaaaaatgattgttacatgttttcttctatttctttttttaaaaggtggattttaataattattaacaagcaagacataaacaagtatcctagcttagtttgtctatacatttaagatgtataaaacattactattttcttggtcttctgttatctgtacatttttctgaactaaacagttttatcttgcaaactagtactgtcccagaaaaatttatacacctttaggaagtaccaaagggaaatgagttaattaatttaaagaatccaagagaagtaacattttataattgttctattaacatcttgtgatgatttccatcatttttccaagaaaaagcataatggattatttgtactgaagaacacactatttgtactgtatttaggaaggtgtaattatttcctccccccaccctttggggcactattctgttgtttcatgaacacaactcactggaaaaacttatggatgattctgtctattgttaagtccacttcaaaaaaaaaaaaacagtttggcatttcttttcctctggatgtattgactgacagtcatgattcctagggaatatcattttggcacttgtgccctggctctactgtggtgctctgattactgtcattagtaactccattgtttctactctgattcgggtgccacattggatgactaccccccttcccaagcttgttcctttaatctccttctcattggtgatttaggggttccagaaagctgacctcatttagcaagctgctccagaaaaatgtgagtaatgtaatggacaggaacaattagccatactaataacattgccaatgaggctgcgtcaagctgtgacagaagcagtaaggaatacttcgacgttaaaaaaatgtttgagagcaatttaaaatatattattttaacatgttttctatcagccttcatcacatgacagaaatacttttaagttagtcccaactttatctaaaatgcagcaatctcattccaagtgaatcagagttgttattttggaatcaagctgttgctttctatatcctggattgttctcactgttcttactttaagagacataatactgatatgatacttgaatactaccagccttccagtgtaggaggtaatgaagtgagcattcagatctgatctaacctattaagtagctcaatttcacctgcaattaaaattagacatcttcatgcaaactaaaatctgttgctgtagtgaagagaagaaataaaagaatgccattttgagaattccagcttccaaaatagcaaacagggaaatctagactgtgttcttttgtaaggtagaaatgaagactaaaagttaggttttttttttttttcttcccattttgccaatacaacttcattctaaaacatagggattctttcagtcagtcaaggagtaactcacatgccaccatcttttattcaaaggcaggcacagatgttccttctgcaggggaggatttaatttatgaaaatgatattgtttatgcatgaatgaactgcatgcactctgcataacacatagcacttccatctgatcagagaaataccacagaaccagtgccaatgtcagaaacatattctacaaatttactcacttaaatgtttaatgaatatttggaaggcattttcaaaccataagaaacattttaaattatcttcttttatgaattcctacccatatttaaaagagactcttacagtttttgtaattggctaatgcttatacccagtttgtaagaaaagaacatattttactaaatgaaaaccaaccaaaaaaaaatgctggcaagtttggcttcactggaaaaaatatttcgtttagttttgctgtttaatgcttgtcatgaataatatttgggattctatctgtttcttcatcttgagccacgactattcctatcaaataagatgcttaggtatacttgtttaatgtgaaaatcctatgaatagttatttctagaaaaagctggtatgtaaaatcagggggaaatttcataaagatgaaattgggctaaatattgtaacatgcataattactattgaataggaacacttcacataacatattttactttatataaccaattgcagctatatagtatgatctatctacttttaatcattaaaacaattatatataaattaaaatgaaagattataatatcaagagtgttctactaattttaggtttataatatgttacagtaaaataccatttgaaataaattttgtgttctaatttatcttaaaatctctctgtttttacatttgaaagtccttacattcttacaaaattaatgcattttctgaaagaagctagcaattactaaaatgatatatggatcattagctaacagtttgaatcaagctgttttagttctataattatacaagaaatttaaagtgaaaatacctattaagcaattaataaaactaggtttcaaaatattggctaattttctcctaatgggaaatgtaaaatagcaaaactgcttcttaaactacacaaaaacctcctcacttctccttttctctctctctaacaccacttatttcctgaaaatcatctaaataaaatatttaattccagggtctgatgaagaataaaagagccaatgcaacatcttgtggaacaccaggactgagaactcttgttgttaccattgcaaagaggcgttctggcgtcagatgcacagtgatttgtatggtggcataatcattggctcctggccaggcattatgtttcagaggacactattgtcaagaaccattcaactagaaatctgcactgtatgcactcaaaagttgagatcatctgccttcctatgacaggaagaattctgtgctggcaattgactcatggactctcttcacatacactaaggcttggtccagtggctctgatggaattaactgtgcagccaaactagtggcattgacaagacagggccacagtctctggggacttcaggagaaattgctaattttaaaatgcagagtattatgttaatgctggattaaatcttcagatacattaaatgtggatttggccatctaagcattattatgttatttgcccagttaatttagaggtagatggatggtgacaataaccatctctacagatccacaattctaagagatggatccaattgtgaaatgatatggagagatagagtaagttcaatctagcatatatgaagtaatttggtaactgacttttcttttaacaagatcaaaagctaacctgctttacactttcatgtctaaggacagccaaccagagagatggcttcacacactagcccactgctaagtgcttttcattcactttcatatttcatcatcaaagcaccctcctgccttatttatagatggggaaacttcaggaagttgagatacctagatatttgcattcctgtcttcctttcttcattcaggtttttctttcattgccacttcctcaaagaagcttttactgattcccatttaaaatagcaactgacttcaactccaccaaaatcactgtattgcccctccctctttccagagcatttgcctatcaaatgttatcttatgtatttacttgtatagcttaattttaaactatctatctctaggtcttctgagcacctgagaaacagagacaaagttgtctcttctgtgtgttgctgttcctctggtgcttagaagacctagaggatcctcaataaatattaactttccaagggaactgaagagcactaatgtgatgctaaagcctgttgccttaaccactatgctataagtcaaatcagttgagaatggagaggaccacaaattattttcagtccagcaagtgttataaacattaattctataaaaagaaaacaattgaaactaatttcttattatattgcatggcaccaaactccccccacttcctttttgaggatcatgagttgtctgtcattgtttctttttattgatatcaattggttaaatataatctggaattggaataaaagaaaaactattataggctttttccagaccatgtatttcaatgcatattattttttcctttctgttcattattctttcagtaattgcacttgttctatttttagtgttatgtaaaattactgtagctcataatttctattttgaagggttcagtgtataaacttagcacatcaatactatctttttagtgttcgcgctcaatggtgtcagttaagagatcaccatcacttttggtgacgtcaatgaaggggtattgcaatgcttaagagaactgttaatccctttccactggtgtcactaacaattgtagtgcttgtttattcatagcaggtacgtgactaagtaatgttaacatcaaagcagaaagaggataatagagtgttctaaaaagaaaattcggtggttgggtgcagtggctcacacctgtaatcccagcacttttgagaggccaatgggggtggatagtttgagcctaggagttcaagaccagtctgggcaatatggtgaaacctcgtgtctacaaaaaatacaaaaactagtggtgcatgatggcatgcatctatagtcccagctactcgggaggctcaggtgggaggatcacctgagcctggggaggtcaaggctgcagtgagacgtgattgtaccactgtactccagcctgggtgacaaagtgagaccctgtctcaaaaaaaaaatgatttgagataacatcacttgtcattgtttgttaactgaataatctttattctagccagtgcctaaatacataataaatgatagtacaaatggatataaattataactaaacctaagtagtgatatttatcacaatatttctttactagaagaatttctttgttaatagaggcaaggctacttgtttagataccttaaaataacataagatttttggataaataaattaatgattctttgattctgactggcatattaaaaatattaagcgaagagatctttgcttcccaggttttattttttgtctaattaactactggtgcatttatattaaaacatattgtcaagggaaaacgtatatatatatatgtgtatatatggtgtgtgtgtgtgtgtgtgtgtgtgtgtgtgcacacatatgctatacttggttgagtagtatccccttcccttgcccacctctctcccaaatttatgtccatccagaacctcaaaatgtggcctcatttgaaatattgtctttccagatttaattaagatataagatgtaaattgatacaagttcatgctggattacggtgggccctaaatccaatcactgatgtcctgataagaagcagacagaacacacagacacacagcatacaggaagaatggcatgtgaaggcaaagacagagactggagtgatgtgtctacaaatcaaggggccccaaggatttggggcccacatcagaagctgggaaagagacaggaattctcagcttctccttctgaatccctaagaaggaatcaaccctgctgacaccttgattttaaacttcttgtctccagaactgtaatataatacatttctgttgtcttaagctacccagttgctggtgatttgttatggcagccctaggaaactgataggtatactaaaatctctaatgaattgatgttaaatatatataagtataggagagttcatttaaattcttctgaaaatgtcttcttaaacttttaatgatacagtatataacaaccagtatacgtagttggtatcgggtttgacatttaaacaagctgacaaaaaacagctgtttaataaacatctgaattatataaaagttttattgtttattattcatgtgaatgacttaaactgacatctacatttagtgaagtgtgaatgggcctagccaataaactatgggtaatttttttaaagtctcatctttgaactcacaaaaaattatcaaatatcagctattatgtattcttcatgtgaagaaaatgtcatatttatttgatttgtggattagcatatatattaatagagcttttgaaagaacaaatgtagcactttcccgatttcatagacactcatttaacacacaagttcatattttaaagtacataattttaaaaaaattctagtccaaatgaatttaagtgccatgacttctaaaaattctgtctctatttttgggttttataggaccttgagccagtactcttctggtgagcttaagaggctaagacttcacctttagttatatggggctttcatctgattatttgtctattttgattgctctaaatacaagttagtgtgtatttcatctgaatgtatttcattataagttttggttttatgtagatctggggatctgtcttgtttttaatcttgattggtctgtttgttttgggatagttggtactttcatttcttatgcttgctttctttttcattttgtgcccacctttagtcaggtgaacatcagtaaggaataaaattttatttttttaagccactgaaaaaatttaaaaaccacatcataactctgcctctgctgactgataaaaatgctaacttattaagacaaaatgttatgcaagaagactttattggaatagagaaacatcctttttatgtaagaaatatcaacagagacatgtgcctttcttgtgacaaatgtggtatgtgtgtggattagaggtctggaatgtggcagcatttcagtacttggaggggagaattagagtagggtagaaagatagacggggagcagaggatgattctcacccagtagaaagcagagtgaagaaagaaaggggaattgttttttgcattatattatttgaactgtggattaagtctttccataagccatccctacgcctctaagtaggttttattaacttaagctggtttgagatgggtttttggtcacacacaagaattgcctgatacaagagaggctttgattttgttgttgcttgctcatttttatacactaagatggagaaaaccctggacatagtgaagacgaaattgaggaaggtgttgggtagagtggagggtagaagacctgtaacataggtacagaattacattaaactggaaggacttatatccagatataggagtcagggtagaaagagagaatgttagcagtaagggtaacagagtagcagaagtttattcttaccaggtcctgttatgtgacagtggaggcatgttgaccttctgactaggggagttaaaggagaacactgaaggtttagaataatgtctctaaggatagaaagagaaagtttcatcaagactcatcaataatagggcagcagggcttagggccaagcaaattcagagaccatgatattatagtagtttgtagtggtcttaatccatctaatttttcagcattttctcaatggccaatacttagcagtggtagtgttttatggcatttggacaacagaagtgaaagcactggtaagagagacgttgaagtgaaacaccatggggctcagaaaagcagagttgatccatctggtacatgggcaaggatggtcctgaacaattctgcagtaagttggaagatagaaaaaatacctaacgaacttgtagatctgggtaaggagatttttggcagaatattgtaaggctaattggcttctcttaactatatgagatagggttttacaagggagagataagcgagcataatttagaagaactatagggggtcccaggcagactctctggctggaaaattattctgatagcaagaaattagccccaaagcaaagatgaaaagtagggtacttccaattaaacatgtcataagggcaagcctcaatcaagagtgtggctagaaggcacagctcacctggacaaaagtgcttctaagcatattaggagcatataccacaataacctgacttggacccaaagttgagagaggccagtctcaaaaaaatttgagggaattgcttttgcataatatgatactttatatacatatctgttacatatcatatatatcatattaaaaagaaaaaaaaccctgtttttccttccgttctttcatataacccttctgacaacaaatgtggagtttttcacacactaagcaattctttagttcttgctggacacttcctggatgtcctacaattcaactcgattctcacacaactgcccagagtcagtgcagacccgcagattaaaggcttagccccaaaagactaccccccactttagatgtcaatcacaagtctcaacttcatttacttctgaaggacgagctatacattggaggaaacccctctttctttcaataatttgctagaatggctcacaaaactctgggaaacatttacttatggttaccaatttattataaaggatataactcagaaacagccaaatggaatagattcatagggtgaaaaatgggggagaggcatggagcacaactctctcagcacctccatgtgttcaccaacccagaagctctcagaactccttcatttagggcttttatggagctttatcaagtaggaatgattcatgaaatactggcattggtgattaacttaacctccagcccctttcccctccctcaacattgggggtgaagctaaaagttccaactctgtaatcacagggtgagcttccctggcaactagtcccctgatccttagggggcttctgaaagtcacctcattatcataaactcaggtgtggttgaaagggatgttttgaataacaaaagatgcgcctttttcctttatctttctgagttgtttcaggagctagggacaaaagactaatactataacaacaacaacaaaaaattcaatttttgcttttatctcttgggaattacaaggattttaggagctctgtccagaagccagtgatgaagatcaaaatacatatttcttattatatcacaattcacacatgtacatgatatccgtaagataagtgaactacataaagtaagctcacaaagtttctgtaggagttttgtccatttacaaacagtttgtaagctaaaagtatctgtgacaagcctcagtcaatttagaagttcatttttccaatgttaaggacatgcctgtgacacagcctcagaaggtcctgatgacatgtgcccaaggtgatcaggctacagcttggctttatacatttagggagacataagacatcaatcgatacatgtaagatgaatattagctcagtccagagaagcaggactactgaaagtggaggcttgcaggtcacaggcagattcaaaggttttctgattgggaattggttgagttattatcttaagacctggaattaataaaagggaatttatcatgcagatgaagctttaggtagcaggcttcagagacattagattgtaaaggtttcttatcagacttaaaagagtctgttctaacagtctttaggtctcagtgttgatgttaatgctggtcagctgtgcctgaattccaaaagggaggagagtataatgaggcatgtctgagtcccttttcccatcatggcatgaactagtttttcaggttaactttggaatgtccttggctgagaggaggggtccattgagatggttgggtggcttggaattttatgtttggtttacaagtttaacattaaaagcctctgtacctccaatgttttatggacaaaaagaaggctgaaaaagctacttggctgtaatcatgggccatttcttgctgaaaagaagaataaaatggaggcagaaccaaaagcccagaggctagagccaagagctgctgagaatgatgaattagggaaccactctcagagagcagatctggatgtgagataggaacattttctttctcagggtctatgaaactggcaacatatgctctcctgaatttcagaattgctatggaccagtgactgtgatatgctttctatatttttcccttttgaatgggtgcatctatcttgattatcctctgtctcattattgtatgttggatttgtgtgggacgataacatgtgtttttagttcctaggttcccagaataagaggagcacactcaaagagcgacatttatgagatactggatttttcacttgatatcataattgggtgagacttgaaagaaagtgaacatattttgcaaatgggagggatgttaaccactgacaaccacacccacagggtccactgtattagcctatctgcaaagacggctgccaaaaattccttctgtccatatatacattcccttttttaatgtgactgtttcacctgccagcaactgaagggctttatttccatttccccttgtgacttgtttgactaacagcaagaagcaaaagtaatgctattccaattctagacctgggccttaagaggcatgacagcttctgcttttactctcttgaaactcaatgtcattttttaaaagctcaggctagactactcatcatgagggaccacatgaaaagagataggcccagctagtttccacccattccagccgctccagatgagatgccagacatgcaaatgaagccatcttggatatttcagccccagctgagcttccagctaaatgtaagtacattcagttgatacctcatagagcggaactactgagctgacttcatccaactcacagaatcataatgaataacaaatcattgttgctttaagtcaatacatttaaagtttttttgttatccagttgtagatgaattatacagcctggggggaaaaaggagatagcacactgttagttgcctcatcaatattcatccccaaattctttttcctttttagtaggtctcacctcccacctggaagctgaaaacacctttcccagtctctctggaagctacagcacaggcatgttgcccaattctaaacaataggacatgataggaggtctgctgggtgggatttttgaaaatatttttttttctggttaagaaaaaagaaatgcccaaggaaaacctacaaatgccccttccattcttgcttttggacattttttgggagagggtatgatgcttagcactcctgcagccatctcggggccaacaatagaatccttgttgctacctggtgatagtgaagtagaaagctacaaagctcttgatttcttttcttttttttttttttttaaattttattattatactttaagttttagggtacatgtgcacattgtgcaggttagttacatatgtatacatgtgctatgctggtgcgctgcacccactaactcgtcgtctagcattaggtatatctcctaatgctatccctcccccctccccccaccccacaacagtccccagagtgtgatgttccccttcctgtgtccatgtgatctcattgttcaattcccacctatgagtgagaatatgcagtgtttggttttttgttcttgtgatagtttactgagaatgatgatttccaatttcatccatgtccctacaagggacatgaactcatcattttttatggctgcatagtattccatgctgtatatgtgccacattttcttaatccagtctatcattgttggacatttgggttggttccaagtctttgctattgtgaatagtgccgcaataaacatacgtgtgcatgcgtctttatagcagcatgatttatagtcctttgggtatatacccagtgatgggatggctgggtcaaatggtatttctacttctagatccctgaggaatcgccacactgacttccacaatggttgaactagttcacagtccaacagtgtaaaagtgttcctatttctccacatcctctccagcacctgttgtttcctcactttttaatgattgccattctaactggtgtgagatggtatctcattgtggttttgatttgcatttctctgatggtcagtggtgatgagcattttttcatgtgttttttgactgcataaatgtcttcttttgagaagtgtctgttcatgtcctttgcccactttttgatggggttgttttttttttcttgtaaatttgtttgagttcattgtagattctggatattagccctttgtcagatgagtaggttgcaaaaattttctcccatgctcgtgggtaggaagaatcaatatcgtgaaaatggccatactgcccaaggtaatttacagattcaatgccatccccatcaagctaccaatgactttcttcacagaattggaaaaaactactttaaaattcatatggaaccaaaaaagagcccgcatcgccaagtcaatcctaagccaaaagaacaaagcttggaggcatcacactacctgacttcaaactatactacaaggcttcagtaaccaaaacagcatggtactggtaccaaaacagagatatagatcaatggaacacagcagagccctcagaaataacgccgcatatctacaactatctgatctttgacaaacctgagaaaaacaagcaatggggaaaggattccctatttaataaatggtgctgggaaaactggttagccatatgtagaaagctgaaactggatcccttccttacaccttatacaaaaatcaattcaagatggattaaagacttaaacgttagacctaaaaccataaaaaccctagaagaaaacctaggcaataccattcaggacataggcatgggcaaggacttcatgtctaaaacacgaaaagcaatggcaacaaaagacaaaattgacaaatgggatctaattaaactaaagagcttctgtacggcaaaagaaactaccatcagagtgaacaggcaacctacaaaagctcttgatttctaatgacatcatatgggatgaaccaacccaggaacagcctgactctggacctcttttaatgtcagaaataaaatcttatttgtaaaccactcttagttgttcaggttgttgacacaggcactgaagtgcctccaaatggtgatgaataatgaggcaaaagtcaaagacagcaagtctagtgtcaaattttttgatgcctatgggtaagaagttcaagaaagtgagctattttctttctttttaaaatttatttttatttttgtgggtatatagatgtatacattagtcagctattttcaatagtgagaagggatgttgccacttagtataatgcctttttcatagctatcatagaaaccatatatacatatagtatagaaaatgaggatagatttctgacttaaactgcctatttcatttgtgtgcctggttacacctaattcaagactctacaatacagcattgctagcaattactgtgagaatatttcaagctccctatttgctggaaatacatttcatttttttgttccaagtttatgaatattagaacctatctaaaaaggagcttttaaaaacttgaggaaaggaaaagggagggcctacttttcttgcctgtgttatttcttgttactgctgattgagatgctagagatcatattgggtgagatgtgtcttagaatacagctgagcaattcacttttaacagtttccatctgagtacaaaaaactggtatgtgcagaaaacttgatattctgacttggcgggattctaggatttgttctatttttttctgtaattgttgtagggacatatggccctgtaccttttgggcagcaggagccagaatagcaggaacattctgacaaaattcccactcagcatgagagggaagcagtccccttgatacactgatgatgtgcccacttagcattacaagtgtttgagaggtggacacaactaaaactcacctcactcaaaatatatattgacacggagaaagtaaatacaatttgctgttattaacctttcttctcaccattgagacatgttaaatatctgaaattaataaaggaattaaatttaaaaagtttacttatcatgcatttaacacatttattgagcatctgttatataaatgcactgtttcaggcacaagagatagagccataaataagcagattaaatcactattctcaactgaggtactaatctgatataagagaggagacagaaataagtaaacattataaatcaactacatacttttacatggtgtaaagtgcaattaagaaaatattattgaatagaggtcaattttggaatggttgggcagggaagaccttctgaggtgacaagaagttggcctgggcaccatggggagctctaccatggtgaaaagtgttccagacagagtagacagcaacagcagaggccctaaatgagaatgcacttggcttatctggagagtagaatgaaggccagtgtggtaggacacatactaataataggagaaaactgatagaaaagagggtttgagcaggtgggcaggaattggacaacatggtgtctcatatgtcataatagaagtttggattttattctacctgcagtgagaagttcttaataaaaaaaaaattctataaactggagtttgagaaagaactatgttgatgatagcataagccctcaatcacttgtcacataaactccaaacttcagcagagactcagggagatcaaagggactaccacaggattacccactggctaaaattcagatccatggcagttggtcctgactggaattagacttccttgtctgttgccctcattgcagtgggtctgaatgtctctgtcggctgtgaatttttctccctctatctgtggcactgagaaggtggcccagacttccagagtctgtctcattggcctattacttggggatttgctgcccttcttctggaagtttgggtatttgttttcagagcatacttaaaggcctcctgaaagcaatgttaacaatagcaggatatattttacagtcttctactcagacttggatttttaagaaccagggatggagactgtgtttccagatctagtcaaatcccttccaaacataaagcaacaaagtgccttttaaactaggacctgtactgtttaatgctctggaaacaaatacccaagcttcagccaaaggagggaaagctatgttcaggaagcttcctgaaagttttttgaaagcaattttcatgcattagtattttacatatatatatatatatatatacacacacacacacacacacatatatataaacatatatatatatacacatgaatcactaatgagacaattgatcttcaggaactaacgtgaaataattggggtatcttggtattattgttatagataaatgttgaagaagttcattctttcagatattaattgagcacttactgtgtactaagaactgtgatagatactggggatttaatggtgaacaagataaattctctgccatcagggggcttatattctaacaaacttaaaatttactgagtgttctctgtatttcagtattgttactaagtacactaacttagtggggaagctagacaataaacaaagaagtatgtaataagaattaatagtaagtgctgtaaagaatactaaagcaggttatggtagagagattaatggcagcgtgaagatgtccatgtttcaatccccagaacctgtgaatatgttaccttacatagcaaaagaggctttgaaaacataattaagggttatctgggcaggcccaatgtaatcataagagtccttatctaagacgggggacaaaggtcaaagacagaggaaaagagacgatttaaggatagaagcaaagaggagagatgttagactgctggctttgaagttggaaaaagtgaacatgagccaaaacaaacaaaacagaacaaaacaaaatccacaggtgacctttagaaaaggggtccccagtctctgggccatggaccagtacctgtctgtggcctgtttggaaccaggctgcccagcaggcggtgagtggtgactggtggacaagcaagttttaccacctgagccctgtctcctgtcaggtcagtggcagcatcagattctcatagcagcctgaatcctactgtgaactgcacatgcaagggatctagtttgtgctccttatgagaatctaatgcctccaaaatgctcaccccttcaaactgcccccatccgtggaaaaactgtcttccacaaaaccagtccctggtgccaaaaaggttggggactgctgctctagaagccagaaaagaggagatatattttcctctagagcctacagaaggaatatataggcctgctggcaccttgattttagtcctgtgaaactgattttggatttctgacctccagaaatgtaaaacaatgcattggttttgtttcaagtcactaaatttgtggtaattagatacagcagcagtaagaaatgaatacacaggtttacaggatggtgaattatggagggtgctcaggaatggcctctttgaggtggtggcctttaaacagaaaaatgagcaaagtgaaagaatgaaccatctggtggggagaaaagcattccagtcagagggaacagcaaaagcgaatgctctgagaagggattattcttctcaatgtgtttgaggactggcaagaaggctttgtgtgaatgagcaaggggaaaaagttagtaggtgatctcggagacatagccagggtccagattataaaggacctctcgccttgctaagcattttgactttattccaagaataatgggaagtcaatggaaggctgtgagcagggttatatgctctcgttattttttaaaggcacaatgtaactccaaaatggaaaattggctctgggctggaggtgccagcacaggggaaaccgaaagcagagagctgggttgggagagcggagactgaagttgtccagctgaggggtgcagaagtgcagactgcaatgacagcaggcagaaaggactatatgttctagacagaatggacaggatttgctggtagattggattgaaggcatgagacaaaggagacatggatgatatcaaggattttgatactacagatttgaaacattctgagagggacaggtttgtgatggaaaatcatgagtctggttttagatatgttttagaagcttattggacagccaagtagagatgtcaggtagggagctggacataatacctaaagttcaggagagtggttggagctggtgacatcatttgcagaaccctggatggtacataaagcacgggacagtgtgtggatagatcctaaagagagccctagggcactccagccctggaagaaggcagcttatcaaaggaaaaagaaagaaagaaggaaacacaatccttattacttccatcttcaggacaattcaaagccagtgtttttgacttcctggcttgagtgaagcttgaaaaatggcaacttgcccctttgcaaagctcctaaggagtagccattggcttggcctgtttgcactggctctgggtgagcttttaaaatgccagtgagctctaattgtgttgattgcctaacagctgtgaatacaagatgctgactccagaactgcaactcattctgcgaagggcaccgtccttttccctctaatgactgctgaacagagccacctgaagcctgcatggggtttagcagcagctgcacttctgctctaagaaatagctcactgcagtcagatcaaactgaagctcttccttgcttttcctcgaagcttgggtacttattgtcggagcattaaacagtaagagtcctagcttaactggtgcacagtgctttatgtttggtagggatttggttaggcctacaaaccgtctgagctaagaaccttgagaaactcctgctatagttagctctttctgtgactctgcagtgtgaccaggaatgaggacagaattaagaatttgctgcctctatgatagaactgtttaggcactagaacactggaactagatctacaaccctatgaatttaatttccttttcaactcccctactccttcttttcaatatgatgataatgatcttgtttaaaaaaaaaaaaagccttctgctttacttcccactctgctcctcttcccagggactcactttcttcttgactgcttccccattacaagtactcagctccctgttttatcaccctgcttagagcagccattatcagccttggctgaacattggaattacctgggaacttttaaaaatccggaagtctgggtctcgcctccagagattccagcttagttgtcttgagcgtggcctggacatttgggttttcaaaagttccctatgtaactttaatgtgcaaccacaattgagaatcactagcctccagactctctgtgttatcaaaattaatgagcagctgattttagaaatctcagttatcaggagaaaagggtgaacccccccagggctcttctccttttccaggtgacacttctttatggcagtgcgtgaaagtgaagccctgctgcttgtaatctccctcaagggagtgcaagatccaggcaaagacaagactgcagaggcgctaccttgggggaaagtaggaccctaaatacttacacctggaggcacttacctttaatactgaatttgtcagatgcaaatttgtctatgcaaaccagggccttatctctagcttcccctcaggggttttgggaagtgcgctactactctgaaacagggttgtaaagcgtcacctgtgctctccagggaaccctctggaaaggaggtggaaaaacagaggcttccacccttgcaactctaagtgtgttccttggccagtgggatccatcacctagtattttcttagatatgtggtatctgggggccagtcccacacctatgcaataagaatctccatttgaacaagatgcccaagcgattatatgcaagtttaagattgaggagggctggtttaactcgagggtaacgaaaagtacgaaatcgtactttacaggagaagctaggcggagggagccacttattcttcctcttgcagctgggtctttttgtggtgagtggcgaagcggcgaggctggcaggccagggtgctggactgggtcaggcgcggccccgcctccctcctgggtccctgccctgcgcgccgttgctgtggcagcgctggacgcggctagagctggggctgccgcgccctccacctccttctccaaaggcctccccggacccctggctcgggcccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgagtgcccggccccaagcgtcttcgcctccctccgcgcttcctccctctccccggcccaaggcctacacccacgagcttttgctccaccctccccttttctcgcctcccctccccgtgctcgcctcactgcccggacaggttaccgagtccccaagtcgccgcctcctccttcccaactgggaactcacgcctctcgccccatcccagaacccccagggattctttcgctacctagccttttcccgcctccgagaccttccccgggcaaacgtcacaagcagcttttgctcagagtctcagcagaaaatcttgagccccaaaggggaggtaatttacaaatgtgagaaggtcaactactcctcccctccaagttgaaaaagttttaatccattaactttgatggtacattgaaactataaacatctcacagattatgcctacacaagagttctgaatccaactctcattttgctgacttgaaaatgtaactccagagctttgggagtgtttctgggtttttttctgcccctcaccttccttgccattgtctagaattaagacttcttcaggctcggtctagaaacttttgatttttaatattgaccctagattattggatcacagttttgcgatgcttagttacgtcaagcggtttgcttaacgtttgccttttattgacttaaaattttagttacctaaaaaagttataatgctgtagtttacaacaaatacttcgagtctattttcacgtcttagtcaaatagccttatagacttaacagatattttataaagaccattttgcaagtcttataagtagactttcatatagtcttatttctaagtccaaactcgagaaatactccccattgttgaattagcttagatgtgagcggtgaaagacagatgaaatgggggaggaactacatcaaggttactctacttgcgaggagatgacttgggggagatggaatttggtattcaacctcttttagctaaatacaaatttatgaaattaaaaaaattgccttcccctgttggaaaacaagacacagtgtggtatttatgttacagaatagactcactgtcttaaagtcttgctcaaaagtctaacaaaatgaaaccaactagccagggattcagcactggttgcgattgtgaattctgcctgtgctgcatgtgccatgctcgctcgcttcacgaaaacagtctttgaccttaaagtgttttcaggtgttttaaaaaccaaggtgtagtattttcttgaaccttttaagttaaaagctagggatatagctatggaattatttgtaagtctttcaggcaattcgagttatgcaatatagaagtttataattacagtttggattagcccaaagagccagtttaacctacagtgcagctgaaatgctatagaattaaaatgagacattgtgcaatgagaggtcatacaaaccaatgttgcagtatttgtgtacaaaaaaagcaaacaatgacatgagaaaagaaatgctgttttatattgagtggtgattaaggtaaaataggtttaattagtgcacccctggcagtagagtttaaaatacatcttgacagatttgtaactttaaaggttgcaagtactgattctttgtttaattatgccctaaaaccatttggtggtcttttccttcatacaggtgtaccctttttctttgtaattaatacctggtattcaaaccactttgggcctctaaaattgggggcacagaagcctagagccttagtaagtacttctgtttatggaagaaaccaagagatgttttatttaggtaaaatatagccaggcgtggtgtgtccctgtaatcccagctacttgggaggctgaggcaggtgaattgcttgaacctgggagttggaggttgctgtgagcggagatcacaccactgcactccagcctgggcaacaagagtgaatctccatctcaaaaagcacaacaaacaaacaaaaacaaacactgggaaataagaaggagatattaagagatgatatatttaaatgttagaaatgctctgttgttgaataagcttagatgtgagtggtaaaagattaaatggaagagggagctacatcaaagttactgtacttgggaggacatgatatggtaggatgtggtggggggagagcatgtccattgctggttggcaagtgactggctgcctcagaaaaggatgagggtgggtaggggagatcactggagattattagaacatacgtatgttttcaagattgcttagtttttaaacctcatagtactttgttttcactgatgaaataaaatactatgtgatctttttctaattttccatcttgagtaataagcaaagacattaatgtattttatgaaggctctgactgccaaaattgggacaaattgatggtcttgttggcagggtaaatgagcataaccgtagtaattgtagttctttttattgggttcagggatgacctggaataatggatgtgttattacccttccctgtagaagtgaggctttcgaaaagaggctataagtcaatttgggaggcacaaagtatcagcgctttttggggattttttttttttttaagtagagaaatattttaaatgtgtgatataaagttatgcatgtgcttcttaagcacattaactcaaccagatccaacagctggtctaataactttttaattgtttaaaaaaatttaattgacacattgtaattgtatatatttatgagatactatttgatgttttgatatttacgttgtacaattatccaatcaaagtagttagttatccttcacctcacactttcattatttccttgtgggttagaacattcaaaagactctcttctagttattttgtaatatatagtattttactgttaaccatagtcaccatactatgcaacaaaacaccagaatttattcttcctacctagttgtaactttgtgtcttttgactaacctctctccatccttccttctcccctccccttcccagtctctggtaactattctaatctctgccttatctatatcaaccttttataatagaaaaagattctacatgtgagtgacatgtggtatttgtctttctgtgtctgggttacttctcttaacacgatgtcctccaggcttagcattcacaattgacaggactttattttttaatggctgactagtattccattatgtttctgtatcacattttctttattcatccattgttgtacgcttaggttgattccatatcttggccattgtgaatagtgctgcagtaaatatgggattgcagatctcttcaacatactcattttatttcctttggatgcatacctggtagtgggattgctggatcatatgatacttctatttttaattgttttaggaacttccatgctgttttccatattgactgtactagtttacaatcataccaccggtgtgtaagtgttcccttttctccatatctgtgtcagtacttattttcttttgtctttttggcaatagccattctaactggagtgaggtgtatctaattgtggttttgatttgcatttccctgatgattagtgatgtcaagtatcttttaaatgcacctgttgatcatttatatgtcttcttttgagacctatcaattaaagtcgtttgcccatttaaaaaatcaagttggccaggcacagtggctcacgcctgtaatcccagcactttgggaggccgaggcgggcagatcacgaggtcagaagatcgagaccatcctagccaacatgatgaaaccccgtctgtactaaaaatacaaaaattagccgggtgtggtggcacatgcctgtagtcacagctacttgggaggctgaggcaggagaattgcttgaacccaggaggtggagattgcagtgagccgagatagtgccactgcactccagcctggtaacagagtgagacttcatctcaaaaaaaaaaaaaagtcattattattttatctgttgaattaattttcttatatattttggattttatccctttgtcgcatgtatagattgcaaatatttttctcccattctgcagctgttttcactttgttaatagttttcttcaaggtgcaaagttttttagtttgatgtaatcttattttgtctatgcttttgaggtcttattttaaaaatccttgctcaggtcagtgtcgagaataatttcccttttttcttgtaatttcatagttttcaagttttacattttaaatctttaatctatttttatttttgtatatggtgagagggaggggtttaatctcattcttctgcatgtgaatatctgattttcctagtaccatttgttgaagagactgtctttttcccagtgcatgttcttgacatcttaaaaattcagttggctgttgtaggtgcaaaaatttatttctgggctttccattttatttcatgggtctgtctggttttatgctagtaccatgctgtgttgatatagttttatcgtatatttcgaagtcaggtagtatgatacttccagttttgttctttttgctcagggttgctttggctatttggggttttttttgtggttctgcatgaattttcagattgtaacatttctgtaaagaatggtgttggtattctgatagcaattgcattaaatccatagatcactttgggtagtatggccattttaacaatataattatttcaatccatgaacatgtactatcttcccatttattgatgtgggaagataatttctttcatcaaagttttatacttttcagtgtagagattctttcacttccttggttgtttatttctaggtatctttttttttaaaaaagtactataaatggaattgttttcttgatttttcacatagtacaatattagtgtatagaaatgctactgatttttatatgttgattttgtgtcttgcaactttactgaattctaacagttcttttgtggagcattttgggttttctatctataagatcatatcttctgcaaacagggacagtttgacatgcttctttctaatttggatgctcgttacttctttctcttgcccagtttatctggctagaactttcagtagtatgttgaatagaaattgtgtaagtggccatcctttccttgttattgatcttagaattgatctcgttattggtcttttcccattcagtatgatgttagctgtggatttgtcatatgtggcctttgtgttgaagtacaaactttccatacctaatttgttgggtttttaatcatgaaattatgccacattttgtcaaaggcttttaatgcatctattaaaatgatcatacagtttttgtctttgttaatgtgtatcacatttactgctttgtgtatgttaaaccattcttgcatgcctctgatcccagtgatgaatcgcacttgaatgtagcaagttatctttctaatgtgctgttggatttggtttgctaatatcttgagaatttttgcacctatgttcatcagggatattgtactatagtttcctgtgttgtattgttatctgattttggaattagggtgatgcttgactcatgaaatgagtttggaagtattccctttgcttcagttttctgaaatattttgagaggaattgatattggtttgttaaatgtttggttgagttcagcagtgaagccattcgtttctgggcctttctttgatgaaagactttattactgattcaatttcctcacttattattggtctggtcagattttatgtcttcctaacttaatcttgataggttgtatgtgtcggggacttcgttttttctatgttatcaaatttgatgaaacttgttgaaaaccaactctaaattttgttcatcttttgaaattatttttagtctctatttcatttatttctcctctgagttgaattacttccttacttctaccaactttgggattagtttgttctgttcttttttttctttctttctttttttttgagatggagtttcgctcttgttgcccaggctggagtgcaatggtgtgatctcggctcaccgcaacctctgcctcctgggttcaagcaattctactgcctcagccttcctgagtagctgggattataggcatgtgccaccacacctagctaattttgtatttttagtagagacggggtttctccatgttggtcaggctggtctcgaactcccgacctcaggtgttctgcctgccgtggcctcccaaagtgctgggattacaggcatgagccacaatgcctggccgattagtttgttcttaattttgtagtgccttgaggttcatcattaggctgtttgtcagaaatctgttgtcttttttgatatgggcatttaatactataaacttacctcttaaaactgcttgtgctatgtttcgtaggttttgttatggtatattttcattctcacttgtctcaagaaaaattttaatttcctttttaatttcttcactgacccattggttgtttaggagcattttgtctccatgatttgtgaagttgtcagtttttctcattgttgatttctagtttatttcttttctttctccttccttctttccttccttccttccttccttccttccttccttccttccttccttccttcctccctccctccctccctccctccctccctcccttctgtattgctttgtctcccaggcccaagtgcagaggcacgatcttggcttactgcaatctctgcctcctgggctcaagcaatcctctcacctcagcctcccaagtagctgggactacaggtgtgtgtcactgtgcctacaggtgtgtgtcactgtgcctggttaaatttgttttttgtttttgtttgttttgttttgtatgtttagtagagatggctttcgccgttttgccatgttgcccaggctgttctcaaattgctgggctcaagcaacctgcccaccttggcttcccaaagtgctgggattacagccatgagccactgcacctggcctgatttctagtattataacgctgtggtcagtaaagatacttgatattatcttaatcttttaaaatttgttaagacttgttttgtggcctaacatgtgatctctcctcaagaatgttccatgtgcatttgagaagaatgtgtatctgcagctgttggacggaatgttctgtaagtgtctgctaggtgcatttggtctatggttcagcttaagtccaatatttcttgatctctctgtgtgtgtttgtgtatgtatgtctagataatttattcattattgaaagtgggctgttaaagtctcttactattattgtattggagtttatctctttaggttgaatatttgctgtatgtatctgggtacttaggtattaggtacatgtatgtttataattgttatatcctgttgttgaattgatccctttatcatattatgaccttctttgtctctttttacagtttttgacttaaagtctattttgtctgatatgagtattgctactcctgctcacttttggattctgattgcatggaatatctttttccatttcttcactttcagtctgtctttaacggtgaggtaagcctcttttaggcagcatgtagctgagttttttttccagtcctgcagctactttatatcttttcattagataatttatttacattcaaggtttttattgataagaacttatttctcccattttgttacttgttttctggttgtcttgtagattctcagttcttctttctctcttgtttacctctgtggtttggtcattttctgtggtcctaagctttgttttccttctatctcttgtttatgtatctgttgtaattgctttctttgtgggtaccatggggctaacataaaaagtcttgtagttataataaactattttaagctgatagcaagttaactttggtcacataaaaatactctagacttttttcctccgccatccctaatttatatttttgttgcctttatttctttagtatgtgttccctagccattgtagctgttgttgtttttgaccagttgtactttaaaccttcatctagaggatcgacaggtttacatagtaacatgatatcactggggaattctgagttggatttatacatttacctctattggtgaggtttatattctcacatgtgttcatgatagttatcattttttcatttacagctgtagcactcctgtaaacattgcttgtaaggctggtgtaggagtgaattccctcagcttttgtttgtctgggaaggcctttattctcctccaggatagttttgctggatatagtatcttttgtccttggccgagactcgtttttttttgttcttttagcatcttgaataaattatccctttctctcctggcatacatcagtaatttaatgttactgatgagaaatctactgatagtctaattaggattcccttacatgtaacttgatgcttttctcttgcagattttagaattctctgtcttcaacttttgacagtttgactataatgtgccacagagagaatctttttgggtttaatctaattgggaatctttgtggttccttcatctggatgtctatatctcccccaatatttgggaagtttttagctattatttcattaaataggttttctgtgcctttcttcaacttttctccatctgccagttctataatgcaaaaatttctttgcttagttttttttaaactttgggttatttcacaaaacctattttcagattttgaaattctttcttctgcttgatctggtctattcttgaagctctcgattgtgtcttttattcactgcattcttcagatttctgtgttttaaatgatagatcttgttttaatttctcattttataactttcctgatttcattgggttgtttgtattctcttgtagcctgctgaatttttttaagatcattatttttaattttgtttcaggcattttataaacacccttttctttggggtctgttactagagactcactgtgttcctttggcagtgtcgtgtgtccttgctttttcatgtttcttgtgacatctgcacatctagtggaatagtcacattttccagttgtatgcagtagctttcacagggagagacttttcctgtagatgggtcctagagtgttggttgggtatggtacattggctttggtttggggtggattcagtaccatggtctctgtgtagtttcgtcagctgtaatcttcacagcaatgtctgatttcctcagtggcctaggctgcaggagtttttgatggtggtatagttttgctagggacaggcatgtcatgctagttgtcaggctggacacttgcaggctcggagggctgacaagctgtcttttgggctccccagggaagagaaagtatgattttccagcttttcttctatgtttatttaaaactttgttgtctggctcacagtgttctttatctaaagtctagccagtggtggtggtcatattgcaatcattattacagcttcagactttctagaccttttccattttagtgaccttcagccttcattcgcttccattcatgaccacagaatagatgtagtcatctctattgaaggcaaacccatcccatctcttcagcttcatctagaaatttgtttcatctgttacactttctttctttggtttttagccttcattctctaccagctctttcacttaagcagagatatgttcaagactctcccattctaacagttccctgccttgatcctacaagcttttctctttagctgctaccttgctttttatttttatttttttctcacttgctctgataatctcctagaaaaattggcttactctgaccatctccattagttcacctcttaattattcttcaaccatctgagacctggctttgttctttctctactgaaactcttcaggcagagattagcagaagtcttctaattgctcaatgaagtggaaattttcagtccttattttctgtatttctccttcatttgactttgacttaactctcttggtttttgtaataccaccagcacctagtttatcagtctctcatgggaacttcattctatctgcctgccaaatggtggagtcccaaggactgtggtctgatctgctgttcctcattacatgctttctggtcagtattgcacactgtggttctcatctaccatcatctacctccagaagtgccatatatttagtaagtttacaagaaaagcaactttccttgctccgtagactaactctgatcttttgttccctatcatggttatggaactcactaattattcagcatcagctgtcagaatgtttaactttgctatttaggtttgtgtaagttatgggacaataactaggataactagaattagcttgtagcttatgtgggttagataatacaattgcatatgtaagtagtgaatattttggcttaataagtgaaggagtatttaggaagctatctggaatgttatctaagtcaggattctgaaggtaactctagcctcactgtcccttactcactatttctaaacacccaccaatcctgcctactttatttacttggtatttctccaatctgccatccttctctgtccgaccaatcactaccctagctcaggccttcaaagtctctcacttgacctactccttcacctcctttgaacctgtgcacaaatgttagcttcttagtaaggctttctctggtcacctgtataaaattcccatctgctacatacttcctggttccctgtattgccttatattcctcagtggcatttatctccttgtatactatataatttctgatctctgtcctttctattaccaccccacttcaagatggcaaggatttgtctgttatattagtgactgtcctaataggaaaaaaaatggcacatttatattagagtaacttgagaagaatttttaaaagtcagtatttataaagctgtagatatagagatagtgaagtactcttgggactagtaatcattgggcaggtgataccatttttaagcccaaaagggcatagtgaaagagcaggtgcctgaacctggattcagagagactatgtagaggaggccactaggcaggagctgtggcctttgcctcagcttggctgattacctcactaatcctcactaatcctaaattacccaagttccttcttttctggcccatttcacagtccaaagccaactttaagccagagggcaaggggagcacttgatgcagtccatgcagtatggcctcccagtgaacagggcaggtggaggatagaaactaaatctagatggaggagagggaagatattcagaatatgttttttctttactgtcagcaccttgaagagtgcctggcatatagataatatttattgaatgaatgaatttgttactggtttactggcctcatgaactttagttttgcctattctattataacttggtgactacattcctatatacttgataccaactcctcattaactacaaaggcagtattcccctctccccctttttaaacatcaaaactcttttttaaaaaaaattcttaaatgaatcgccagtatataacacataaaagtatgggtgccttgattggagtggtgggtaaatgatcctgagtctgtctgtttgggttccctctttgcctagcaggaatgtgactgtcttgtttaaagcccactgaagtagaaaacaggatgagagacacactcttcaacatggcataagatttccatgcttggctcctgcctatctctgcatcctcatttctcagtagtttcctcatattttaccatcctgtaattgaaagaattacaaaactagttctctacacaagctttcttgctgttccagctgctgggaattagcttcctttgtgcttttttttatttgaatgattcatgtttacattcattaaaattaatgaagattcattacagttgttttctctttaggcataattggatctcctatactgagacattgaatgcaactttgattgtttttttcccccattatatgttaagctccttgaggttcttttcaactttgcgttattccaggatttctatcgtaagagttaaggttcatccacttctctgatgtgaggttcatggcaggaaggttccatgttgctcagctgcagagtagaaaatactgagcagggcttaaatagattaggatgctgccattataatataaactgtgtttacgaaagagcatcatcaattcagaaaatatctttttcattgactacagtggtgcctgatgatctttctattacaatcttaaattatggtcattttaattatagaatcatacatgggtttatttatgttaaaataaggtaattatcaagctagctgtgacctatgagaaaaatcctgaagaaatgatgaagggatcaggtgactgtttttgaagtcaagtgtgaaaggtcagaccactctgggtcatgggaccctgccaaggcagagcaggtcaagtgctgtgcccagtggggccaacccccagtatggtgccagggactgggtgtgagaagtcaaaaattaagaatacacctcagaaaggggacatggacagatgccacagacttatttgcgtatttcatgatttagcccttagcttgtgctgatactggatcagatattttcagagttcagtattttcaaaagcatcgctgatcacctgttggcattgttttacatctcaaccaaggaaaaacttttgggacatctgtttaacaaggggtaagcttttatttgaaatgttcgattaaagcagaagagtcaggcatttttttgtgcctccccaaagaaagatttgtttactgtcctgtgtgaataaatataatgtcattatttcccgtaaaggaaaagctgatggggagagtaagtaatgggtaagattaggcaatgttaagctcatatattagtatgtttaagagtgatcaatttagggatctctgtgacagagatgccaaatgctcacagtgctatctcatgttggaaacatgtgtctcctccacttttcctcagtcctctgaaatgacggccctttagggattgacagatactatacagatttctgtgctgatatgtgatttgtctaaaacaaaagtttcacaaaacaattcttaccattgccatttaagagtcactctgatatgctctgtttccattgcaaacaaatgctcattatgatttgtgaaattaacttcacaatttcctaatggataacaccttgaagtatgaaaagcactacaggatcttttatagcttccctcctccagctctctataatctgctcccatctgtggtgtaggaaagatttcagcagtggccgctgaaggccctaagatcttgtctcaacagatagcaaggtgcataacagactttggacaggttgtttaacatgtctgagttactgtttattcactggcaaaatgaagggcttatattatattgtctctaagtactatcagttctgaccacctatgaactttcattttaaagaaaatacctatttctatggcctttaggcattagggaattttgtcaaattaaataaatctcagtaaggtttgatggtcaatggggcccactgtctggtgtgtgtggaggggtgttgtattttacatcaggaacttcagagccctcatgaatttctaattagaggaaccacctgggaaatataagtcaaagccctttgctcgccttactcagctttagggcacagtgactagaggtgggcaatcgctttggtgtaggtattgtcattggaaaggaagaaaccattttctggaggaaaagaattggttgaggctagctttaagcagctatttcatgatggacaaaaggactagctcatccattcttcattcgtttctctgtatcctctatcaaatttctgagtaaagattttatacaatgcttgattagcattcaaatagtatgtttcaaagattttaaaaaaaataaaactaggcctttgaatcataattatggcttataactctatttttcatatacttactatctcaagttacaaatttcatgttatgtttttttcaaaagagtattcctgccacaactcagagctcagctgaattagagcagtgactagaaaatctgagaaggctgagcttcaaaataaggtctggaaagtgtttcttattgttacaagagagtcaaaatgattttcttgagctttaagtttatgtaagtatttacttgacacttagcagtttaaaagataatgtgcaaaaatatgaaaatgagaaaaaacaatttcaaaacaagagttggtgattacgtgagacttagtagagcaaagtatattctaagtattaatctgtctaagctgtttgggaacagatgtacgtgaaatggataccgggtgttctgttgtgtacaccccaagtgagacatctgttggtagactgtgtggtcagaaataatggaagcaggggttaaaccccaatatgacctattactcatgtgaattattgaaggactaattactcagtaaaacatgatgctttgattcatcagtctacacgttaagaaaaaagcctctttagaaaaaaatttagttctgtttctaagctgtcaaatttgaggaaatttttaagatgtatgcaaagactcaaatttccatagtaactgcaaatactatctgcttataaagttttaaaatgttttgacaggtctactaatttatcataaaaatagcctcaaaagttttagctttttgttagggtaggttgggtctcacagaaaacaaatgtagagtgaattttctaaagcagggctgtccagttagacttcctgaaatgatgggagtgcactatatctgaagtgttcaatacagttaccaccagctacatgtggctattgaacagaaacatggctagtgtgactgagaaactgaatttttaattatatttaatttttattaatttgaattcaataactgcatgtagcaagtggcaactgcattgtacaacacagctctgacacatggagagttgaaaatgtttgtttactttcttcccaagttttcattttagtctttgtttctacatagaaaggaagatatagcttttgaaaaatgaacctgaatgtagaactgatatggttatgcaatttgagctgcctatttaaagataaagcaactgagtttagagatttcaaagtggcagagtcctttaacatatttcgtgggctggccacggtagctcatacctgtaatcctagtactttgggaggctgagatgggaggattgcttgagcccaggagttcgaggccagcctgggcaacatagcaagaccccatctcagggaaaaaaatatgtgtatatatatgtatatatatatatatatatatatatatatatatatatatatatgcatacacatatatacatatatacacacatatattaacatattttgtgtgtacaaaaaatatttttattatgtgtagattagttggttactagtaaagttgaagtcttgtctatagaaatcattgtatttttcatggtcattgtgatacattgtttgaactgaaatttggcaaattcaatctgtttcttactacaagaatagtacatagatttgaaatggtaactctcttagtctgtgtactctgaccctgtgaacgtctggagactaatgttattcctaaatatgctatgtccacatggcagcatctgaaggcaaacactttttaaaactgatctacttttgtggacccttcctctctctctttcctgcatcccggatggggccctctggggctggaactggcacagaactattcccctaggagtgggttcattgaagccaagggacacacaaattgagaatcagatagactggaccaaggtcattaaaccagagagggcaatccagatggggttgtccaaagtaggaagttctgaagtgaattgcagaaatccaaacatggcaaagctaaaggaatagagaaccagggcaatggatatagagaacagagcaattgggtatgcaggaagatgctattgcctagactggatgtttttgtaccctctgtaatttgagaaaatggaccgtccttgttgaaatggtcagggatgtagtagataaattcattgcagttgtgtaatctcagcactagaatactgatcataaccatatcacttgttatcccacctagcctgccacttgattgggttattagattacatttcagacattgacaagtctacaagcatcattaaaatcctaaacacagacttctgaccgtattcctacccaagttttagaagcactatgccaatgacgggggtagtatatgctgagcaggtgagttttgattgtgtgtgtctacatgtgtacgtgggtgtggtgagcaacaggaaggaactctcagccatgactctaaatgctcttgtgttggccaaaattggtataagctaggaggagaaacacaaaggagagagaggcatgaagttgaaggacattaaaccatttgcaaacttttggcatgcaaaccagaatatgaggaaacttagtgtaatgggtgactgaattcagaggtagacaggcaatcaggaaggtataggcaccaaaaatagttaccattggtgagcgtttttgtttttgtcattggcatggtgttatgaacttatgttaagcctaagggtaagtctaaaataatgtaccagctggcatcagggaattcccatgtacattcctagattttcattagaaacagtgttctggaaactaccactgctgctacacagcagtgcccagtgcttgactgaaaatagtgaacacttagatttgtttactctgccaggttctgtgctaagtatcttatcttgtttaaccttagcaaagaaactatgtagtctagatagaatttttatccctagggcccagaggtgttaaataacttgcccaaggtcataccagtaatttcagttgctggggttcaaagctaggcagtctgactccagagcctgcactgtccccatttggttatgttgcttccccagttaagcaagcaagagtctatctgacatctgagttggtggtagtaaagcatcatggtctgaaccaaaataataaaaacctttgaaacaacattatctgacttctttcaggcttttaagacagttccatcatcaacagcttattccatttctctggccacttccagtttctgaacaaatgaagaaaatgggagtgataaattggagtttttaacaagtttttttaaatctaattttttttatggaaaccaccaaacatacccaaatgtaggaataattatgtaataagtcctcatgttcaaccctaagaggggtgaagctctatgtgacccattactgagtttaaacagttttcaatttatggccagtcttatttcatctatactctacccacatcccttcttcccctggaatgattgaagtaattcctaggcatcatataatttcatctgtaagcatctcagcatgtatctctaggagataaagattttctaaaaaatcatattactactcttcaaatttaaaataatctttatagttttacatatccagttagtgtccagattttcctgatattttctctattttttaaatatgtcaaccttgaaatgaggtccatattatagctgatggctatgccttttaaattttctcatccacagattcttcttccttttttttcctttcaatttatgttttgaacaaactagtttggcctatagtttctcatgggcaagaataaccttcagactgggatggccatcactctgatacccgtaaaggggatgaggcaggttggggaagggagagcctcagaccatgatcagatgtcacaagatttttgcttacctagggtgaggacttgggaaaaagattgcccattaggagtcctgccttgggcaaaagtggccaaacttcagctgtgctgtcacaggctgtgggctgccttggaaatgtaggacctcaactcctctgaagttgaggtggagcttgagggtacgaatccctggtggccattataatgactacactcattgggatggcatggcaagttcatcctcaaagatggatcctagcatccaccatgaccaatgaggtttttttattgttatgatcactataaactcaaggatttaaacctattaaatgtttttcaattcacagcaatgattatttttactgatcttcaaattgtcacattttggatttttagaccaatgggagccccttcatcttgacttctgagttcttttgacattcactcagctgtctgatagcttccctgctttctggaatggcaagatattccaggttcatcttgaacatttcatgcttgagatatggaatcaagctcatcatcagagggtcctggttccttttactggatagtggtattagagacctcaatttgagaactaagcaacatcattgctaaaacttcccctatgtgtaccttgttacttaggtttttcaaagaacagagctagaaaatatgttgggtttttttgttttgtttttaaagaaaaaatgtatcataggattatgctgatacttccaattcaagtgcaggcctaagcttttcacattgtctcttttctcctacccttaaagtcctgattcctaactataacaacatcattactcatttgctttatcctgcattatgtagacacaatagagtaacaacaccaatgctgccaatcaaaagtataattactgaaacccacttaagatagtcctgcaatttttttttttgttcatagagtgtacactactagggaggtgtagtcaaattactatgttttaaagacacttggaataattcatatctgtgaagttatacccccaacttatttgttttttgtattattgtttcattttgcttttgatgtttaggcatttcttttttaaaaatcaattttataattacgtgaaatacttatatggttccaaaatcaaatctactaaacaaactatattctaggaagtatagcttttatgtttcccttctatgcttttccttccttcctgtaggtaggaaagcttatttgttcctcaaagctctgggttgttcttttattttatataaataaacatgtgcatatattcttttcattacccccacagtacccaccgtcttaaacacatgtacaatatatgtgtttttctaccttgatttctttcttacttagcaatatgcccagaagttcactctgtagcgctttacatcagcatcaaaatccattatgtactatcgtttattgacctctctgttggagaaatttggattgtttctagtcatttttgttatcgcaaatagtggtttaataaaaaactttactttccgttttttgtttttcaatgtgcttttaggatagatgcctagaagtgagattgttgagtcaaagaataaatgtgttaataattttgctcaatattaccaaattctttcaaaagggttgtgcaattttgctttttaaaatcattattgtataagggcatgtatttcctgaaaatttctccagaagagtttattgccaaactttaaaaaaacagcctgatacataataaatgatatctcagcatagtttaaatttgcatttttcttgttaaatcattcatgtttttactgtagtcctcctaacatttagggagcaccaattatggggtctctagaaggttccaggattctgtaatcaatttgacatgatttctgtcttcagatattcacaatcttcaggaagatatattgacaaaagaataactacatgatctattttgtgtgcaacttagtacttacagagcattataaatgcacatggaaaaataggtaaaggagaaaatcattctctgttgggcgggctgagggggaagtcaggaaaagctacagagaggttcgagggtaaactttaatgtgggccttgaagtatgatttggagttagcaagacagacaaaggagcaaggaaaccattctagaaaaagaaaattttgaaaaatctccagaaaaggatgctttggcctatttggaaaataacattgtcttatttatgggggagatgacagtgctttgtttttagtcagtagtttatacaggactttgaatagcatgcaaggaagttggcgtctcaacctgaaaattgaggaaggtgtgacaaaggctgggcattaggtgagatcaagtatttctgtttttttttttggtaaattaggtagcaggatagattataaatgggctccacactgaggagcccagtgtgatggctgatccagcagatcagggggcagtggctgcaaagctgggagaatggcaaggtaagcctggatgcaagggatattgtcaaagacaaaatttgggggatgtgaggcttaaaagggaaataaataatggtgatggtgagatttctagcttgggcagtgggatagatagtagacgctgcgcaaattcgtttttaaatcagcagaatgagaagcatcttatttgaaatatattctaccaaatcttagcatcaaatgtgctagtgactagcaaaatatgtaaacagaagggaagtagcttgaaaagtacacaaactggagaaattgctcctgaaggactgtaagttgaacccttttaagcctaagatctgtatttcctatgagccctaggctctttccttgtgtatcctgtttcttattagagtagaggctacttaaaaataatcatagtttaaagcgctctattttcagaaaacattattcattagatgttagtaaataatgtaatctttatacattcataatatttctgcattattggagtgtaaaaagtcagtgaaatagtcatttgtaaagatgtcagtttttatctgtggaaaatagctgttcataccattttaagcttaaaagttcttcatttacttcttaaaatatccatgttggtattattttgtctaatacaagtaattaatatttaccccaaattaagcttttaagtttactaaatgttacaaacataattcaaagcactgtttagtgtccatctgtgcaggaaaaataagatcaatacaattgagcagctgttagcatgtattggtttccttatattttaagtatgttttcatgttttgaaggtgtaaagggatgacagtatgttttgttgtggttttcatcatacagataaaaacttattacagttgaaatcttggtgaacataatacattttaaaatttccattcctcacccatttatctagatatttagacacagtaaaataaataacatggatacatttttgtcatgtgatttatgttttttaaaaagtagaaataaatttctctaaaagttatttttattttttaaatttagcatttttcatatttgaggaaaaaacaatatgtcttggtaccctagcttctgaactaataacacacctgtcattttacaggttattttaatgtttttcattgggatcaaacctactctggaaatatctcatgggtgagctttatttttatgaaatgttcttggcacttgaagacctttgtaggtacatgccagactcatcttacatccagttcttctgcatggaaaatatgtgcattgaaattctaagtgccttttcaaatttgaccttcttagagaataatatgagtcccaacaattaggaaaactatggaatgccttttggcctttacttttcaaagattttcagtcagtaatgtttaattagcattcattgtgtacattgtccttttttgtgtgatatggctagttccaaaggaatattctagaagatctcagccttctgctattgaaggtgataatacactactaagttatgtgttgctttacattaaaataatgttgcagcagttacttattgcttaactagcgggtataggacatcaggttgaaataactgattttgaagtgaagagttcttgtttatatcttaaactaaccaagtatgttcattaactttgagaataacaatgatctttttcattattcttgagtagactggataaatcagaaaacccatgttagaggtccctgtaaaaacttcagtcttatttggtaagtccctttataagagtttcaataaaatcaggtaaatttaaactctgaaaattctacgtactgtctatcatgttcaatttactgttaaccagtactatgcactggaaaaaatttttttcaccttaatgagaccactggtcattactgctgctactgatgctcttttgtctgcacatactgttgcaacataatgtgttgtgcatttgatacggatattatcatattgccataaggagctgctattattttagacaccaactgattccatgatagtgtcagatttctttaacatatgcttatgtttttgtacaaatgaccccaagaaacatctgctagttttgtggtggtatctactgtttcttttttagaatttgacctgtcagtcactttttaacgtgaatctacaatatttgagttgtattcctttctcgtttttatgctattgatattaacaaaattgagtcagttttatggcataattcagagagaaaccgaagctgtctatggatgttattttaaaaatacctttttcatgatgattgtgcctttaaatttttgtcattgattgacactttaaaattgaaaagtgcccttttaatggatcctttaggttccaaaatcttaagttgaaaatttctgtctattggtcctgaaagtactctctgaatttgataagtatgtagtagttgtggtgtatccttggtcagtttatatcctgtgctaattgctaatcttacttagtttctttgatgcgtgtgtgaagacaggcaaagaaaaaggaagtggaatttctacaaaactgtgaaatctttactttatggagactagagaaatttctaagtaaaagaagacactcattctattgtagttaggatcccttcttttacttgcttttcatgatcttgactgaaaagcaacaattgagatttccattgcccgacgctttctcttctgcttttctttttgtttctcttgcatttttaaagacagctatttattcaaaaacaatatgaacttttatttattggacttaaacctggaacatcaacaaaacaaagaacaaacaaaactacctttccaaatttattttattagaggatgctatcaatacaattttgtattatgttcacacttgataccaaacctaaacccaagaaagtgtgtcctgtgttacagcctatccctctgtttaagataataactagaacaatttacttttattttctactcatctgctttctgtgtatcagctgttgtcctccctcagcctcgaagcatgtcatcatttccatctccgtgctcattcagtcatccttgctgctcttagtcccctttttgtcccttgggtgacttatgtcattaggacaaccttctgtccccacttggctgaaactgagctgaggcccttgccagttgcattaggtgtggcacctttcatggctcagtttgggcctctgtgatatctgtgtgccttctactccaaactccattctgccagaggtggcagggtgactggaagctttagtttcagtgacaaaacccaagcgtggctatgctgagtgtctaagtagctttcatttaggcctgaaataggagagtcaggcgcctctgtgtcccctgagaaagagagatttccctcagctctctgggcccagcactcaaccatttaagtcagctggttagtataatttccctaaattgtggtttagtttccctatgagtaggactggagtaggaccaagtaaggaaagtccctagtgacctttctgcctcctgaggagcaggccatttactttgagttgtagcttcccatctgtctgtccccactaccctatccaaggccctggaggagccacaggatgagggaggagattcatggaaaagcgccttcaggtactgggtatgtctggagtaacatttaaagtttaaaagactctttaacaattttcctctgatacttactactgcctatacttgtttggttttagtacagtaagttttgcctatcgtgggggtgaagaaaatagaaatattcccattaactttgtatggtgcttggtatgacaccctgaacaggtgcacccgtaattgtttacttgatgttctttttaataagtcaattatatcatcggaaattgaagaatagcaaagttaatttgtttaatcattctatgggaactcttgcatgctcgttcactagaggaacattgcgtttctcccttaaaggacaaggctttgttttgtttttaataagacacactctttataattaaaacaaaatcccagtgttaagggatttctgttttaaataattggatttctttcctttgttcctctaatccctctatatgagaaaaaaatctaatggtgtcttaggataaatatttttagattaaaaagttctcttaaccactgaaatttaataatacttctcaaagtttatggatgatatagaatgtaatgtaaggttgagaattttagatttggcaaaggcaaagatacaaaaactagtgaaaaacaacaaactggaaacacttttaaaatactgatgtatttatctttgcaataaattattcagaaatataaataaactcactatttacatagttttatttaaatttgtcctcaaaatactaaatttagtactatatattttcttctttcagataaatgctttcctgaaaatggtattttaatatctacagatggtttagtttaacaatggttggggtaaaaatgacatagggaaaagcaaaatgtgacagcccagcttggttacctttagagaaactcagaataaactctattcccatttccttctctttcccctttccatactcgagagcccttttctgagactcttaagtcatgtttgggccttggagaggataaatagcagggtgggtggtaaaaggggagagtgctttgcttgaggcaaagttttcctccatatgggaccttcctcaagccctcccttcaaaccctttaaatgagagcatgagctcctaggacagaggtcatgtggaaagcagcattagcatgaaggggggtgctgtggaggggtgtaaggtgcaaaaagcagcattagcatgggggaaggtggggtggaggggtgtaaagggaatgagatgtgaagtggttaaagggccatttttctagttggcctctgggctttgatgaaccttttccagtgtgcctgtttctccacttagccctgggctaatcttgactcttaactttccaggtgtgtatctatgctgatttctcctgggtttggaagctctgagaagctctggttctagttcaatcacaagacttttaaagaaccagaaaaataaaacaattttttaaaaagtaatgaagaaaagacttttaaagaaccagtgaaaacctgggagtaaaaatatagaagacttgagaaatttcatctttacctttcaagtgggcagcatgagaaattcttgtaaatggtgctttcaaatcttacacaaggttctcagttacctttatttgtactccctagactgtattgcatcccttgctatgttgactaattcccacctaaaataattcaatggcctcccaatataatctggcattctaattaataagctaagaaattatttggtttttcactcattggcgttaaatattcttcagtgcccacatttggaaatattggaacacagaaatgaaaaaagatacaatcagtttctctgcttgccatgttttccttgatatggcaatacgacaacaggtcaccctttgaagaaaattcagagatgctaaagtagaaattaaaactgaagataagtcaaggcaggatagtataggagtctgctacagctgccatagcaaaatactacagcctgggaggcttgaacagaaatttatcttctcacagttcttgaggctagaagtccaaaatcaaggtgccattggggttggtttctgaagagggttctcttcctggctttcaggtggccaccttcatacagcatcctcacgtggccttttctttttgcctgcatggatagagatctctggtgtcttccttgtaagaacaccagtcctattggattaggaccctatgctatgacctcatttaacctaattaccctatttaaggccctgtctctaaatacagtcacactgggggttagggcttaaacatattttaggggaacacaagtcagtccataacacgtgatttgctatagttttcctttacctaaatcttttccaaccttgagagtggattttggccaggtgtggtggctcacacctgtaatcccagcactttgggaggccagggaaggtagattgcttaagcccagaagttcaagatcagcctgggaaacatggcaaaaccccgactctgggggggcagggggagtgggggaattagctgggcttggtggcgttcacctctagtcccacctactcaagagggtgaggctgaggctggaggattgctacagcccaggaggcagaggtcacagtgagcagagatcacaccacttcacttcagccctgggttacagagtgagaacttgtctcaaagaaaaaaaaaagtgggttttattcttccccttaaattcctattaatagtgaggtgaggcttcttgtgttttttttttttttttccaagacaatggttaatgtgtgattacttaaaaatgatatataacactaagaaataaagaattgttaagtgagaaggaacatattaaaatggcttggaaagatgggtaattttttacattttaagtaggttttctcaactctaactctgtggaacttggtcaatctaatcagtctaaatatagcacaaataataatagttatatggacaggagaaatagtagccctcaaagatagtgaaatacatctgaatatcactaacaatgtcatgaatttgcttgttctaaagttttctgaaagtatgaattcataactgagtttttttttttttgcctatgactactaatgtttgaggagagagtagtgtcagaaccacccccccatttattacatgtttatttcatattttggtactgaaatcagtgtttattttgtgtcttcctgataaatcttgccaataagtaattaccttccatactgaaaagttcttaggattaccaggttgctgggggcaaccttaaaaggccatgcagaacattgacttaggtggctattaccctgctttattcaggtctgagcatttactttcctactacaatcagaatactgacctacatttaaaagtgcaacactgccctgttatctaaatccactgtgttcctgagaggaaataccagaaaagagggcaccaatattatttttctgctgttcttgatcataagtgattacctttttttttggttaggcattctgcttctgaaagataactgaggttgaagttaatagaactaagattcttatataaaatcataggaaagataattttcaggattattgaatcatattgaaaaatgatataattgtgttaaaagataaggactaaaatgagttaattcaatttggaaatagttaaattagaatttgcttctgtttttgatgaatactgctttttgaaaaatcttctgagtatttaagcttttactactctagtcattctctctaaagtagacatagaagcgtgttcttatcttgatttggtaaggctctgaaaatgcaaagcaacagatgttgtacccagcataattatatgtatcctggaaacacatctttattgagtgggatttgttcttggggaaacaaaaatttggcaaacaaaggacattaacttgctgatctcagcagtaattacttgggttagattataataatcttgtgtaggtggtaactgcatgcatatattacaaaatctaattctaaaatacgtacattaaaaggaaaatgaacttgcgcaaactttagatcatgtatccccttgaagagcagaaaagatctcaatttcattatttgaaagttgtttgaacagctttttggaagaggtttccaggattccaaatcctaatatgtgtattgatactgaggctttggactaatctttgggggttactgccttttttatgcccactgaaaatagagcatttcaaacaaatgaactgatctctgatctttaagcatgccagtaactctttggaacaaatccatagttatttttaccaatgactgtattaaaacagtactttctgtattatctcttccattccaaggccattttaaaacaccctctttctcttctcccaataggtaaagtacgacagagctccttaggactgggttatggagaattatctggaggtcaatttgagaaccactgtgcaaaccatttcttaaataagtagctacaaggttgtccttacaaaaatttctgaagttgatggtgttgcgttttggagtctgaagcttaaataagagtttgtcagtggtcatggtctaaatagctgattactaccaaggtcatctaatttttttttaacacaaaaaaatgttctgagcacaaatgaaaccttcaggacaagacatttatgttttgagaatgttcttaaatgattcctgtcgtgtatcttattttacatatcttaatgatcagcatgtattttttgttgttgatgatgattttataaatgtgctatcacctagtttctaattcctaacagctccttcatcagtagaatattgctgtagcacagttttgccatctgttaagaaaagatggtgactaataagagtggcacatttcagggctggtgtgctatcgcaacatctagtgttttagtactgaggacagtgatgtatgcagtgttccttacagccatggggtgtgggaatgttttcctcttcggcaaagtctgtgtatttctatagctgaactctcaggatccagaggaaaaccacaagatgatgaaaccagatgattgtcatcaaatttctattccccactacatgattattagttttcgtcaaaagaaatactcatcctatcctgggttggaattggtaaagaattttgcattgtgactaggacacctaaaagtttttaggatgagtacaaatggaatttgatagatttccccaaaatgtttgggaaaagatttattcctccctaggaacagcaagagtagcagcatcacatgaggcaactcctggtaattttttcttcttgctcttatttcaatgatatcttttcattcttttctgtatctctcaatttctatgtttctcctcttaatgtatcctgtaaatttcttagtagaacctttttactaatgagggtttcctagtttgctttaggaggcactcaggatgcccccttttgtaaggcagtaaattgaaaataagaacttggtgaaggtccacgtgacggttagtttccattctccattgtaccaaactgctacagggaaagaaccatatttaatcaacctcaaatcctcaatatttaggtcagaaaacacttggcatagaagagacactcaaattttgcagctaaatagattattgatagaaaatatgtttcttgcctctacaagcaatatgaaaccaatacaatctctaaatatcttcagactactaggggcaaatactgtattataagaataattcttcagaaaggaaaatccagctactctcatatcacctctctatgttgaaagctagggaagataaactggcttccagccagtgagagtccatgtggacctagtgctggctggagatccctaatccaaaggcaagagccagatactggttgtctgctgaaaatcagaagatgacctctctggtagtaaggccagtgactcatccctgcatcttttatcctcttctgatttgtataaggatctctcctttttccccagtacccactctcaagaattgctttcctttttaacatgatcataccaaaatgtatctaacagtaccttgatttcctttctgaggaatttagggagcatatttactttgtcagactcattagaggtttggcttcttggtcgggttcttaaatggacaacttgtttgggtgatttggcagagaataggagaagccagtcccctctgatagagcaaacctggggagctgtggttgacccacctgctaactgtcctgtacaattaggcatgtggcatcagtgggtgactgaccagagccaccatctcaatggcggctgttctttccttcctgtgccttctcagatctcttttttgttcttgttactccactatattggtttttcttgagtttttttcaagcaaatatcattattcacttctactgcagttcctctgttgttcgctttttctcttagtcttcattgttttccattttgaacattcagagatccatcaaaaaaagtaaaataacaggaagggagaggtaaacaccagtcaaatgaagtattataatagtgtattactatactctttaaagtaattgaagggtggttttttggggtcagaatatctgttagaatttggaatttgccactcttgagactggggcaagctatttaaactctaagcttatctgtccttcctcacaatctgtaaaatgggatcataataatggcacccagtttatggtgtagtgagcattcactgacacaattaatctaaacttatttgcactacatagaacagaatttttgtctattaaacaatatagcgttttaggcatgaaagaaactttagattaaattaaatatcatttttcttaccacagggtaagtttctgttttgtttgcccctgtttctctaactcctagaatagtttccagcacatagagattaaacaaatattcgttgaatgaatgaatgcatctattctaatcctcttgttttaggaatgacccgtcaggctcaaaagtgaaagcatttccctcaagattggtgacagagttggggactaaatctaaggctttctcttcctacaccagtgtcctttctgagaacacgatgccattttctcaatatttgtttatttatatggtaaattggtaggaagctgtgtggtactataagaggataaactttgataatgaggtatacttgctatcaaattctaacattctcatttaaaacatggcataccatttgtcttctacattttcatatgtaaagtgaggtgatttctaccttatagaactattgtgaggattaactgaactaatctttgtagagcacctggtcccatttattttttttttttgctcaccccaccccccaactttctagctagataacttatacattcactctgtttttcattccttcttgaatctcctgtggccagacttgacccctgtcactctacagcttactcgtcaaggtcagtcctcatctgacttgacctactaagagtctgacaagtagtcacactatgctccttgatacagctttcttcacctaccttcttggatgtcattcttttggttctcctcctaccccattgggctgctttttcccagtctccattcttgggtattctcattttcccatgtctgtcctctgacttcttattgtctctgtttctgttttctctggttggaccttctctagtttctggcttcaaatactatctaaatgctcatgtctttcaaatttgtaactctagtctagacctctcctctgaattccagttttataaatcttctacttaaatattagaggtctaataaacttctcaaacttatgttctacaacaaactccacattttctcctgcagcctctaaatatgtacctcctatagattttcccatttcagtaagtgggaacttcattattctgattgtccaaaccaaaaacacttggagacttgctacattccaccctttgtctttcattctacatccaacctatcaacaaatcctgttgcctcttccttggaaatatatccacgcttgagcagcatcattgtcaccacttggtgttatacactctcatttctcacctggagtattgtatttctcatctggagtagtgtctgtccaacgatgtcccccatcagtctgttctccatgtagcaatttcgtttttgtttgttttaagattgggtcttactttcgccttggctggaatgcactggtgatcatagctcgctgtagcctttaattcctgggctcaagtgatcctcctgccttagcttctccagtagctaggactacaggcacacaaccacacttgactaatttttttttttttttaacttttactagagatggggtctccctttgctgcccagtctagtcttgaactcctggcctgaagtaatccttctgtgccagcctcccaaagtgttgggattataggcatgagccaccatgtctggcccagatgttaattttaaagtgtacattagagcacatcgttcttctgcatgttcagcataaaatccaatgtccttaatgtagtctatattaccctacatgggctacttgtgcctgatccctctactcttatgtcttatccctctcctgctttctcactagcaccagccacatcttaccgttccttgaacacaccaagtatgcatttgccacaggaccttgatgcttactgttccctttgcccagaaacccttggaaccagctatgtgttaaaattcagatatttactgattttagagagctaaaatggggtatatataatatattacataacactcacagctggtttgtggtagcatttcataattaaataatatttctgaatgaaacattaagaatgcccatgctaagagggatgagtaaagactcaactctcattgtcagttcagctgcagaatgaggtcagctcaagatttgctgccaaatgacttaagaaaaaaatgtttttggagctttggggatttcagaattgcagatgagagattctagacccgtacctacacagcatgctcccttattttgttccaatctttgttcaacgattatttattgggtagtcaaggaagatctctgtctaaaaggcttctctgtgtggaacaagactggcatgtggaaggtttccaattaacgatattgaaagagtgaagctcaaatcatttttcactcaaatacatactatttagaagacagtggccagtttaagaataatcattattggaaacaaagtactatttgattagggatagttaacacaaacacttattagtattagggatatgtgaaatacttaatggatgagtcatgtgctgacataaaacccattatccattttagttcctggtagcctaactggttgaactctgttttattgatctattattgatttggcctgtaacttcaagttacattttaatgtaatttcatccttttctgatcaccttgtgtcttcaagcatttttaagcagttgatagatagttgaaagatattatcactatttcaatctaaaagatattatcactattttaatctacttaaaatttttactacattcattttaagtatgacttatggaacgaatcgaaaatacaagatagtgaaaaacttgtgaggatcacctgaaattttagcattcactttccttacatagaggaacttagtctctctaaagaattatgagtaataaagtatcataatgatatttgtcttagttttggttaagtgtactccacaggagaaagttaggcatgagcaggaattattgtagtcccacattctcaaacagttctccagtaagaaagattttatgtgtttccagaaatcattttcctcctcttcagagctttgggaccataattgtatttaaattgctaatctgttttaaggaatcataataaattgtttaacatttatattcaatcaactttgtaatttgtataaatttttcagggtgacatttgaacaatttttaagaaaatgggaaatacagaagtattcttagttttaatatattttaaaaagatgacatgtgatctactgactgaaatccttcaatcatttttgtttttctccccaagattagatagaatggatgtgattttatttttaatttgcattatggagagtacttttggggggttttatgaaaaagacttcatttattttgttagtggtacttcagttgcataagaaaatgttcttttaaatatagtggtcatttgtgtgcagccttcaagttagcaaacatgcctttgagtagtcactatttttgaaggtctttatatctgattgcaatggcttatattcaatagtcctcctactaaatgaaataaaaatggatgcctcttctgccacagaggcacaggtggacatgttggtagcaagccccatgcggtgtgacacatggcacagcccaacatgggggcaaagagcatgcggcttgagctaggagtcactttatggctactttagtgtagatttgtgtttttctgtggaacagccattattgaagacatttatatagtatgatgtttgtttttcattaaatgctgattgtgatttcttaaaaatagttaagacttgattagcagaacctatttagaagccagagttcccctgcttcacctcttgctatctatataaatgatatttttgactctgtcctttataatgttggcaccctgtgcatattagatgtaatcagggctgaaaggaaacttgaatccatctggaagcaataaacttttctaaaagactgcacagtgttatttaatcctgtgacttcttactgtgagtgaaattaaggtttgatgcagttgtgtcacatcgtattgatatcaaatttatctttctaaaaaaaaactgacagtattacagcacagaggagaagatggcttgctgtaatcctgtaagctattttacattgattacatgctacataatgtacctaagtatataaaatacttgatctagaatgtttatgttttctccaaaattttctcatcaggtaatactttctcaacttcacctttagttttggcttcttatcatagtactaactatgcggtagtaattgtgttatgatgaaaggcatggagaagaaattataattttaaaactattataaagtggagacacacttgtataattaccatctatgtagactgccaaggtataaacatttagcttattttagtatcagactctttgaatcaatttaaggctttttcaataaaattggcttcctctaatttctactccaaaatggttaaaattttgttttacttcaaatacgttgtagggtatcatatttcatgtgactaggagcctaaactatatcagctgactggcataatttgtgaattatatgtgtgtttattaaaatttaaagtttttattaagacttacaattttattaagacttaatttttttccttacattttgagtaagtccaactgaaaataacttagagacttaggaaatttgactacattttataagtaatttccttgtaatttttctttcttgtggaaacaattcttactgatttacttaactcttttttcaatggcaaaaatgaaaaccaaatatatttgtcaactatattcttttaattgtggaaatgaaaggttcatatcccccatttgcctagcatattaaaaataaacatgacctttgtcttgaatgttgttaacttggattttaaaaatcaaaccaattataagctatattaaaattgcttatcaccttccctttgtcttcagtaagtctgggcctaaaaatactcatcatatgaataaataaagttttacaaatactttttagaacatcttgaattatatgtgtgtttgaagcttacttttggatgttcggtcaacaaggcttctgacagtttctttttatcttccctctattccctgccactgtgcaccccaaagtgatccctgaccacagtggtcccattgctggcatcaggaaggtagactgaggagttcaggtatcctagaggctgttaggtgaatctcttctacctctttcctggtcctaggaccactggacacttcaagtaaaaataacaattactttaatctctcaggtaaagtttcttctcccttccagcaacacagatctgcctgtgccgagttcaaatactctgaactttcaacagttgttctgaatacttttttgtcatcttatgatcaaatattgagagcattgaggggataactgaatgggcatggtataaaagtcagacttttagtgtttctaagtagcagaaccctttggacaatttagagggctgtgcgatatcctcaccgtgactgctgggaagtaatgggatctgacctgcagaggtactaccttggctgacaataatgacaaaagtgagagcaaagtacatatgactatccttgaggtcctcaggaaaaaaagagtattagtgagttgaactgtatgtaagggtctttaccaataaggaagcccatgcccagacataatccttacaccctggcaatagaaaccatcattgtggtttacatctcatcctgttcctacagtccagcaagttcaggccacaaaaggtttaagcactttttcctttgttctcatagcaacagttgcccatggaggttcagttacactaatattaacattttaatatacacaaagaagtgcctcgaatgtagtaggtattcaaacttgttaaatgaaagaagtaaactttcagacttaccttgaactactacagttttattctttctctaacctctcccactactaccatcttaaaaccaccatttaattagtattttataacaagttattaaaggctttcaaagacctttgaaccttcaccctctggtaagttaataacttctgatatgcgattaaatgtcaactgagtagtagtgggccctaagagctcagagggactgagaaatgaaggttattgtttagaagagtggctcaatgtgcttcgacagttggttaatatttgaaaagactagagtcaagaaagccttccatgtgctaggaaatgaaggagcaaaggtccagaggtggaaatgtatacagtgtgattaagggattttctgattgatagtaaatacagtcaataaaaaacttttattggaagcctagcctgtgtttgaagcattaagctaggtgctgggatacagagattagagatgaagataatgatgaagatattgttgaagtgaattgctgagaagctggagaaagggccaattaccataatctgaggctcaggaggaattggtgcaaagatcatctggtatgatatatatgaactgtatatacaaactgatctgtgtagctgaactgataatgccaaaaaaaaaaagactaggtttttgattaagatgaatccattaaggtcatgttttctgttggtgccattcttggagacctcccccaaccctatacatttataaatgtttttcctgagggactgagatggaagtggacatataaaaggaaaggtctgggcaaatacataagtaggtagtaaaatcaaggaacaaatgatctcaacaaaattgcccttcttgaaatgaatgaaaatgatgaaagccaatcacattgcatgatgaacttggggtatagaatatgaaatatttaaaattgctttatttcatgatgtttcagatgtagtaggaacttgttgcatagatggtgtaaaaacaatctagtaataaaatcttaggtatttaatacaaggtgaagaaagatgcaatgcataaatcatgccattttaggcttaattttcataaggctatgcctgtctttataagactatataccaggagttctcaagctttttggtcttggaacccttttatactcttaaatcgttgaaaaccacaaagaccatttatttaagttataaccattgatatttgttgtattagaaattaaatagacattaaaaatatttactatttaaaaataaccaaaaagatgggcatggtggcccacacctgtaatctcaacactatgcgaggccgaggcgggtggatcacttgaggtcaggagttcgagaccagccaacatggtgaaaccctgtctctactaaaatacaaaaattagccaggtgtggtggtgggcgcctgtaatcccagctactcaggaggctgaggcacgagaatcacttgaacccagggagatggaggttgccgtgagccgagattgcgccactggactctagcctgggcaacagagtgagactctgtctcaaaaaaataaaaaaaataaaaataaaaataacagtaagttcattgcatattaacataaataacatatttgtattaaaaataactattttccaaaacaatcaaaaaagcagtaccactcttctattttaaattttttcaaatctcccttttctaaaaaaaaaaaaaaaatattgtgtaagtttaaggggtacaagtgcaattttgttgcacggatatattgcttagtggtgaagtctgagaatttagtgtatcttcacccaaataacatacgttgcacccattaaataatttttcaacacccacccccttctcactctcttgagtctcctttgtctatcattccacactctgttcctatgtacacattatttagtacccacttaaagtgagaacatgtggtatttgactttctgagttttttcaactctggcttaatagaagacagctgaaatctcagaatgcttcttcatccagtctgttgtgaatatgttgctttgattcaagtatctaaggaaaatacagttttacacagatgtgcagctgaaaaggaaacatcttttaatatgttcagataattgtggatattgtcctttgatactatagcaaaacttatcaagtgctaatttcttaaaggctggttataatttgaaatctgaaaacatatctatttaattgtagtttgctatttgaaaatttattggtctgtcttgtactttgaatggatattttgcccacgtatgattttataacatcctgtattggccttttggaaaatttggtttactattatacagtttctaaatgttgataatttttattataatatattttaaaaagtctaatgtcactgccagtctcatcagaaaattctttgagattagaaagctgttaagatcatcatcacacttacaagttttacaaaattttaattttactcaaaactttatattttatcattgacaaagctctcagttgctttgcttagtgactgactcactttgttcattttccagaaagtgtttaccaaatgctgctgcctcaataccagagtctgtattgtcagttgatctttcaagtaaaaagtggtgttctatgaaaaacagctagttcagctgcgactgaaatgatataagtgtttctcctggagcaaaccaccacttcgatttgtagcagaaatgctgtatgtatactttccattgttattactcataacatttttaaaaatatactcaagggtggagatttttttaaaaataagtgttattgcttcatcaagaacagttaaatgaaactggattttttaaactgagtttgagttaatgaagaatgcagcaattattagtaaaatttggtgctccaccttgattcatactgacactccaggagttttacccactatttcttttgtacctttagtgcaaatgttaatatggtaggaatggtaaatgacatctttagtattattataaaaatcgtttttaccctgtatactctttgagactacacattgagaattgctgatgaaggtgttttaatttatcataagcactgaaaagatttacttaattcaccaatttctcctgaatatttgtttatataaaacaagactatgtgtatacacctacctttttattaatggtagagatctaggaaaattaatttctaagaactagccaggatatttggaatgtgaataaatcatatatccagaaaaaagctttagaagattgtctatgattgaaagtcaaacagctctcatttctattatactgttctttttcaaagaatttaccaattttatgtggtatttatgattaaacatacaccatgtaatttaacatttttaatgtcacttttacatcataggtattaaagattagcatttttattgtctgtattttaaagctcaaagaataacatttaggctgggtgcggtggctcacacctgtaatcccaacactttgggaggccgaggcaggcggatcacgaggtcaggagattgagaccgtcctggctaacacagtgaaacaccgtctctactaaaaatacaaaaattagccgggcatggtggcgagcgcctgtggtcctagctacttgggaggctgaagcaagagaatggtgtgaacctgggaggcggagcttgcagtgagccaagatcgcaccactgcacttcagcctgggtgacagagtgagactctgtcttaaaaaaaaaaaaaaaaaaaaaaaaatttagatttttgactgtttcattgattcatcttagacttcacatgaaaatatctgtatatcctcaaatgcttacattcttaagaagtatctcagccatttacacatgatagaaacaactaaatggaaaaaaattgcagttggaaattcactattttttatttgatccgataacaatgtgacatttgcgattggactgtaattttctgtctttctctctgaaaataagttcaaaaatttccctctaattcttttactagataagaagcctacttcgttgtaactcttgatatatgtatgtatttaggaacttaagcttttctgctaataaatgttatgtcataattcttgaggatagtattatattgtgatgggttttcagtaaactacaggagcagccctatttgtttaaaccctagtttaacctgattattaacaattaaattgtgttttcttctaacaattaaagtgtgtttaaatttattggtcccttgcttcacagatttatctcagtatgtggtgtattcaaacagaattttgtatttttaattaggggattagataaccaattctgaagagccaaaaaaattgttagacatcacattgcttaaccatctaatataccataagtgtgtgtatacactatgttgtgggagccatctatcaggcaggcctgtttttcaggcagtattttaaaaagtggacatgtgcagaaactgtgagcacaattagcgccaagcagataaatccagctctaatcctgtttacggtctacatcagacagatgtgccaagattgatttagacaagcccgaggcttacagtaatatttttaaaagtgccattcgctgttctatttttgttaaacctttgctaaatattcttaagtcttgttggttttgctcttcttattaaccaccgtaagtaacctactttaagcaggtcccgctttgctctcatggtgacaaggtaacctgccaggagaggttatctttattccctgtaattaagttgacttttccccccaaaaaaatacaacaataggaagtgggtgctgaattaaataaatagcatgatacccagtagatgtatacttaagttccttgcaagaacagatggtccccagtatctctgtaagtaatgtgagaggacagttaatgttctgaaacaactagctataaccagtatgatactaatgaaccagtagatttcaaataataaaccacatgccgccaagcaaaattatatgtcattcataaggatttaattatcataacttgcaaaaaagtgtcaatagatgatttctatatttttatctactgatatcaaatatcaatttatgaatagagtttcacttcatattttttaccaataaaggtatgttttaacattaaggtagaattaaagttatatttaaaatacatgccccaaagtatgtggtgatttttttttaactcctcttttactatactgtctgtatgtattgggctgtatatggaaatgtagcttttacatacaattaggaaaacaattgcttttatttctagcagaaacttgtactataacagaagtggctagcatgggaatcagagtagttatcttgtagatgacaactgaagcagacataaaagatgtaatattttttcagcactcaaaaatttataagtaaaattttataaacaaaaagcagtatttttgtgattcatatggaaaataaaatgagtctgagtcattcttaaggtgataccgtaaaggtgtatagataagaagtccatttttaaatatacccaagacaacagttttttctctcagtatggtttgttttcccttttttctctttaattatgtttcccataagtatttgtatattctaagaatgtccaaaaaataaatgttttgcagtgggggttgaaaagaaagaaagacctttttagatttcagctgatcttatcagatgatctctagaaccttgaaccttcaaccttcactgaagttagctggagggcttttcacctggaaacctgagaaacctcagaagccttctgctttagctctctctcaagtctaggaagccagtggcctgcgaccccacagagccagctggtccactcctcatataagaacttcggtaacaatacaaagacatagcaaagcaccatctaatctgataactcattaaacaatatttagatggctcaagactttaaataaaaacattttaagcttgtttatagaatactaacaagttttattcccaaagactatattcagagtgagaaaacaattttccttaaaactaatattatatacatgttcatatatgttaggaactagttatatgcaaaatcaagtgactcttgtgattagaactggtcacatttattcatgtagcataaatggttaatattgccaaaatgagtaatagatcagattttctatgtgagatattgacacctgagagatttacagtgtttcactgttgtgaaaaatggagtgctgaagaacatttgtctattgttatacatttgtaaaagaattcacaaattactaatttcaaataagaactaaatatttcttctaagcctatagtttttctttttaatttcttctaagcctacagtttttctttttaatttcttcttgtaacattggcaaaaagaccattcgtgtgaaaacctcagattttgatctgtacacaaatgcaggagtagagattggaagcttgagctggaaaagcaggaaatactgctcagagccttacaaggattttcagaattttcactgttgggtcctcctggttgctgcagtctaacctcgcatctccttgaaggcagccccagtttctgatgaaatactcttcagttaatttatacatatgctgtcttgctgttttcctaaggactgcaggcagaactgtggttcacctactgttttaaatttggctagatttaaaaacagatgatctcacttatatgtggaatccaaaaaagtcaaacttatagaagcagagagtacaattgcggttgtcaagagctgggggaggggaagcaaggggatgatggttaaaggtataaaatttcagttagacagaatgaataagttctggatctattgtatagcattgtgactatggctaataatgtatacttgaaaattgctaatacctgaaaatcactaagagactacgtcttaaatgttcttacaacacaccaaaaaaaggtgtgaggtaatgaatatgttacttagcttgattttaatcatttcacattgtaaacgtgtatggtactgatcttgtacctcatttcattttccatatgaatcagaaaaatactgctttttctttataatatcttatacagcatagatacaatttttagtggtcaattatattgtaatatatacataaatatatatgattttcattggtcaattatactgtaataaaacagcaaaaaataaagttgtaattaaaaaataatttggaagaaaaaattagcaagtggttggagattgaggaagatgggaccaataagtcctccaaggagagtcatacattagttttttttaaaagtccattattaatcttataatatttaatatgtttaatttcttgacacttattaatccaattaagtatgagaacactgtggataaatctaaaaaccttaaagttgagtaaaataaaccagatacaaagaagcacatactttatggttacatttatatgaagttctagaaaaggcaaaacttagctatagtaaaaaaatcatggtcctgagggaataactagagagtggtatgagggagctttctataatagtgggaaaattctgtatctttattgggatagtggttatgtgagtgcatatacttaaaaaaactcatggaattatgcccttacaaatctgtaatttttgttggtaatttataccttaataaaaaacaaaacagatgacagggttagtgattgtttccttgaagaaggtctttacatgggtctgttgttaacgagttgtagtaaaaatcatccaaaatgcttggattcaaatcttagatctgttcctaccagatgtgtgaccacagacaagttacttacattccgtcttcagtttcttctcttttaggaaaaagcatctagtttttgttgtagagattaaattagataatacaaatgaagtacagagaacagcgtttggtgtgtaacacatgttcattattagctacccttattttttagagaatggaaatttttaaatttaaactaatcaaactattttaggataagcaagtgaaacaatctttttttcaatcgatcacagaaatattttcactgaagacaaattagacatttatataagcaaactacagtgtcattaccattcaaattttcatatgcatattcatgcttacatgcatatgaaagcattacacatatgtattctataaatatatacaaaacagtaatggaaatgtgctgtactattttgaacatctttctagtcagcccggcattttatttacttttgagacagggtctcactctgttgcccaggcttgagtgcagtagtgtgatctcagctcactggaggctggaggtcctgggctaaaggaatcctcctacctcagcctcctgagtagctgggaccacaggaaagcaccaccatgcccagcttatttggtttattttgtttgtttgtttattttttatttttttgtagagatgaggtctcactatgttgcccaggctggtctcaaactcctgggctcaagttatcctcctgcctcagcctcccaaaacactgcaatcacaggcattagccactacactgacctctacattttaatagctgagtagccttctgttatatgaatatacttttttttaacaaaaccaatactccattattgtacatttaggttgtttccaagtttcactcaaataatgcttgggtaagtaagtatttttatttattattattatttttttgagatggagtttcactctgttgcccaggctgaagtgcaatggtgtgatcttggctcactgcaacctccgcctcctgggttcaagcgattctcctgcctccacctcctgagtagctggggttacaggtgcacaccatcatgcctggctcatttttgtatttttagtagagatgggatttcagcatgttggtcaggctggtctcaaactcctgaccctgtgatccgcccacctcagcctcccaaagtgctgggattacaggccgtgagccaccacgtctggcctggataagtattattttagctaaattgtgcatatttattcccttagagtaaattcctggaagtaaattgctggatcaaaaccaggtatattttaaagaattttccttttctacattaaaaataattataattctgattacaagaaaggaaaattatggagcttcataagaaaaaattagtctcatatttcatacctcatattgcatatttaataggtaaccagtgttaaatttgttgtgtgttttccactgggatttctttttatctcctttaataaaagcaggatcagatccctcagattactttgtaacttgcttttattctactttttcatacctcttagcatgaatgtctttccagaccagaatacagagatttcacttactcatttatgagctgcagaagatgactatgatttattcaaccattctcctattgaagagcatgaatattgcttcagatacttttgttattataaatattagtgcaattaacattttaaagtcttttgatacatattcccaacttgttctccagcaattaccatttttgcattcccaccagcactggggctacttccctttagttgcaccatcatttagcattatttttgatcttgtgccaatctaaaaggcaaaaagtggtatcttgttgttttaatttgcatttctttgattactaattagattgaactttttcatttgttcattggtcaatttgcatttcttcttttgtgaaatgcctgcttgggtcttttatgtactttaccattaaagtgtttttcttgattaaatagattatgtaactgtcatatgttgcaaatatttctgtccatttggcctttgcttatgactttttatgagtctttaggacttttgaggtctttattaggtattcaataattttaatgttaaatatattgatgtctgtcttcctttgtgtcttacggcttttctatttaaggttacgtaaatttctaatatacaaatattggtgtatattatgaaatagggccctatttttctttacaaaagattagtcagttctaaatcatcctttgctatttctagcggcgcttagatgccaccattatcacatcagtgaatttttaaatgtgtaattgtttcctgatctattcatttctctattcctagatacttctattgtaatagctttaccaaatatatctgatagggtgtgtactccccctcattacttcatttatttatttatttatttagagacagagtttcagtcacccaggctggagtgcagtggcatgaacttggctcactgcaacctccgcctcctgggttcaagggattctcctgcctcaacctcttgagtagctgggattacaggtgtgtgccactacacctggcaaatttttttttttttttttttttttagtagagacagggtttcaccatggtggccaggctggtctcgaacttctgatctcaggtgatctgcccttctcggcctcccaaagtgctgggattacaggtgtgagccactgtgcctggccccctcattgcttttaaaacattttcttactgtaatatatttattccaagagaattttcaaatattttatgagattccttgtccattccttacatcaaaaaataccacggagattttgattgaagttctattataagtagttacttggggtggggggaggggggagggatagcattgggagatatacctaatgctagatgacgagttagtgggtgcagcacaccagcgtggcacatgtatacatatgtaactcagctgcacaatgtgcacatgtaccctgaaacttaaagtataataataaaagaaaataaagagaatactggcatggaaaatatgtaatcttggaacttgttgtatctccacttattcaatcctttgtctctcagtagattttgaatggctctttatcccacacgagtctagaatcattttgctaagtttattcctagatataatatgctaattgatatgggaattttttttatctccattataccttcttcttgggtgtagacatatttgtagccagcttcctcactgcatattttttattaggcctaatggcattaagtttattattttggattttacaaaaaaaattatgataacatctttaaatagttagtttcaactcctcctttccccttaaatccatcaattactgtcttttatttcactttccttatgtactgactagaatgcctagaataattgaatgctatgagtaataataggtattcttgccctgtttttggaaatccttctggatttcagtaagtgtgatgttggcttttggtttagtatctttaaatttgcaatttacaagatattttacattggaatagtcattgagttgttaagtaaagcacaaacatgttaaattcagactgaagtacaggacttcaatgaaaagttaaaagagtttatttcatcactttcattttttctttccctcagtggctgtttgtcccctccccccaccccgctccatcccccagcttccttcctttgtgctcttattgttctaggtttgactacataaaaagagactctcaatttatatgtgatacaagaccataactaatattataaaattagtctagaagaagttatttgcaacctatataataagggactaatttcaagattatttgaaggactttaaagattggtaagaaaaaaatagacaaccgtttagaataaggcaaagcatgtgtagaggcaactcttaaaaaaaaaaaagtgagctgggtgtgatgatgcacacctgtggtcccagttactagggaggctgaggcaggaggatcacttgagcccaggagttcagggctgtagtgcaccacagtcacacctgtgaataaccactccattctagactgggcaaacataagaagactctgtgtcttaaagaaaaagaaatgaaaagatattcagtttcattaattgtttgactagctgatttttggaaaatacccacaaatataaccaagcctacaagttattttaaggtgggtaagagatacatcttatctatatgcattcacctatgtgaagcggacacccagtaacacccccgtgtggaagacaagcttccttaaacttcacaggacagtatttcccatgtagtccatcatagggtgaggatttttcaggacctttggtaagcctgcttgctttcattcttgagggtagaggaagggtgcaagacttccctggtctctcccaagcattttggggaccctggccataagcctacttgctcaacaggtgcaaatgactggtaatatgctgaccagatgcaagtgtaccaccaatgatttgctgtgactgagtttggtttcctttgcatatactatccagctttttgtttctaatatattcttccttaagggaaccaggacttcttggggaatccagatgagcttgaaacactgtttttataagagaagggctgttttcaaaaacatctatagttcgtaacaaaggagttagattgaagggactctcactgttcagtctgtgacaagcatgagtgttaaaatggagacaagaattttagttaattgtaatgttgaatttgtaaaaggctataacttcataatatgatcaaggggaacaagcaatctaaaatgtgttaaagtagcattttcaaagtgcggtccagggactctcagggttggtgaggtcacaactgtttttataatattgctaagaatgtatatcactctccttctctccaaggatacggtggagttttccagaagctatgggatatgtggcgatagccttgccctaatggagtgtgtgctttgtgctttgcatttttgtcctttaaaaatgcttggttttaattttgaatacaataattatagatagatataacctacataaaccaaagttatttgcggccctcagtctttaagggtgcacagtggggcctgagactaaagagtttgggaattgatgttctagagaaaagtcagtcttactgatgagggttaatcaattagtatttactgaccgggacaggacaaaccattcattttataaagacacacagagcatttcactaaaatacttttactctgattaagtggtgattttagtaatagtaatgattgtttgattttctgatacctgaaggaaaaagagcctgttgaattgatactttgagggtgttgagttttaggtcactgggtgactgtagaaatggaccaggagaagaactgaaacttgagccttctaagaaatagaagaccaaaaaatgtttagtgttaccctatcccatgaccacaataattgagaaaaaggcctttccgttccctcttccctaccctcccccttctcccctaccctctcctcccccctcccctccccctcctctcccctaccctctcctcccccctcccctccccctcgtctcccctaccctctcctctcccctaccctcccctccccctcctctcccctcccctctcctcccccctcccctccccctcctctcccctcccctccccctcctctcccctcccctccccctcctctccctccccctcttctccctccccctcctctccctaacccctcccaacctttcccctccttctctgtccccctccccctccctccctgtcttcctcccaccccccactccctgtcttcctccttgtcttccatcctcccttccttcctttccttcctgtctttcttttcctttctttcctttttcttctttccttcctgtcttccctcctctccgtctgtctccttctccttgtccccttctctctgtcttgcctttcctttccttctgtctttttctttctttctctttctttttcactcttcctttttttaatttcccttttacttgccttctctctttcattccttccatgctttcttttttttagtggtatgtatactttgtgagcaatcagactatagcttgcagaatagttgggagaggccaaaaatgcccctgagaatgcaagcaaggaacttcttagtgagcatatgaacatcctcactccaatcggaggataacattgttcatacttcaaggactaaaaagctgagagagggtctctgctttctgttacttttagcactcgagtcatttctgcatgtatttctactgattactttttctcctattttggttcatatgttttctgcttctttgcttgtctagtgattttggattagatgagtgacattgtgaattttactgtgcaggatggctgaattttttttctattcctgtaaatatttttttggcattgttctaggatgtagttaagttacctggaaaaagtgacatccttttgagaggcttgcttttaagttttgttaggtggaatcacagcagtctttagccagctcactaaggaccaatactcttctaaatacttaccataatgtcatatgaatttccatgtttttccacttcagctggtaggaacacctgtgtcatctctaagcattgtactgttaattcttctagtagttcttatctggctttgtacatctgctgatcaatactttcagctaaagtctcaaggggacctctgcaaatctacagtgttcactgttcagctttctcttctgtagtaaattgcacagtgaactctagtccccttagccttcctgaacccccagttctccttaactcagggagatcaccaggccccaccaggattcctgtatctgccctgtgacctggagattctctgcaggcaataggttggggcggtcgtagggtccactttgttttcctcctcttcggcttcactgtcctgtgttacctgatgtccaatgtctgaaaactactgtttcacgtatcttgtgtgcttttgtagttttaggtgaaaggtaaaactagtttcttattattccacattggccaaagcagaagttttggaagtctttttttaaggtctaaaacacttctactttgagagtcaattgaaatggtcttttccacaataattattttctgacctatggtttaaagataagtcatgaaaattttatgccactatttttttttaagtctgattatggttaaattcagggggctatttcctcctagattgacagagtttataatgtttcctactcacaataattgtacttctgcttcctctttgcatgtgttactttaatgggaatgtatatttccttttcgttaaggctgccttcaacaatttgtcataaagtcacttctgttagtgaattctattttttctgttactttactctatccttagtaccaaagagctccttatgtgacaccaatttattactaaaatgtcgctttgtttatgttcttggaattcttcatacattgactatcctcagatgtcgaatgttgtaggcctgtgtggcagggactctcttccatttattctatttttaatctaattcttgacaaaataaacccaatttttcttttcttcccctttccatctcacgtagggactggcataaagggcaatccataaaattacaaatgatgaatttttttggttttaactattattcatacatttaagatatggtcacaatttttatttcttactagtaattcattttattttttaacttttaggttctggggtacacgtgcaggtttgttatataggtacatttgtgtcatgggggtttgttgtacagattatttcatcacccaggtattaagcccagtacccattagttatttttcttgatcctctccctttgctcactttctaccctctggtaagccccagtgtctgttgttcctttctatgaaacacaatggttttaattggaaaatttatttttttttcaggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggtaagtactcctcatgggaaattttaatcagcccagtttccttgatatacatgattaatctagacatgttttgagtaaaaacaactttagtgatgttgagatagtttccttctgttcctagtttttgtcgtgagaaagtgttgaaatttgctaaatactttttctacattaattgagataatcatatttttccctacatcctgttaatgtggtatcttatattaattgattttcatatgtttaacatccttgcattccaggaataactccccaatggccatggtgtataatcttttaaagatgctattgaatttggtttgttaatattttgttgagtatgtttgcatcaatattcataaaacatattgttctgtagtttttctgtactgtttgtctgactttggcatcagggtaatactggcctcatagaatgagttaggaagtaactcttgaatgactattttcatgaagaagcttcaataatctgaaataaaatacttaaataatttagttcacctgagagttgtttttagaagcgtatttatttttctattaatgtcttttttgaactatataagaatgtattctccttccactcacacattgatggcaagtgtgtatttgtactctgtggcctgaaaataagatttttttgaataatcttaagaggccatgctttatactctggtaattgagaattacctatttcacagtagctttttctaaaggttaatttccagagaaaagagaacatgtttattaggatatatctcttaatgaattcagtgtatctgaaatttctaaatgacattttcatattttgcatactaaataaaattcataagtacaaatataatgcaattcataagtacaaatataatgcaatttggatttctagaagttatctagttaaaatatgatcttaggatttattttttttgtcttagatttatgaatcttgcttgtttttctgttaattcatttcttcttgtttgctgcatcagtcagatcagagtagaggcagcttgtatagttgatggcacagtttagggttagatggcacaggatagaaatgggtgctagacaaagagcagtcacagaggcatgttagaaatttccagttccagcatcattgatgaagaaaaccatgaggacccaagttgatcaaaggcagccagccaataaagctatgctcatgcgagatgagctgaagtgacattacattaaaattggaagaccctcttactaagtggctccatgcttccctgctagcccctttgggacttccaagaagacttggttatttcaagaagacaagaacccacagaggctgtagtttagtttatctctctggaaacatagagaatatgtataattaaataaaagcactttaatagtgaatcctttacagtgttatttgaaatttatgtcaagtgatttaaaaagtaaaaatgaaaattaataatttcagtggaagtaaattgattaacatgaccaggaatacataaaacttgcatggtcttgtctataaaataaggatatgtcatttaattaggagagtcaaagctcattcttgcgcttaaggtctgaggaactcttctcccatggggcttatgaagggctacactgaggcaacttcctcaatatatctcagccataaaaccaagagaaagtaagaagcagaggacatcacaacaaagctcaattcagtaaaagcaattttataggagtagagggacttgtcaaaaacaaaaacaacaacaaaaaacaatgtccaaatatttattcagcttaatgagtgatgtttttgtttgatctagggttaaaatctagacaaattacagagatgaataaactacatatcctttagtctaccatcctctgaaaatgttactttttgaaactttgattttgataagagctggaggcactcagggagtcattctctggcatggtctttgagtacagagtgattttgctgattaaaagcaaatagattgacttttaaaatcaactcatacaaacaaactgttaaaatcctctaatgagagtgaagaaacctaaccaagactgactgatacattactgctccatctctgcaccaaagtggactcagggaggcctgtaggagatgccaactccttatcctactccccacaaagacagttcttggctatcttcatcagacacaaatgaatggttgaggctccaaagctctctaccaattcttgtgttacactggcacttttaaaaaattttgtttattttttatttttaaatggagtctcactctgtcaccctggctggagtacagtggcgtgatcttggctcactgcaccctttgcctcccgggtttgagcaattctccctgcctcagcctcccgagtagctgggattacaggcacccgccactacgcctggctaatttttgtattacttagtagagatggggtttcgccatgttggccaggctggtcttgaactcctgagctcaggcaatctgcccaccttggcctcccaaagtgctgggattacaggtgttagccaccgcacctggctggcacttctcttaaaactaatatctcaagaagttttttctttaagaatcttctttcaattgcaggtccatgtagttctggtattcattaaagtgcctatcccaggggttttggtatgttgtgtttcaattttcatgtttcaatttttttgatttatgcattaattttgttttttcagaattcaggtgcaggttgtttagtttccatgtatttgtgtcgttttgagaattcctcttgttcttcatttctaattttatttcattgtgacctcagaagacacttgcattgattttgattttttttatcttattgagatgtgacttacgactatgtggtcaattttagagaatgttccatgtacagatgtgaaaaatgtatattttgtgttgttgggtggaatattctgcagatgtctgtcaggtccatttggtcaagagtctgatttaagtccagtgtatacctttgttagttttctgccatggtgatctgtctggtgctgtgagtggggtgttgaagtcccccactattattgtatagctttttttccccataggtctagtagtatttgttttatgaacctgggtgctccaacattgagtgcatatttatttaggatagttaaatcttctggttgaattgaaccctttatataatgccctcctttgtctctttttgatgttgttggtttaatgtctgtttcttctcatacaagtatagcaacatctgttcttttttaattttctatttgcatgctagatctttctccatcccttcactttgagcccatggttgtcattacatgtgagatgggtctcttgaattcagcagaaggttaggtcatttaaaaaatctaatttgccactttatgtcctttaagtggagcatttaggccatttatgttctaagttaatattgatatttgaggttttgttcctatacatttgatatttgtgtattgttaagtagttgctttctagtttgaattgtgtaattgctctataagatctctgagccttgtacttttgtgtgcttatatggtagcaagtattgttcttttgtttccatgtttagaactccttggagtatttcttgtatggcaggtgtggtggtaacaaattcccttagtgttttcttgcctgggaaagactttatttctccttcatttatgaagcttaatttggcagattatgaaattcttggctggcattttcttttttctttaaggaggctaaaagtaggcccctgatctcttcttgcttgtaaggtttctgctgagaagtcctctattagtctgattggatttcctttataggtaatttggcccttttctctagatgcctttcatattttttctttggtgttgaccttgcatagtctgatggactatattccttggggatggtcatcttgtatcttgcaggtgttttctgaatttcttgtatctggatgttaacctctctggcaagattagggaaattttcctgaattattgcctcaaatatgttttccaatttgcttacttcttcctcttctccatcaagaatgccagtaagtcataggtttggttgctttacataatcccatatttatcaaaggctttgttcatttttcagattctttatgtttgtctaactgggttaatttgaaaaggtggtcttcaagctctgaaatcttgtcttctgcttggtgtagtctgttgttaaaacttccaagtgttgttttgttttgttttgttttgttttgagatggagtctcactctgttgcctaggctggagtgcagtggcatgatcttgactcactgcaacctctgcctcctgggttcaagcgattctcctgcctcaccttctggagtagctgggattacgggcgagtgccaccacccccgactaatttttgtattttttagtagagacaaggttttgccatgttggctgagctggtctcgaactcctgaactcaggtgatttacccatcttggcctcccaaagtgctgtgattacaggtgtgagccaccatgcctggcctgcttccaagtgtattttgatgttccctttagtgaatttttcaattccaaaagttctatttggttttatcttaatatggctatctcatgtttcatatcctgcattgtgtttctggtttatttgaaatggattttaaatttctcttggctctcactgagtttccttgcaatacatattttgtttttttagtctgtcatttcaaagttttcaacttggttaggatccattgctatagagctagtgcaattctttggaggtatgaagacactctttttgtagtgttggagttcttgggcagattccttcttatctgagggagctgttgattcttatttttgaatttcctattggttgggcgggacttaaactttttttttttttccccttgagggtatgactatggtgtatgttgtgtgtgatcattcaactttgtttctgggtgctttcagggggccaaggctctttatggattccttgggcgtggtagctttcttaaatgctgcttattgtagcaatgtattggatttgtgagctgacactctatctcatgtggggctgagggtgcagaagtctcaggaagcttattttgtggagtagtgctaagcctttctggtagtgggctttttatttgatagtacagttcaggctgcaatccagtagatggcacttaaaaaataagaaccagcttgccctcagttaggctgatgtccagtagaagcacctgtcctgacaggggagtgacaggaagagattctgttggtgtgtgccgaggcctttggggtcgctggttggggggagatagggggaggtgcactagctcctcatgcaggaatgtgatctgcttttctatcataccccatcagagggctcatgaccttcagttcataaagattttttccttgggttcccagccatagtctgtctgtaggttatgcatatgcccctctgaaggcaaccaccaaaatggtcttggggcagagcctcttcccccagtctagggcagacaactccatgacttgtatgtcctccattgctgggacactgctgctctgtgtagggatggggagttgggccccaccctttatgtaagcctaagtggcattctcactttcagcaggggtggagccatcttgaaaaccatgaaaaactctttcttcgagtacctgtgctggcccccagtgggaagaaccactgctgcgtcttcaacagcgtgtggggtgggagggtattgccacagatgaccccctctccatatccgttccttgacatggtgttgccccctttagcgattggcactgtgcccacctttcctttgtcccaaaggggttttggcaagttgtgtccctctcccttataggtggcctacactaggggggttagatctctagaggttccatagctccctgggaacttgctggccccctgggcttttcaaagtcagaacaggttatgaggtatgtttgctggggatctggtgctacagagactcaagggtagagaatccctgggcagagcagaggcccaccactggtgcacaagcaatatggtgaccaccatctcagtttgtgtctgaggggagtatgggaacccctgcaggagctggccacccagttctctatccctgggaaattcctaaattaccaccaataacattgccctgggtcacaagggtggggccttgaattctttgggggttgatctctgccagactctagctacttttcctttctgcaccccagcttcttcccatgggcactccaaaaggtcctggctctctttccccagttttccattagaaacttgtccatttgacagtaactttgatcttctttctaagaagagctggcatccaaggtctgtggtcagctatgttggaaaaaagaaggagaaaaaaactagtttgtattaaattctgaaagactagtggcactggttaagtctttaaaggattgttaacaaaagaaaatctttttaaaccaaactcctaattttatcagaattgtaactgaaaatataaatgtatgaaaacataggtattatgtaaaatttgctcaataaaagaataggaaaaactactatttatcttggactgatagcatgttagtttgagatttgaaccctttctactctagtaagtagtggtgggaaaaattcactgtaggagtctgcagacataacaaactatcattagactgccaagacctccacataataaagcaagcagagaatgtcaaataagtatgtgaaaaatgatcaaaaaagagaaattgaaaatataaatagggtgctattaaaaaaggatagcatttatgttatgacatatgtacacatgaatatcactttttagaatttcatccttcttaggacttattcctgagtccgaggattgagaggttctgataaaataagtctcagtgggttccaggcatgggctttctttaaaagtctctccagggattctaatgtgttgccaggaccaagtaccatggacagccaagatctcatcagcacagtttgattgaatgaacttatgtagaaccctgaatgccacacttaaccaaagaaacctttccagggattaattataggtgacagaacatgctatattcttattaaatattattaaaagttaagcaatacccattcctgattcatgtaaaattctcacttattttccaagagttttactgtatgactggtttatgggatgcttggaaaaggttgacagacatggcaaaggttcctgcagtgtttctctttgtccatcaacagccctagctcataacctctaccctttcagctaaaagcaattagctcttcagaagtgattcattctatttatacttgggataagtaacatcaggcagtcttccctagggcttctcacgggccctggtggcatttttattctaagagagggttatatttttacatgtaattggtcataattatactaaaaacaagtaattggtgtcttatacaagaaaattatatttctgctttagtcattgacagagtatcctgagaataagagttaagaagtatattcattgtcatcttatttctgatatatttcaaattcttttgctaggaagaagcccttttgactgtgctttgtgtaacaaaacttcttcggagaaacaatttagataaactttgtcagatcttatgtgattatattcaaaatgctaattgaagattctctaaacattttcagtaaaatgttgaattgttttcatgctgttaaataagttaacatgtcttcctttactaaagtcattattataaaaatgtaaatcctaatgataatagctgatgtttattaagcatttagtaggttccattttttgatagcaacttttatgaattatctcattaaatcttcataataatagcatcaagaactacaaatatgttttcatgtaagaagggaaataaaattatgagttttgctgtgaggtttgaagaatgaaaacaatgcatgacttagaaaatagtataattaagtgaattttattatcattatcatctcttagtttataaatgaaaaaactaaggcttacataatgtaaaaatcagttaacaaggttaaacaaccggtagatggtagaggaggagctgggaataaatctgtacatgtctgaatctggagcaggaacccttaactgatgtgtcattctagcaggtcatcagttactctacaatacctattaagtatactttatttactgtgtttagatttatagtagatttagactctactgtaaaaacaaggacttcatacacctgctagaaagtatccatatcatcttgtttgaaagttgtcccgctctagtgttcttttctaatcatgatgattcagaactccaaactcttgaagcagggcaacccgtagggtcagcattcataatttctcaatacttaaaaaagtttcctcatgactgttgctattattgagatttctcaaatgtcttggcctgaattgggtgtgcactatgaaaaaaaaaatggcagacatttctttttgttaaaggaattttaaaaacacatataaacacactgatttgtgacagattaccaggctttatgtttagcagggtttcctaagcaaaacacaaattctgtaaatctacagaattagataaaacattgactcaatccttagatgagagtataatggattatcacttaataacttctgtcactgaaaataaatgatgtaaaaagtaataaagttctactctcacagtatgaataaataggaaatacataatactttaaattaggcaacaaatcattaagcccccagcattcattagactatcattaatgataataaaattgtgtggtatttatacagatattatatgtaactccaggaattttgttataattgtgtatgaatatatttgttgtttgaggcaggtagatggatatttgcagcagctatgtgctgaagcattctggtaatagttttcaaatcaaccatttttttctccttgtcgatcatctttaaagcaaaagcaccgttttttactatattttttgaaaaaaatacattaggtgtaaaattatatattttgaagaagttcactttctgtttttactagtttcacacctttgttattttttcagtggaaggagcagagataggcaaaggcgaagcctgtgtgtgtggtcaggttcctgggcccttcatagcatctgatgccaagctgtgttctcttttgtgtcattgccttcccacttgctaattacgtgacagagctagggacttccctctgtctagaatgccccccatctcttgtttgcctagtgaaatctggtttgaagttcaaggtctgatacaaaccaggtgatcctctgcaaaactaactgtacctgagcaaaccaggcacttactcttttatatgttcctggcactgctgatactctgatagaaaacatcatcacttaatgctaactgtgggctcacaaaggggatacttctactgtaagaagactgtaactcttcttagcacagagattagtaagtacttgaaacagagtttcacatataataagtgttcaataaattttattttttatttctaacacttggcacactgcatagctcagtaaatgttggtgaagtgaactgagtattctccttatctattatgtggtaggcattattctagttgcttctgttataaaccaactcatttaatccttatcacagcacttttattgtggtcaatattttttaatcctcacagatggctaaggaatcagcactctgagagattggttgacttgctttgggtaaggtgcttataaagtggtagaacaagattcctatccaggccttctgattcaaaaatacattctttttttttttttttttagtagtgttttctggaaaggcagggtataactgactatgctgtgtatttgggactaagtatattattgtcaagtatattaaaaatgtcgcaacactggaaaggagtccatcaatgggctatgcaggttgagggatttgtagatgagaaactgataaatttggttagcaaggaaagccatcaagctgtgaaccctttatattggcaaaagagagggtcctttgaaatctaagggaacagaactttcctgttctccaagtttggagcagaataggtaagctctaggcagtctaatgcccaacttttaccagtggtgttttagttttttttttttttccaaaaggaaatgatggaattctttatatacttctgaattgtctatcttttcaaaaataaaaattttcattttgcagtacatacagaatcaaaagactttcaagtcctaactccacaaatgtttattttgaagctctttaaactgtttaccacggatattagtaaatctgtcagaaatgaggtgacttacttatccttgtcccaccagatatgtgggaaggatgatcacgctagatagcatggatgggtcctctatttatctctttttacttgaatggaaaacacatcattcagattaatcaattagtcattgtgactgatagaatttttatatggataatctgggtttggtccctagctttaccacttacttggggtctttatgtcttctatggtctcctatctgtaaagggaagttgataatgccaatctagctaggttactgagatgcttaaatgtgtaatgtatgcaaagcagcaggtactcaataaagggtaactcttactattattgtatagctctccaggtatgtattgagcttctatagaatccatagccccaaactctttagccctttgagaccaagattaagcattgtctttccagaggagagggtgagagagattgccattatactaatagaattcatcattatcaccgtcatcatcatcatcatgatttcttggtgtgtcatggaatgtactgtgtttcacattaccaacagatgttaattttcacaacatccctgagacaagaaactatgattacattttacagataaggtcatgcagctataaagttgtgaaattgggattcaaactcaggcagtctgtccccacagtccatgttcttaacccaccatgctctcctgacacttgaaaagttaggaggcgtactccatagcctgtaatgttgctgcagagagaatctaattttaaatccagtgaagcatattagttgctgtctttgatatgccattcagattgtgctatccttatgatgcctaccttggttgtatatgtaactgggcgtcaaatatataaatactcaaaaagtgataggtgccaataaaatattttatagttaatacttatgtaatctgtgttctctgtgtttgagggctggttctaaaatactgctctatatttgacttctggttaaaacaataaactttgctcatattagttatatagttgataccattctcatgttgctaacatgtctgtaagtaacagttgaaattgatctggcaattttagagctgtcagacccaggagatgagagaaacatttaaaatgtttataacattaaatcagctgagtcaagagagagaaagagaaagatgattcagatttcttgtactggtggatgtaagtgcttggaactgaaataaaggagaaggtgtagggagggagaaagataaagaagtcttccctttatacaagttgaaattgagttttctttgagatatagaggtgaagacattttaagaaacttcttaaaactctctaatgtggcttttcaacctgtttccatcaatttggcacatctcacttttcggcacaacagaatattctaggtttatctcacaccttccttgccccagcccaggaatcagccatttctctaagaaactcttgtttattttggtggggaacagtattgggaaaccaacatctgggagctaaatatactcctagtggttaggaggtcataccttgtagactcttgtagctgacggagttaggacatatttattagaaatcataagtttatattgatcttgctaggatctatccaatcctacaagattcttccctgtgtctctcctttgtatttgtgtatcctttcttccatattaagaactgtggctcccaacaacaaggcatgtgcccatttgcccaatcgtatgatgtataaaaactactttgagaaaagtggcagccaaaccactaagaaaaataaacttgctgaaatgagttcaagatttattggcagctctttttttggcccctagactgaaagtatatatttcaagtattgtgttcaaaaattatttgggttagctttttccacctttcataatagtaatattatttacttgaaatacagttggctttgtttctatattcagtttttttctctctatcttcattaatttcattatatatatttaatatgtaggacattaacatgtttccaaaagaagaaaacactccttcctgtatcatttccacctcatctctcttaccccttataggtaaccaattgcactggtttctagtttatcttacttatattcctatttgaaaagttacctcatatatgtatgttttttaaatttttatacttttttacacagaaagtaacgttcagtatgtactttgccactttccttttaaacttaacagcgtatactggaaatcactccatatcgtgtcacagagagcttccttatattttttaatagctgtataagacttcattgtgttgtctgtaccatattttattcacttccccatgtgtggacattttgactgtttctagtatctgcaattactaataatgctgcagtaaactttgtgcatatcgtaccttggtaaatttctagacatagatttctgggttaaaggttaagcacatgtgtagttttgttagatattgataaattcctttccatggggtttatatcatttttaaaatatttaccagcaacgtataacagcgtccattacttcaaagcctcaccaacagattgtatgttttaagtacttttatgttttagaatttttccaatgcgataggtaaacaatggtatatcaatatagttttaatacattaaagttcagcatcttttcaagttcggctagtctcagggctattcttaatatcttgtgaattatcttcatattattttcccatattccataatacttttggttttttttcctcctcaattctgacaagttctttatatttcaggaatattagccattttatttgatatgttacaaatatttttctcccaatatataacttttctcttataacgatttttttttcatgaaaagtttttaattaaaaccttttatgggcccaggtgcagtggctcacacctgtaattccagcactttggaaggctgaggtgggcagctcatttaaggccaggagttccagaccagcctgaccaacacagtgaaaccctgtctctactaaaaatagaagaacattagctgggcttggtggcacatgcttgtgatcccagctactcaggaggctgaggcatgagaatcacttgaacccagcaggtggaggttgcagtgagtcaagatcgtgccactgcactccagagtgggcaacagagtgagactctgtctcaaaattaaataaatatataaacaaaaccattatgggccaggtgcagtggctcattcctgtaatctcagcactatgggaggtcaaggtggttgaatcatttgcgccaaggaactggacagaccagcctgggcaacatgggaaaaacctctctctaccaaaaaagaaaaaaaaaaaaattagctgggtgtggtagcatgcaccagtagtcccagttactcgggctggtcacatgagcctggggaggtcaaggctgcagtgagcagtgattgtgccattgcactccagcctaggcaacagagtgagaccatttctctaaatacatacatacatacataccttttgtggagttaaatttacacactttttctttattggctctggcttttgcattgtagtaagactttctttacactcaacttatagataaattcacccatgttttcttctagtacttgcatagttgaattttagatctctagtccatttggagtttattttttgtatggtagaaggtattgatcctattttttcccaaatagttgttacccagttgtcccaaaacaagttattgaaaagtccatctttgtcccagatagactggaacaaaatgaattaaagacttaaatatgaagatttttacttgtgtatcctttcttcctagaaagaaaacataggcgtaaagcttcatgacgttgaatacttcatgccattggtctggcaataatattactattatgaaaggtggaaaaagctaacccaagtaacttttgaacacagtacttgaaatatatactttcagtctaggggccaaaaaaagagctgccaataaatcttgaactcatttcagcaagtttacttttcttagtggtttggctgccacttttctgaaagtagtttttatacatcatacaattgggcaaatgggcagatgccttgttgttgggagccacagttcttaatatggtagaaaggatacaccaatagaaatatttatatttaagtctggcaatcatttttaagatgtgaacttgaacaggcaacaaaagcaaaaataggtacgttggattacatcaaacccaaaagctcttcacagcaaagggaacagtcagttgagtgaagagacaacctatggaatgggagaaaatatttctaagccacacatctgacagagggttaatatccaaggtatataaagaactgcaacaactcaatagcaagaaaacaaataacatgaataaaaaatgagcaaaggatctgaatagacatttctcgaaagaagacataccaatggacaacatgaaaaaatactcagcatcactaacaatcagggaaatgcaaattaaaaccacagtgagatatcgcctcacacttgttagaatggctgttatcagaaagataaaagataagtattggtggggtgtggagaaaaaggaactctagcccactgttagtgacagtgtaaattagtatagctgtgatggaaaagagaatggaggttcctcaaacagtttaaagtagaactaccatatgatccagcaattccacgactgggaatatatccaaaggaaatcagtatattgaagagaactgtattttagtgattattgcagcattgttcccaatagccaagataagggatcaatctgagtatctatcaatggacaagtgataaagaaaatatggtgtgtatacacaatgggataccattcagcctttgaagagaaggaaatcctgtcatttgccacaacgtggttgaacctggaggacattagctgagtgtaataagccagccaccaaaagaaaaataccacatgatctttcctatatgtggaattttaaaagttgaactcaaggaagtagaatagaatggtagtgaccaggggtatgcgataggctgagggatcaaggagatgttggtcacgggatacaggatttcagttagataggaggaagaagttcaagaggtctattgtataccatggtgagtatagttaattataaagtatacttgaaaattgttaagagtagattttctgttcataccacaaaatgataagtatgtgagataatgcatatgtaaattggctcaatttagccatttcacaatgtatatatatttcaaaacaacatgatgtacatgataaatatacagtttatttttaattaaaaattttaaactctctaattggtcttcaacatatagtacacaagtcttttcacgactctttataatggaacatatgttcttggaatgctaaaaattattttttttggaggccctgcaaataactaaaaatttatcttaaaagccacacctaattacttacatatgatccagaaaggatactttgaaaaagctttttaattgataaaatcattaaggtaaaacatattcataaaagtgttctctaataattttataattttctagttcatgaaggattaaatatacaactatcatttgaattggattttttatgaggttaattgtatttaaatgctaattattttaactaattttgtggttgacttctatgtagagtagggaaaaagaatttcctaaagccagttacgtatatctctttttagtctggatttttaattaggaaaagtgatatagttaaataggtctactctatagcatcttctaaaatgagtaaaaattcattatatcaggataaaaaatgataaagatatatggatgacacatttggctgaatttttcttcttcgctgttctcttgctctctatttaaatagtcttagctcttttatcatttaaattctgaagtattgaggtgattattccggcagcaggtgattctgctaattactgttcagtcagttttagctattagaaacagagatatgtttacattgctgggctgcatgtaaatttagaagttacatggctttgtttttactttgacttacggcattaaaattattttcatctgtgtatgtaaagatctgcatctataagcttttgtggataataaggtgaaattgatgcattttaatataaattgccaatataaaatatctctaactcagacctctactggaaagttgtcaaatcttatgtaggaaaggcttttaccatcactgttacacattaactgggcatagtttaatattaatagctcctgagacttgtggttaactgaggtttctatttcctgtgtttgggttttatctttgcaacaacttggttgcttttctgtgtaaaatagtggtgaatatacacaagagtatgacaaggttctgggctcttaactttgatgaacaccatgccatttccatcatgctgcactcaaaacagcacagatgtgagtctgggagtggcgtccctgccgctctcatgagcctttgtttggagaacaccctgattaacccccacccttcacggttcattgactcactgatagatcaagtttaaactagtatatattagcacatttgttaccaacagaggaacagttggccattctgttttacattgctggttcattgcaaactggcgtgctaaaaaggtctgtactctagagtatgaattgggaagttaccaaaggactgagaaccaagtcagttgcatattaatgttgaattatacctatattttaatcttggattgtctacttgggggatgcttacactgttgtcaagttatgaataagtgataattaccactttgaaattcatctttttttttcaaggagtttaggggatttaggtgtctcaatatagctttcatattaaacagtttgtcataattggatgagagcagagcaaggtcatgactacctgatgccttgtgttggagcattttaaaaatgttttccagagagttatttgtacctaatgactttacataagtccttacattatactttatttctaggtcacctaaaaatgttaattgtttagtcaagagggttaggatgtgtgtctgttttctcatgaaaaaaattaagctgttccctttttatcaattttcttgcaatctaaaggcttttttttcttaccttcctaacctagtgactaaggtcatcttattgttacagttcctttcatgggagataggtttactgcatcatttggcagtttcatagggtgaattttgtcttggcttcatctttccttactggttgtcatcccctgggccacctgcttttttgcattttcctttctcttgtgagatgatgaagctctgtgccccgatggggatgagagacagcactctgagttcaagtctaggataaggcaatgggcttgcttttcaaaacaaactagtgtcatacgggctgctgctttcaggtccactgtctgattttatcactgatgacttgtttctggaaggcaaactgatttaagttctgagcaaaagggtcggtgtttattttcaatgctactattaatttagagttttaatttagaaaagattttttaccagttctcaaatatgatttttctattgactttaagtttgtagatataaggagtagacatgagatagagactgaattgcttttttgtttttaaaacttggcagtaataaggggttgcttgttttttcatgctaaatattttttctaagggatctagatacctatcagaaaacttaactttgataactctggttctttattaagtatttttgtcttattttaggaattaatagaaatagttgtaattttagacttcctttataaaataccaatttaaagagaagctttttgcttaaatgattgttttgcagtgttgtgcttttgttttctttaatgcagttgaaatcgcagctttataacttattttttaatttggggtttttaaaagaatattagttatttatttatatttattgggcacctactgtgtgccagacactattctaggaactagtaaacatagcagagagcagaatcatgaagttcttgacctcaaggagcttaaatcctagtggtagagggggaattcaaaaaaatcaaataaatgtatttctattatgtcaagtgatggtatgtactaccaggcaatcagatgaaaatatttcctcttctatacacagtgggcaaggaaggcttcattgactgtggagttttagaagaaagctgaaagtaatggggaaagagagccatatcgatatatgaaggaaaacatggtccaagcagaggaaacgaaaagtgcaaagaattgagcaagaaagtcatgttcaagtggagtcagcaggggaaagagtaggtcacaaatgcggctgagggtgggtcatgaagggccttacaagctttgtatgagtttttacttttattctgaaaaaaacaaaaacaaaaacaaaaaaaaccggggagctatttggggattttaatagaaaagtaacataatttccttttaaaatggatatgtggccactaagtggagagagtggtgtatatatgagtggatggaataattgatacaggcaagcaggagacaggttaaatgaaaaatggattaatccaggcaaaagatggtgacttaaattaagctgggagtgggagagatggtgagacatgcttagactttggattcatttttccagatagaactggctgacagagacatgtcatttaccaacatagacatggcagattttttttttcttttctgagacaaggtcttgctctgttgtccaggctggagtgcaatggtgtgaccatagctcatggaagcctcagactcttgatatcaagtgatcctcccacctcaacctccctagtagttgagattacaggcatatgccactgtatccagccaactttttttttttctgtagagacaatatctctctgtgttgcctagggtagcctttaactcctggcctcaagcattcctcctacctcagcctctcaaagtgctgggattataggagtgagccaccatgcctggccaatatggcggttattaagaggataagtcaaagattacatgaatattctgttatgaaaagtgtcaaacatatagaaaatataaacagtattccagtgggcacccatatttttatcaccttgattctacagatcttaacatttttctgtatctgcttcaaacattttattctgccaatgtgttctaaagtaaattgttgatattgtgatagttctctccaaaatgctgcagtgtgtagctctaaaaatagatatttttcagataaccaaatatcattaacctgccaaatcaatgaatgataattgcttattaacatttaatacttggtccatagtcaaattctccatattttccataatgtcttttatagttaacttttaccaactagtgtctgatcaagaatcattcatttaactaattacatttaaactgtaacattacaacatgttttttcgtatgttttattctctctgacattgacttatggaagagactagattatttgtcctgtagacattttatcatacataagagttactaggagagctctgattactagtccccactctcagaaattttgattcagttgctctttccagtgagctgctggtgatgctggactttcattctgaagaccatactttgagcactactgctgtaccactatccgatggcttctttgtgatatcgtttaacttgttgttctgttgcctgtatttcctctaaactgaattttcaatctaaaggcttactgagattcatgtttgatactttgggcaagaatacttcataagttctagtgcttaatgttaggtagcacttaattctgactatttcactattcatgaggctaagctaaggaggtgacagcctgatccttctattgtaatgtttcatgtgaaactactagataatttgttgagttggggggtgggtagggaagagatatctagttttcaataaatatttcacctaatggttttaacacacattgatcatccttgcctgaactaattatttaattagggatggcaacatggagactttctaattcaatctttttttttttttctaaatgaatggccttgtttttatttttaaatggatgttacttcgcaactggggttatttgattacccagaaatatagcgcatattaaaaaggtaggataaatgcttagttaactaattaagcaatttttaattaccagttttcacagtaaggcactaaagtttctgacttgagcaaagataaagtggaaagataaagtggtcgtttagtgagatgggcaagactgtggataggtagactaggtttggtgggaaagtcagaatatcagttttgaatatgttaagtttgagatgtctattagaaacatatgttgacgaggccaggtgcaatggctcatgcctgtaatctcagtactttaggaggctgaggtgggcggatcacctgaagtcaggagttcaagacgagcctggccaacatgtgaaaccctgtgtttactaaaaatacaaaaattagctgggcttggtggcatgcacctgtaatcccagtaatcccagctacttgggaggctgaggcgggagaatcacttgaacccagggggcggaggttggagtgagccaagatcccgccagccactgcacttcagcctgggtgacagagcgagactccatctcaaaaaaaaaaaacatatatatatatatatatatgttgacaatatttcagttgaataaaataaaatattctagctattttaggtagaaaggcattttataccgatactactactaaagggtaagaagatatgactgtagtacattaaatatgctgatggcctacaactgttgctgtgttgctttttcctcttcaccacacatatgcagcctcatgaaacattttccatgaccagcacactgaaggaaataaaaggaacctagtttagagatggttctgcatgatacaacaaaaatgagctgctaaagcattacaatcccactcaagagtattcccccatcaaatagtggggctggtattttaatcagttgatactaattgtcaaggtgtgatggccaagggattgatgtttatcagtgtatggacagtggttcagagtttggtgaattagtcgagttgaaagagaaagattggtgacaaagatgtatgaggtggaaagtatactttcacagaataagaacagaaaatgagatttatgtttttttgtaaacgttcaacaaagaaaattcattcagaggaggaaataggtaggcaagatgccctattctacagatgttagtcagcatcactgcaaagcaacctcagggcttatgcagtggacacttaaaatagcactggtgcagggatgggagaaataaatggatttaataagcactgctgcttaccaaggttgattgaattgccactattgccaagtgttctacctgcaaacagatcaaccttgagccctggatatggcaccatgtcccagagcaaccagccagccacctggtggcaggttgattgcattggatttgctccattatggaaggtcagtggtttgtcactgctgcgatgaatgcttactgtacgtttggatttgcattccctgcccaccatgtttctgtcagcaataacatggccttattaaagccttattcaataatatgacatcctatataatattgcttttgatcaggagactcattcacatcaaaataagtgaggcaattggctgtcaactacaggattcactggtcttaccatgttcctgttgtagcatattgtattctacctggaagatgaaaccttgtgacattaaagtagtttttagttccataaacataatacaggggtctatgaatcaagaagtggaggtagaagtgttgtcttttacttcacatctaatcacatgttcaaaatattttttcatcttgcctctgcaactttgaactttgctgacacactgaggttttagtgtgaggaaacaatactttcacatgggaacatgatagtcgttcaattgaactggacatttagaataacctggccacattactgaactgtataactgaaacaacaaatgaaaaaaatgaagatgctacgctggcaaagatgattaattttgattattgggagaaatagtattgctactgttaggaggaagactatatgtctagaaactaggaggaaacctgggttgcctccttgtagcagggtaaaatgagtgagtaccttgtctaagaaagggaacatgaccaaactgaacccagaagacataggaaatctaaacagatcaattaacaccaaagaaacgggcattttttggtacttctaaaaaagtaccagactgatattttcacagagatgttcgttatacccttaaggaacaggaacagaaaacttctatactatttaaactattttagaggatagaaaaggaaagaaaactccagattttatttatagaacttgcatgaaattgataccaaattctgacaatgcaagttcaaaaaggaaaactagagatcagtgttacttatgtcaaacagctcttaatagaatagatggatatggttatcaacatgataaatatgtttatcacattttaaagcctacatggagaaacatttgaggttttcttattctagaactgacaggaatgtcctttattatgagcactattagtcaaatttttctggtggaactaatgtaagtagactgctgaagaaaatgaatggtatgaacattggaaaggggaaattaaatgattattatttacagataaaataattgttaagctggaaaatccaagtgaataaagggaaggcctacaattaagcagttaaggaaagggctaggtatagaaatcaatagttttgatatatgcaggctatagccagttaggagatcagttaggggaaaaacacgttgacagcagcaacgaaaagctgataaacctagaattgttcaccacttatcttaaaatgtttaacatggtactgagggacacaggagattatttatgtggaaaaacataccatgtttctatacagaaaaattgaacatcacaaaagtattatttgatcttaagataatttatatttaatgcaatctcagtgaaataccaggagaatgtttttaagctagacaaacttatttcaaagatcatatgtaaaaataagcaaaaatagatgtgaaaaattctttaaagtaatgagagaccagtcttattgactattaagtcattataaaactataatgtttaaaagatggtactgacatatgaatagatcagtggatctcagatgggcagtgcagaaagagatccaaacacatacaaaaatttagtacctctaaaggtggcatttaaaatctgtggggaaagatggattttccaatgaataatgttgggataggtagatagccatctggaaaaaatgaaagtcaaatcccaactttttaccttttatcaaaatgaacttcagatacaattgaaaatataaaattgagaccataaaagtattagaagaaaaatgcagtttttaagtctcaaaaggggactcttaaatatcatacaaagcccagaggccataaaagagatgattgataaattcaaatataggtccgtgtaagcgaaaactttcagtatggagaaaacataagttattaaggcaaatgacacactaggaaaagcatttgtaactcataacaagcctagttttcttactgtgtaaagtactgccataattgacaaagaaaatatgaagaattggcaagtgacatacatagaaagttcatggaaaaaataactcttaaacatttacaaaattttacaacctctcatgaaaagagaaatggaaattgaaattagagtcacatacagtatttcacttttcatttgtcaaagatcaaaaagtttgaacatactgtgggtttatgtttataaggatgtaagaaaacaggcaatctaaattccttgtagagtgtaaattggtagtaataagagaaaaatttactgaatactttgtgccaggtgcttttctaagcactttacatttaattatctcaattaacttatccagaaagtaccattatttctgtattacacgtgaggaatttgaagaaaagttagacaagtaattcaaagtcacacagttaataaatgacagagtgaagatttgagaccatttcctttttctcaagtgtccacttttggtcgcaactctgctgtttctgtagtgagtgatttaacactatatgataaaaccttaagagtacgtactctttgatccagtgattctacttccagaagtttgtccattttgcatcaaatagatggagaatagcattcattgcattgttatttgcagtaaaggaagattggaaacaacctgaacatttatcctcaaggactcatccatacaaaagaattgaagtaaattcatccagatgaatatgaggcagctttagatagagtgagatggcatcctatgtagtgatatggagtcatctttaaaatacagtaaaaggaaaaagcaagatacagaatagcatgtagggaagctgctgtctatgtgaaaagctgtagaatatacgtgcatttttgtatatgcatagaatattcctagacaaggacaaacatggtggttcatacctgtaatcctagcactttgggagactgaggcaggtgattcacttgactccaagttcaggatgagcctggccaacatggcaaaaccccatctctagaaaaaatataaaaattagctgggtctggtggtgtatgcctgtggtcccagctacttgggaggctgaggcaagaggattgcttgagcctgggaggcaaaggttgtagtgagccaagatcatgccactgcactccagcttgggtgacagagcaagacaccattcatctctctatctcttttctctctctctctttctctgtctacacacatacacatacccccccacacacatatatatacacacatatatgtgtgtgtgtatatatatgtgtgtatatatatacgtgtgtgtatatatatgcgtgtatatagatacatttctagaaggattctcaaagtgatatcagtgattgttgtgcaagaaggaaactagatatcagtgaatgcgctaaataaggtgattttgaattctgtagcatgtgtatgatttacctatagagaaagcagtctagcatgagcgtgggtttctcaaatatagaatgtttgcagtgaggtcacttggtgaaaagtatagccatgtcagacagatgtaggttcagattccaggacttccaggactgctgaaagggaaaggggctttggatctccttcagctccaggcagcattgctcctttcccagctttgacattagctggagggaagacaagttcttagagctctatgtgcttgggacaagaccccttccccctactgccttactcgccaaccataactgctgcaaacaattcttacctcttccaccccatgtcactgcctaaaacccttcatcacctggcctcccatgcctctaagtctctgtacatcccctagcctgatactgtccccaaccctcctcaactccagacaccattttactctaccctctggaattgtccattattagcaaaatctcctttattttcaacctcctttctaagtatttcccccacattcttgttgtaatagagacacagctttcccaggactgtatagctttccttgcagtcctctaaagtggtaactggtttctctgccatacatttcataccactggtcctggagatattgtcaatatcttaatgtcttccttccatctcacttaaattttgagaccataattcctttttcctctcttaaaagttctcagtgttgaagctcaatccattagatacctctagctggcactactagttgcagtcctgtgcagactactgagtcattttctttactccctgaagacttaaactctatcttactctcactctctctgacattactcctattaaaatgttatgtttctttagctattctttcagtttttggtctcctctccttcaacgaggatgatttctagaatgttggttctcaaaatgtggcccctttgcagacatcgtcagcacctgggaacctgttataaatatgaatctgcagaccacaccccagactactaagcccaaaattctgggggctggagcccagaatctatgttttaagaagcacgtcaggtaattctgatgaatatgccagttccttagatcttgttattgtcattactgacaactttctctgagaccacaatttgaatctaccaatttttcactagtactcacccatcttaagtccttactttccccttaccagccagacatttgaatattccttgactcttctctttcacatactatatccaaagagtcaacaaatgctgtcagctataccttcaaaatacatgtagaatctaacttttaacctccactgcagtcacttcagtccaagcacaaccatttcccacctggagtattgcaactgttcttgtttggtggcccttggccctactttatctactttccgcaaagcagccagagtgtttctttcaacacctaaggttatatggcttcattgattgaaattcaccgtgcttcacctctttctctacaaaagccaaagtccttgtaaatgcctgtaaggctcgagggtgatctgaccttccctggcctgtcgtgtttcggtaaaagtaagctgagtctttcatagttaaaggacagcaatattgtcctgcatgatattttaaaaacccaatcaagaatcacacattgcatttaattttcatgcctttagtctccattaaaagtgtgccctttgtattaataattggagtgatgagggacagagtttaagaatatataaatattttgtccccaactgactgtcactggatggctttggcacccattggtgattcttacctgaatcagtaattattgtgatgactgaaaatagtgatttttctcactgtataattcttctatatttattaattaccttaatattatcctatagaacagaatgttcccttctcatcttttgtttgtttagtgtcagtattactcatgaagttgggtgtttagaaaattcaatgttgtataatactgttattattcaatattgtattttctcagtttgagtcttccatctgcgtcctttcatgtaaatagtataaagatcagtaatagaggaacatagagtaaagtgtgagcagagaagccttactctgagacaaacttcagagaggtgaactctgttgctgattaagaaaggcttcactgaggaagtgttgtttgaagtgagctttgaaaagtcataaaattttgacaaaagtggggatggggtggagcttaaaggaaaaactgtctgaacaaaggaaggcccggcagactaggaatttggcaataatacagtggttttggaccttgatgaggaagttgaaatggaacataaaaaccctctgcatttagctccatttatttgctcaggcagctctcactgcctaaaattttcacccctgctgttttgctcaggggtgggatgaggggtaatgagggaggaaattttagggggtgaaaacagcacaagccaaaaaccctgctcagatactcccttctcttgaagccttttccagatccctaataagaattaaccaccctctctcacacactctgttgtactttgtccttctctgttaaccagcctctgtgttttgtgctgtctgtatttgtggatacatcttcctcctttaaagcacgaatcatatcttaatcccttggcccttcttcccagtacttagcacaagtgctcaatacatgtttctttaacgcgtgtaacagaggaaggcgaggagagtgagtgggattgggagcaggaggattctgaatgtcattttaaggggtttgggctcgctcttcaggcagcaatgagccatagccgcctttgaactgtgcagcactgaccagagctgtgatgccaaaggatgcagtggaaggggaggacagccagcatgcctgggcatggtccccaagtcagaggacatcagtgggagaagggagaaggcatggaagcaagtggctaccatcttatgaatctgagcactcattcaaaggtggcaaggaaaaaggaaggcattgagcacggttttgaggtttccagcctgggtgattggaggctgatgcaggcttcttaccaaaaagggccctaggcagtttcaccaggaatgtttaaggagtttatcatgaccctatctcttcctcgtctaaaactctccctaaaatcaaaacagtatgtcctgttgaaatactttattgtatcaaatataatgagaagtaaaatattctctctacttgatgtatgaaacactgacttcttgtagtggacaattttcacttgtctttttagtaatggtttttattaaaaatagatgttaataactgcttgtttaatctttaaacgtggccctctgagagcagcttaccgtaaaagaaacggttgtcagctttctttttgctcctcagtccctcctgccccttcctaacaacagaaaatttgctttgcacctgctccaactgggttcgaagagataagcatcttgcaagcccagaaaattgtagtatcaaatctcagccccaactgtgaggcagcactatcattgaatccctgctgagaggcgttgctttcccaattcccaaaagagttctttctcccctggccccttttcaggcttgaactctgaccgaaaccctctttttaactcccagcatgcactgcacttggtactgacactgacccatccctgcttcctctgttctgcactggactcatcagtaggtcaggcgttggtagccctggggtcactggggtgcccaattccaataatgagcacatttagctaaggagaggaaatgtacccttctatttgttacagtccattgctttttttccagaaacaaatgctaaaagaacatttgatatattgtggtttggtaaatacacatagcactgcctaatattcacaaagttgcctcttttttttgcatcttccttcataaattaaatatattgttctaactcatgatttattttaagagggatatacctatttcacagctaggaaaatgttttcaaataaagttatattcagaatactcttgcaagaatttcaaataaaaatagcaaatactatttaaatgcatataacattctaacagacttgtgtgtcattttaaagggaaagaaaaaaaatgatgacaaggactttacaactttgtctttaaaatttcttcttaggctttccaaacagaccgaagtcattaaaaatactccttaacccccaaagtcacaaaaaagaagctacccaggtttattatgagaaggttgaacctctgttgaagcttgcaggaataaaaactgatgtaacaagtaagtaattttcagaatataatttcaccatctacaaaaacatacaaaagcaaaataatctgaatttgtccttaatgcaaacttgggaaactacttgtaatatctatagcatttttacgtcttcataacctactgcagccagctcgagggttataatttaattatttttgttatttttattagaatattaatattttctctttagaattttttcagatattttttcagacttaaacaattgttagatataattacaaaggaagctgtatacttgtttacatcttcatggagatgtttgctacttacacgttaattttgcagttaggcaagaaattgattttttgctcacttatatagttgatgtctttccatggaattcttccttgggttgttttcgttctgactctgacccctggtggttaggtcaaaactaagcactgaactgctggttttattaatagatgaatttagagatgctagaagcttaaatttgttgtctaaactaagaaatgtacttaggtttgtgccaaggaaaatagaaacttgttaatgctaaacttaatagatgattagtaatatcctttttgatttttttaatttggtagtcacatttctttgtttctttgagacttattttcgtatggtggggaactgagtagaagagtcgatgctatggagaatcgcaaccttcctagctttatttctatgtggcttcgctaacagtggaaatttgcaataaattttaattgatgaaaagtattataaaataagcctactcaggggacaagcccagagtgcaattggaacttcctagtcccagttatagattcctagggaagggattcacagtgatgtggctttactcagctgtaaacaaaggagataagtttcaagatgttaataatatcattgaaacctacacctagtgatctgatggattgaggtagaagaaagttcaaaaaaaaaaaaaaagcaagttttgtaggaaggtcagcccccatgaaatgtgcctataactatagaggttcgagagaaactaccatgaaaaactcaagaggaatttttgaattaaaataaagttatagtgaagaagttaacctttatgtttgtgaccttcggcttatttagaggtgatttacaagtaaaagagaaaattcagatttatgttttctttctactgaagatttccaaagattggctgaaggaaaagtttgagatttgtattagggtgagacaattaaaagttgaataaacatattggcatactcaatgactattttgttcattgcttttacatgtgaatactacaaagcagcttaacatggatattgctatatagcattcacttcaggaatctcattgtatgcttgctctgtgttcaacatagtgcaggatgcgagatgaataagctatcatacttggatgactttctacattattagagattcaaaaaaatgcttaaaaccattataactggggtatacataaaagaactttgatgtctcagaggtgatattttgatcggaagattcaagaaaagcatttgaactaggcagtttttaagaggcagacaaaaaatgagggaaggaagtcaggctaacaggcatgtactgtaaaagttgggagggggggcggagagagagagtgtgtgtatgtgagagagtccatgtgtgttacacccatacatctggagagtttgtgccataactttgctctactttcctcagtttttacattatctgaaatcttactctatcatcataaaatagctgccagtgaatttcatcctttcttattaatatccagtgggatggggagaggtgtgcatatgtgtgcaagagagacccaacatgctttaatcctgaagatgaattaaaatttccttttttaagtttgggcacagatactgtattagcgcagtcaatctggaataatcatttatttaaccatcaagactcttcccaggggctgaggacagatccccttttcctgatgactgaaatgcctcagctgaatctggattctgttagggagaagaaagggcaaaatgacttctaggaaggctctcaacaatgtatactacaggaggtataattccaggttatggatggatccttaagctgcactcagcagtttactcatcgtgtattgatccacagttggtgtaaatttttttttatcatactgttgcaatctggtttggcaaagatgactccaccagcagaattaaaattaaaaaggaagagagaaaaagagattggagacaagaaaactgatatacaaggcctgaactaaggcagaggaaatcatctaaatgtgctttccttcttaattgtattggagacaaaactattatgttctaggatttttttctctaaatttgtaaatattactaagtaccatatttaaacataaaacaatagaatattccgtaaagcaaatttagaatttacttacatttgtgcagaatggctaattattagctgcctaacactcctcctacaggcaaatttataaaattacatcatttgcttataaaaccattttagtatgcatattggctcaatatttatgaaaaatatttcttgaataaacctgtgaatatttgaaaagttttagtcttcctgcctatcttacagtgttatttttgtagttgaaataatatatttgaaactttgtatattatactacagaaaggtggtcataatactgttagtttcagtttcaaaaattatgtcatagtaagatcgaattcgtactttatttgaaagtatatggaagagtaaagcagaaagaggacatatcttctgcatgtccagtgggacattgttttaatgtatccttgtgtgaatgggtgagtccaaatggaattggaattacaaaataaaccctatatgatgagttaattaggaaatagtgctatataaatatgaagtataatatgaagaattacagctagatatatacactataaggtactgtaattttttcataaatttattttaaaaatggatcttaccacattaataaaaacacacttctttcattttgggttgtgctgaaatcctaactacttctgaatatagatcagcatcttttgaaatatttgtgctaaagttgcatccccactctgctaccaccaccaaggtagtatcttatctaatagcatcagaaaaacttccgggagaacctggaaagaattattttttcctaattacctattcgtacacaaatcaaagaagagtatgaacgataagcccatgctggcatatgatatcatttctcttgcttctgaaacaaagcaagttttagagattgtaccattaaaggtgtgacagatattttgaggatcagagatccataggataattcatagtacaatagagtgaaaaagttaaggcagcagagaaatcagactgaaaagaactttcgaggccatatggttcaatttttctccttgtgggtggagcacaggtgtgtggcactcaactttggcttggccacctacactagaggcagagtacgttgttactggacaatactgtttgacattcttatgaatgttcagagttactgtacctttgggcagattagaaaaggcacctcctctgtgctgacttacaaaaaggtgccctttcttccagactaattcatcctttgcttataaaaccatttcagtatgcatattggctcaatatttatgaaaaaaatatttcatactttcaaaatattcatatttcaaaaatattcagcccaaggtcactagattcagcctaaagtcatttgttagattgcaaatccgtcattcccgttagccaagtacctttgtgctaggcataaactgtacaaaatgagaacttgtcagctgacattcgcctctttgtaatttttatgtactagagttaatgttatctcttgtagtaatatgaaataaatgtgccccatctattgtataggagtcattgagatatttgaagagagatatcctgtctgcccctcatctcttgttcacgataggtacttccatcgccttcagttactttttgcattaacagagctgctagaccttatcatggtcattatcattatcatactcaaagacatttatctgaaggaaaccttgatctctgccagctcagggctcttgggagtgcctagtcaccagataattttacctcctgggcagagttgtcaagaaagtggtgtttgttatcattttccccttctttctcctaaaatcacgcttctaacatggctgttaacaagcctcttcatagtgtttctctggttgtttatggctctacttgaagccttccatttcttggaaatgcctcttgcctttctaaatctcacccagcagaaagctaggccatctaatgaaactgtgtcacaaaagattccagtagcctgaggcatcactccttccaattttacctgcattttaatacaaaatctgaaaagtaaatgttcatgcatcatatctagctagagagaaagataattctgtgtaaaagattctttttgttacctcttaaataattgtgggtgtatatggccagtcctgttcccagcattcagatgtgagttaggaagttggaactttatacctggggacgatgaagactcactaatggggtatatacaaaaaagtgatatgattaaatatgtatctgaaaatggttattctggctagagtgggggagaggtttgagggagacaagataaaaggctattgtagtacaggtggagtatcccttatctgaaaggcttgggaccagaactgttacagatttaggatgtttttagcttttggaatatttgcattatacttaaccacttcagcatctctctaatttgaaaatcatggacacaggaaggggaatatcacactctggggacagttgtggggtggtgggaggggggagggatagcatcgggagatatacctaatgctagatgacgagttagtgggtgcagcgcaccagcatggcacatgtatacatatgtaactaacctgcacaatgtgcacatgtaccctaaaacttaaaagtataataaaaaaaaattaaaaaaaaaaaaaaagaaaatactccaatgagcatttactttgaacgccatgtcattgctccaaaatttttagatgttgaagcgttttggattttagatattctggttacagatacttaacttgtctacacatgaaagatatttagtgatcagatcaatcagctaatttagggaattagctgggagaaatggaggaatgctatggcataatttaaagacagaaacaactggccttggccatggagtggttctggagagtggaggaaagggacactctagaaagaagtcattttcctgtcttggggtagatgatggaacacaaaaagaacaatatatttgagagagaatatatttgaaggtatacataatggattctgttttgagcttactaactttaaagtacctacaggacaggaaagaaaatgacatttcagtatcatatcccacactagaattttatcaccaaaccaagaaatgtttccttatgtccaaatcaaatctcacctgattttatttcaggtgattttctcatcaacattgaatatcaaccttaagactttcttgtcttcctgaggaagttgcatttgcaccaaagaggggagggggaaattcccagcagtgagaattgtgttcaaagacctgtaaactgtgaaggcttcacatctcctatttagaaagagcacaggttggcaatctcataggaaaaggcaaatagatgaaagaagaggctgggttacattttttgaaattacatttatctagcaatcctttctttgtttgtttgtagggggatgatttgaatctggctgtcactgattccagggcccacaatagcctgtctaaatacatatttggtcctttctactatatttaaatagtaatccagatcactctttatccttttgcctaacattgttttgtataaccacctattacttcatattataattcattatttcattagcatatattgtctatctccagaatgcaaattcctgaggccaaagactaattcattttgttcattttgctaatatattttatagatgtagatagtcaggttcttttcattttgtttctttgttctagatctttgattttattggacttttgcaatgttacttaaaaaattgctattttcaggcaggttgcattagtgtataatcaaattccacccacaatatcaaaaaaagactattacaaattaaaaaaataaaaatagcattcaataataacacagttctaaagctcattattggatctgaaaaactttaccaatgtaagctttggtataaaagtaaggcttggtgaactgattcttagcataaatattttttcatgatattcttatttttaatgtgtatatgtaagatgttttattttgcattttaaggttgtaagtacttgctgtagttataaatgaatgatcagcacacatcttctttgataacctttcaactttattaatattaatgtttcatatgtagttttattatggctttcttctgattggaatttaatatagagaggttttattcatgtgagtgttaatggcattttgaataagctatgggagaattacaatgtaacactgctggatacagaatgattcttttagacaccaagactaataatttttaacaatatcgaaaaacattgtaggaaaagcttgaaccatgctggcaccagggacagacaagcatgaaagattaatgtaatcttgcatataatgacacacattcttacacaaaaaatccatctgcaatgtcatgtcagtcagcagaaatctttgatgggtggatacagctgggctgtctcttctggcagagctgccctggaaaatgctaaatgtggttgtgatgcttggtgccatctgcagtgtgcccgtttatcctgtcttcactggcatttacgatactgcatagggcatcagtgactgtggagacagcgatacagagtgacagattcatttcctcggagggtctgagctctggtgggcctgtgtgccaccctccttcttgggtctgggtctcttataattggtgttggctttactttgtattttcacatccaactcttcctctttttagtctaacagttccagtacacattcttctggtttgtaaatcttacactaaccttttgactaatttattcatgtaaggttgccaaaccgatttaagattgactgttcaatgccagctaatatgccttatttccaaaatactgctcctcctaagcctctgatttaaaggacatgtgtcttatttagggaatactaaacaggcaccaggacaaattgggtaaccactatgcgtgggatattcccaaatgactttatgtagttgaaacaaatatatgaccttctcttacataaagctataaaacatcaggccagtaacacttagtcctcttgcccatgattaaaatataaatattcaagaataaatgctgttttatgacttgaccatatgtttatcatattattttgccagaacaagttaaaaagtgtgatcattgtttaaaactgtcactttgtgtatgtgtgtgtgtttttttaatagtaatggaatatgaagggcacgctctgtcactgcttaaggaatgtgaactccagggatttgatgggtaggttatattattaatcaatatatgttatatcatttatgtattaaatgccttcactagttttagctacatatttggaacctaacatttaaaaatatttgtagtgtatgtactttggctctatcttgttcatatctatgtaataataattaatgataatatgacatggtcatctatctctcaggatctggcataggaaagcaaaaagaggaatctaattattaaaatactgggaaatgacagtgtactactctatacttactaatgtgcatacatttgcatctataattatttgcttttaccatatatctagagaagcactaatggaagatgttatactggtcacatggcataactatatgatgatcttcttttgcaaattaattgataggtttaatagctacccattggttaacttgtctgtgatagattgagggaagatattttataaatacaagtaaataaatacattatttccagaaacaataagaaataattttaattatctcataatgtagtgactacaatttaggtatgttattcacagtgggcatcggaaaccattgttcgcaatacattggagtgtacagagattgttcactggcatgcaaacgttagaaccaaggcaagtgatataaatttcattgccattttttaaaattaggtgaaccaatttgctaaagtgttggactgatgtgtaagactaaaacatattatattcctttagggaagttctttttacgtgagtagatatttgagaatttaaaaagttgacaagtgtgtgaattatttgtgttacatggtgatgggcagggggcaaagacccataaggtcaggaaagggagttaggtctgtactttcaccaaagtgaaaggcattaaccttcccaaagactgatttgaatgtgctggggagggaagtgatgcaatcaaaatggagtattggcagggctgtttttcagaaatgcttatttatttatttattttttggatgaggagaaaacaatagctgttgagaaagaaaatgtggtaagtaaaacatgatttttccaaaaggaatctaattgagggaagtaaatctagatagcaatattatataaacattgggaatcaaaaatatggggtaggagattacttcagaactttatacttagaggtagacaaaaacattaataggcttcatttagaaaattgtcttacaagtatacaatttaagaaaagtccttgtgggaatcatgcataccaactacctatttgaatatgctgcatagtccctcactagacctcatgagtacatgaaggtagctgcattgcaaatgagtacctgcttcaaaacttgattaaagaatgagaataaagatatcacagatattaaacttgttcttacacagcagcattacagaatgttctgctgaatgcagtatctatcaatatgttttactggtatttgtactgggtaaagggatgaaaagaactttgcagaatgaagaaagacgattgctgaagtgtagtacaataatatttttctctttacctgaacatatttaatccttatttatttttcatggcaggtgttgttatttttcagtgtagagctaaaagatgtatagatttttcagttattatattttataaaccaaatagtttggcctaaccattatatgaattgagttatgtaagtgtttctaaactctatggcatgctgatttatttcagacttacaataatttcaaatttctactgaaagtcatcttccgtgttctaagactctttaaatcaggggtccccaactccgagactgcagatgaatatcagtcagtggccttttaggaactgggaggcacagtaggaggtgagtggcaggagagggatcatttccgcctgagctccacctcctgtcaggtcagcagcagcattagattctcacaggagtgcgaaccctattgtgaactgggcacgcgagggatataactggtcatgcgagggatctaggttgcgtgctcttgatgagaatctaatgcttgatgatctgaggtggaacagtttcatcctgaaaccatccgtctcccaccccaccctgcagtccatggaaaaattatcttcccacaaaaaagtccttggtaccaaaaaggttggggaccactttaaatagcttatttatttttgtggggtcagttttcccagtagaagctgatatggtagttggagtaattatcttaataaactggcaattttaagtcactgtacttagaattacatagagagatatatgaggagaataatagaaacatagtttcttcaggtacttcaaaggaacaattctcttgcaagtaaaattgtttgaaaatggaatattctacattggtgagttttctattcctgaacctgttctaaagagtggctaaaggaaaattttgggggaaatttatagaaaaggtgcagagatgagagaaggttaaccccaaaatgctatggcattttgatgagagacagactcaaatttctttaagaactttggcctgaagcacctccgtctgacactagtggaactattaatagggagtgattaggaaatcacctaacagtttggtttctagatacaggctgaagaagttaagagccaagaaagattctatgtatagtatttagtaaagcaaaacaatttggtaagtaatgtttaagaaatgctatttcctaagattttggagttgtatttattttttttaatgaattacatatgtttctatgagacatcttgtgacatttctaaacccaacagaaacagtgtatcagcacttatgacagctagttctccactgcagtgtgtcctaggaaacactctaagatccactgttaaaccttatgagagcttcagattctatattgctccctattttactgggcatgagtaggaagttttaggaaggaaaataaaagaatatcagctgcatagacttgaagcagtaacacttgcatttataagtgtgagtatagttttaaaaatctatagattttatgcaattgtaaatatatgaattcctcgctattaatatttgtttcagaatttttaaaaaaattgttgagttacttttcttttgttcatttcaccattaattagacccataatgttgtagacattatttggattatattgacattttatcagattgaacatatctgtattacttagtaaggtaaaaagcaaaaacaaaaacaaacttttccagaaagaaaaaaaactgtgaatcaaaactacaacaatatattgaacatttcatagatgatgggttcatagataagtataaaaacattcattaaaaaaatctttatcactctttgaaaaaggatatattatcacccagtgtttcttttctagacagaataattctgtttggagccatggcaaggagtttacttattttaaaaacaagatttgtcacatgcaaaggattagttactctaaggtttatgttttagagtgacacaagtgtgattaactcactataaatgattgaatactttgctttttgcctttcttgtatatttagactcttgtgatatttttgtaagaagctgttgatgaaaaaaaccaaactgtaaaatatttaaagaggtttattttgagccaaatatgagtgctcatggcctatgataaccccaggggggtcctgagaacatgtgcccacagtagttgggttacaacttggttttatacattttggggatacagaagttatagccaaagacataaatcgataaatgtagggtattcattggtttggcccagagaggcgggatatcatggagctggtgggaaggggagctcacagatgaattcaatgattttctgattgtcagttggttgataagctttgctgaaagattagaagtcagcagaaagaaatgcttgagttaagataaatggggtggtgtaggctgggtgcagtggcttagcagtggctcacacctgtaatcccagctctttagaaggctgaagaggggagatcacctgaggtcaggagtttgagatcagcctggccaacatggcaaaaccccatctctagtaaaaatgcaaaaattagccgggtgtgatggtgtgtgcctgtagtctcagctacttgggaggctgaagcaggagaatcacttgaacccaggagggagaggttgcagtgagctgagatcacaccattgttctccagcctgggcaacagagcgagactctgtctcaaaaataaaataaaataaaataaaaaattataaaaataaagataaatgaagttgtggaagcacaggttcttgttatgtagatgaagcctccagatatcaggcttcagagagaatagatggtcaatatctcttatcagaccttaaaaggtatcaaactcttagttaaatctctcctggatcaggaaaagacctggaaagggaaggagattctctatagaatgcaaatttctcctgcaaatgatagctttgcagggccatttcaaaatatgtcaacaaaatacattttgggataaaatactttgatttcctctagggcctgctatttgttatttaatgctataccagagtcaggttggagttggggatcttattgctaccaagtctgttttgtcagtcttatgatctattttttttttttttttgagataaattctcaccctgtcacccaggctggagtgcagtggtgcaatctcagctcagtgcaacctctgtctcccaggttcaagcaattctcctgccccagcctcctgagtagctgggattacaggcatgcaccaccatgctcagctaattttttgtttctttaatagagatggggtttcaccatgttggccaggatgatcttgaactcctgacctcgtgatccacccttggcctcccaaagtgctggaattgcatgcatgagcctggccaatgatttacatcttaatgccagtgctggccatttgcgcctaaactccaaaagacaagagggtataaggaggcatatccaacctcccttcctgttatgacctgaatagtttttcagattttctttgtgaccttcatggccaaaaggggaggatccattcagttagttggcgacttagaattttatttttgttttacaaaacttatttcctaggttgagtcactttacctgaacatgatcttaatgattgaatagttgttaacataaataaatacatattttttctaactcacttaatttcacactggttctactggtaawctgtttttcaaaataataagattctcataaggctatttttattaggtttcatatatagaaaaggtatctaatatattgaataatattgtagcttctaagaccaaaatgtcttatttcaaatccctgttctattacttactagtggtacaatcttgaaaaagttactttatctttctatgttttagtttcctaatctgcaaattgaaggtaatattacctattgcatacagttatttctccacttaaatgagttaatacatggagagtgcttaggaaaatgtctgatatatatatatagtaattattcactaaatatttctttattgttataattgtcatttgtattagtttcaaaagatttaacacagaatgtattatgacaaaatttcagatgtttcagaacatgctcatagggaggccacctctaataactctagcaatatgttaacatatgcatgacgctataattgtatgcaacattctaggagttaagtgttcgcatcctatgtatgtaagggtcaagttatttggtgctaaattagatttttttgggtatgactccacatagtctttttggtcacacccatatgtcagcatttagacagccatggattgagggttacgtttaagttcacagattagaaatctcatagagatttttgaaatcaggtaagtttcaagtcaaaccttggtttttttcattcataaagatgggactgtggcctattttgcagacttctgaggatttaatagaaattagtaaacacattacctgatatatagtttgtccttagtaaacatcattccttttctctgaataggtggtcatattgcgaacctctggaatcagtttagacataagaataaaacacacctaatcaaacatgacctgggtcatatcttgagtcttctaaccagagtagccttggattgcccaggctatgtggagctagtgggatgaggaagatggggactagagggaatagatggccgagagaaagatggtgggaactgactggaaagacactttcagcctttggtcaccaccctccagagcttcctaaacttagagaaccagtaactactgctgactgtggcccatagacagttttgtttgaaatagtgtttttaaatatattgaatgctagttgcttagtatttacaaattaggagactcagccttaaatcagaatctctggcttctgtagaaaaaccagatctgggtccattaggcctcacacgtgatgtgagtgggccacagcaaagaagtggctgcgcctttagattgagcctactcttccattcctgctgggcccttgtagcccttgagttgtgacacctgctttcactgaggcaaaatccactttccattgggttaactggtgacattttgatacgtaagaatattttgcttcttttgaacataaatgattatgaaatgaatttctggtacttctgtgttattttaatggattctgcccccatagtctacttgatataaagtcttaaaaaatatactagtagtactatctaggatcaaaggctaatagtattacatctagaagcaccgtatagcaataatgtcaaggagatgaaattcaggtcaggtttgtaattactacattcatatagtaatgataattagcagtttcttaaagcttcatattttatatgatttttattgctatctgtcttttcagagctttattgagaattagcaggattttatgactttggttggtgttagttaaatgaattgcagatgacagtattattaacaagaaatgagaatgatatgcttttggatgttaacagagcaaaacgctggtcagatgtgaattaacatgttcaaaagttttcatatctcttaacacacttaaagctattttgtctatggggaattatctagttattatatttgtgaagtaaacttacctgtgttgtgtttgtgttgtcttacccattgacacatattaacatgtttaaaggtacatgtgagcagttatgcacatagactacaaattagtaaactattttgaagtctagatttcatgacttattaccaatcattctgaagttttgccttctttgcttgatttgtatttttctagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggcaagggagtggctacagattcattaaactgacccttctccctcttttcctttcttacttgctaatctagacagcacaacacagaattaatgaacagactttgaaagatccagacttctggcatccccactagcaaatgtgagacttttgacaagtcatttaatctctttgagccttatttttctaatctatagaatagggatcacagatatattattcactttattacaaggttattgtagtactaacgtttggtttagtaaagggtttaatatatagttaaaccatcagtatatggaatggttattattctcccttcgcataaaaaatctgttgattacacagtaccaggtaagaagtttcaaaacagggccactccagtctagctgcttacaattccatatgaggtgaatatggtaacttgcataattgatgtataaccagataaccttgagaatgccaaaattacttgtgactggaagggaggataaggtttggaagggtgagattcttaagggcaaggctttttaatctttctactcactgccatttttcagcatctagaatagactatgccacagtgatgctcagtgaagcctattaagtgaatgcatgtaaagaagactttatatagtaaatgacacttggattaggtcttaaaatgggttggagctggcctgaaaaggtgagaatgagttattttcttggctgcaaaagtaataaagcaaaggcaaaacccaggagtgtttgaggaatagtgaaaaggccattcagtggaagataatggtatcaaaataggcccaaccatggaggctcctacatgccacagtaaggtctctgaattgtatttgataagcagtagggaataatgggatgtttcagagcaagggggcaacctgattggagcttgttccaggaggattcattttgcctcaccgtgtggaatgattagaggttgggagcaggagaaagtagaggtcagagacacggagaaccgttagagcaacactgtgatccagaaaagagggaaacatcattcaaaagctgattgtattacacaatcactcatccctatttaacgaacggtgctgggaaaactggctagccatatgcagaaagctgaaacaggatcccttccttacaccttacacaaaaattaattcaagatggattaaagacttaaacattagacttaaaaccataaaaaccctagaagaaaacctaggcaataccattcaggacataggcatgggcaaggacttcgtgtctaaaacaccaaaagcaatggcaacaaaagccaaaattgacaaatgggatctaattaaactcaagagcttctgcacagcaaaagaaactaccatcagagtgaacaggcaacctacagaaagggagaaaatttttgcaatctactcatctaacaaagggctaatatcctgaatctacaaagaactcaaaagaatttacaagaaaaaaacaaccccatcaacaagtgggcgaaggatatgaacagacacttctcaaaagaagacatttatgcagccaaaagacacatgaaaaaatgctcatcatcactggccatcagagaaatgcaaatcaaaaccacaatgagatatcatctcaccccaggtagaatggtgatcattaaaaagtcaggaaacaacaggtgctggagaggatgtggagaaataggaacacttttacactattggtgggactgtaaactagttcaaccattgtggaagacagtgtggcaattcctcagggatctagaactagaaataccatttgatccagccatcccattactgggtatatacccaaaggaatataaatcatactgctataaaggcacatacacacatatgtttattgtggcactactcacaatagcaaagacttggaaccaacctaaatgtccaacaatgatagactggattaagaaaatgtggcatatatacaccatggaatactatgcagccataaaaaatgatgagttcatatcctttgtagggacatggatgaagctggaaaccatcattctcagcaaaccatcacaaggacaaaaaacgaaacaccgcatgttctcactcataggtgggaaatgaacaatgagaacacttggacacaggaaggggaacatcacacactggggcctgttgtggggtgggggaaggtggggagggataacattaggagaaatacctaatgtaaatgacgagttaatgggtgcagcacaccaacatggcacatgtatacatatgtaacaaacctgcacattgtgcacatgtaccctagaatttaaagtattatatatatatataatatacagccttatgaacatatatatatataaaggaaaattaggcaaaatagcattacttgaggtactcaatagcctggcagagcagacattaagggtaagagagactggacttgaatttcagtttggtacttgactttgggtgggtaattagcctttattagtcttgattacacatttaaaaggtttaataaggccgggtgcagtggcttatacctgtaatcccagcactttgggaggccgaggtagtggatcacctgaggtcaggagttgaagaccagcctggccaacatggtgaaaccctatctctactaaaaatacaaaaatgagctgggcatggtggtgtgcgcctgtgatcccagctactggggaagctggggcagaagaataacttgaacctgggaggcagaggttgcagtgagctgagattgtgccactgtactccagcctgggcgacagagcgaggctgtctcaaaaaaaaaaaaaaaaaaaagtttaataatgtccatccccatagggccattacaagaatcaacttttaaaaagtcacacattatcactaaaaaagcaaaatatttttccctatgattatagaaaataatgcacattgttgaaaaaaattcatattttgataaccctattcatttagtatggattttagaatacttagtattgttgataagttgacagagcataagatattcaaatgcccttttagagtgtaaagtctttcagaaagtcagaatttaaaaggagagagatattcagatataatctgataattctagagtatataggaaaacctaaaatggtttctaagtagaagacaccaagatgattttgactcaaagagaaaaatgatgcattttgggccatcttttcatggcattttatttcttgacctttttgctttactttagtagttctgactataatggtggaaactttccaacatttccttccatgcaaagtggatgtgcttaggacacttcattagtacttaaattcctgaggtcattcattgactgccatacatcagaaatagaaagatgggtgtccctacaggtatgcctttgacataaatttggtggttggctataaaaactggtggttattcttatgttttagtatgtaattcagattttataaagaaatagcatttagttttatcactattataattttgaagagtatttctgatttggggagcattttatgtattctttggatatttgtagtaatgccattttaacctgtcttgtttagaagacacagtatgctgccaaaattctggtcattgcataggagttctagcattctaattccatctaataggaggggaaagtcatgtgtggggtatatttaatatgatgactgtatgcctagtcagggcttttgatagagaatgggaactagaactaggcaggaagttttcaagctgaacatgaggagacagtgtgcctttgaagccatttgcctcctggagagagacacccagagggagagtgtttagtaaattaatccactgagccaacagactaagctgctgaattatggtcagactcaaatggatcagatgtggagaagcctgtatttgaactgctggccattaggaatggtgtttgttgctatgggaactggtgctaaggaactatactgagagactctgattaaaagggggagggggaatggagaaaaaagcctgagaggacataaaaataaaaaagcaatccagttgttgtaaaacaaggctcaagccacatactgatggctgtgaaccatatattcctatagagtttgcataaataaattcatgctttccaattaatttgaggagaataaaatattgccgagggactgttaatttctatgatatttcaggcaaagaaccaaagtgtaggtgccgttttcatgagaattttagatatgcttgactaggaagtcattacatcacatttatctgtttggatgtgggagacattaacagccttatgaatattcatggtatctggttaattaagttaattgttctgcagaagtgcttgcacttccaaggacattttttttttttttttttttttgcctccatagtttctccctggtatttcatcagtaattctttacatgaactgctacttctgtccttacttttttgtatttggaacattttagcagctctcaggaggaagtggtaggcaaagtttctggtagtgttaagaaaaataactttcaggctaattaaaatgtttaccttgaggtagaacatttatagcttttgtgagaacattaaaattacgccattgttatttatgtgagcagcatgttcttttggcatgtagacatcttttcaaatagagtacagtttcctgaaacaaaatgtaatccatctttcagattatcccaacaaaatatagaacaagctatcgttttgcaattttacatatactttctcataaactttccttttttcttcagagtgtcaaaaaccacatttaaagactaagatacagattaatgagtagtcaatgactaaaataattttctgacttctagtcatgtctgttatcactgccaacttctacagaattagagaaaagttgcaaagcctgagaagacataaacaatttttaaagccatctctagcattctaaaaaaattttgtacttgggcatacccaccgtacttcaaactcacagggaataaatggtctttattttcttaagtcatgatatgtgtcattctctattgcacatgacattacattatgttttttaatagcctttctagaggaatgcttttacggtctactcataattaaccatggtaatggaggaaatgtgtttcatggagtactgtaatccatcgataatcctaaatatctgactctaattatgtggcctcctccaaaatctttaccacaaatctgattgggaagcacaatggattgacttgtttcttccttttctcctgatccattccagatttattagcaattagatggtcaaagggcaggctgtagagggccacaagatcattggaaagaccttgataaagatccactgagtaacaggtttctacactacttgttctcaaaacttagggtccatagactcaccttgtgaacttgctaaaacagagatacctgggtcctccctcctccaaacacattctgagtccatgagttggaggtagaacccaggaatgtacgtttttaacaagctcccaggtaatgatgctgcttggaccatgcattccagaggagtttctcaccaagtcactgtgcatacaaaccacctggggatctaataaattgcagactctgaatcagtgtgtctggaatggggcctgagaggcaacattttaaaaataatatattttttacttccattaatactgctattactgttttaatacctattatccttatttttaaatggacaaaaattgtatgtatttattgtgtacaatgtgatgttttgaaacatgtatacattgtgaaatggctaaataaagataaacatgcataaaattgacataatgatcacatactgattttacattgagaacacttaaaatctcccttagaaatttccaagtatataatgcattgttactaactattgttttagcctgttctcatgctgcaataaggaaatacccaagactgggtaatttataaaggaaagaggtttaattgacttgcagttcagcatggctggggaggcctcaggaaacttacaaccatggtggaaggcaaaggagaagcaaggcacattcttcacaaggtggcaggaaggagaaatgctgagtgaagtggggaagagtcccttataaaaccatcagatctcatgagaactcactcactatcacaagaacagcatgggggaaaccacccccgtgattcaattactcctacctggtctctcccttgacatgtggggattatggggattaaaattcaagatgagatttcggtagggacacaaagcctaaccgtatcaactgtagtcactaggttgtataacagatctcttgaatttattccttttacctgaaattttatatcctggaccagtatctccccagtccttcccacccattagccccagtaaccactattttactcttcgcttttatgagtttaagtttttcagattctacataaaagtaagtatttgcctttctgtgcctgtcttatttcacctagcataatgtcctccaggtttatccacgtgttgtaaatgacaggacctctttaatgccaaatagtattccattgtgtatataaacaggctgattgtccctaatctgaagacttaaaatccaaaatgctacaaaattagaaatgtttgagtgccagcatgatgccacaactggaaaattccacacctcatgtgacaggtagcagtcaaagtgcagtcaaacctttgtttcatatagaaaaatattttaaatattatataaaattatcttcaggctatgtgtataagatgtataaaacttttatgtttagacttgggtcccaccccccagatatctcattacaccaacagtgtaaaagtattcccatttctccacagccttaccagcatctattgtttattgactttttaataatcgccattctgactggtgtgagtgtggttttgatttgcatttctctgatgatcagtgatatttagctttttttttatatgtttgttggccacataaatgtcttcttttgagaagtgtctgttcgtatcctttgcccactttttgatggaatttttttttcttataaatatgtttaagttccttgtagattctggatgttagacctttgtcagatgggtacattgcaaaaattttctcccattctgtaggttgcctgttcactctgatgatggtttattttgctgtgcagggattgttttcttgatttctttttcagatagttgtaagtgtacagaaatgctactgatttttgtgtgttgattttgtgtcctgcaacttaactgagtttgtttattagctctgacaattcattcatggagcctttagggtttcctaaataaataagatcatgcctacaaacaaaggcaatttagcttccgtatttatgatttgcaagccttttatttctttctcttgcctaattgctctggctagaacttccagtactattttaatgacagtggtgagaatgggtattattgtcttcttgaggaacaagacattgtttctcaactcatgagagtaattttaataagcactcaagtattgtcattcctgtttgacagtaggccgtattttgagtaacaagggtcacagcataacttgccttttggtgaatcagttggaaccagtttgccatttagttaaaataaacttttctttgcactggtattactagaagtaattgtgcttatttataattaataataattaaatatgcttattcttagttacctaaaaaattatgatattaatgacctcttggttgataatggctaagctgcctcagcttctccaatttagcaacccaagtacatatcagttcaaagtaacacaaattgaagcaattatgtatgatcacataggaatgcttctgattaacaaaatccagaggactggtctttgccttcataaccggaacacaccacatgcatggtttcacagctcttggctattattggacttacttattatattctttaattcaagaaaaattgtagcttcattcattctgttcttaataattttaaattctctttagcctcctgggaatgggaagggctagctggtatagtcccctgtatctcagatttcagttacacataaacattaaaggggcctgacttagggcgctctttgcctctgtggactggtggggaaaatccaggtgtgtcttaaattctaataatcatgaaaatcagaaatcataatgtttcaaatacaaatcttcatacatgggaaatacaattgaattaaacattttcttcaatgtaggagacatttgtcagataacagaggggattctcatttggctaagagcttacctctaagattcattaaatgtgtttagagcatattttttgtagtttgtagttattttatttttctgagttattatttggattattttctcttttatttatgtatgcatttgtcactgctccccagaggcacctcattttggcattgaagctaaaaacccattcattaaggttgggatggagtgggctttgatatagctagcatttgggaggtagaaaatagacattcgtgatcaaaaaagctgtaagcggttactataaactatttttaaatttctaagtattttaaatattgaacaaatgtgtagacatttgatgtgcatctatactgtgaataagaacttaaacttctaatattcacattaactttcctgattttataaattctcgtttatttttcatctgaacattgaagaatgacatctacataaagtaaaagcaaatgttagtttgaacacattctaccctaatagtgcatgttttaaaattgctttggcaggatctaccaatgtattggcacattctcttcatggagttcctcatgtgataactgcaacattgcacattataatgggtaagaattcttccaaagcagttcatattttataaggaaatgttgatttatataaggaaggccatcttatttccatcagactttaagaaaaggcaggttctttgtctcttagagtagagaaatgtttgactaaaaaaccaaaaggcaatgctttactatgtggattgcctgtcttttcaaaatacttgctttgtaaagagcagtaaatgaagttttattgtaatctgtacagaaaaaaaatattgtagtgtgctcaaaattataattttataaccagatgaagaacattaatgaatactccttaagtatatccaacactgatgtaggactgtaccaagactctaggactaggattatgttattaatgaaaaaacataaccagaaaaaaatttcagccagtagatgtctatagatattttattatccctattggtaaaaagcatataagctcaggtatatgtaacactaaactactgttaaatctgtgtttaccttgcctatctactttaacttcgtttctttgaccatgttttataggaaatagcaataagctgaaaaatttagtactctgtgtttcttcactagtacctgaacaagttaaaaatggtaattattgtagttataggtaaagggaactgaagagaaagtgaggatgttcatggtctacagtacctttagatattctcctataagccaataaatatgctctcttatgtttgctgttttgatacaagtcctactgtactcactgattaatatttaatgtaatattcaagggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaagtaagtctttttcttaaaccaaaaattgtatcccaggttcaatgactgttaataacaaatttcattacattttagggcagaagactgtgaaatatcatttttaccatttaacagctctgatgatgtgcaagaaaggtaggtaaaaactcaatgtaatacagataacctgtatctttaaagcataaaacattctgacaaacaattgatcagacttaggatctttggttatttttctaacatagtagtaaagaatatagaatcacagactcttacaggtcctagtaagcaaacaactactcactcagcctttttctctttttccttccttctttcctcccttccttccccctgtctctccctccctccttccgttctctttttcccttcccttcccctttctttcctttcctttgtttttttccctttctttccttttccctttcccttttcttttgagtgcctactatatgccaggcactttgaatacaacaatgcaccaaaaaatgaacaaaacacacagttttgtccctcgtgataattttggtctagtgtgtaatacaaatattaaagccatattaaagaagggttatagtctttaaagaaatagtacattattattccttataatactagtttacctttaaatgaatcaacacattatgttggcagcaacaaaattgtacgtttttacttactatctaattgaagaaagtatttaacatatataatgatgagttctctaattttctcatatttaatagatttgtgtgtgtctgtgtgtctgtgcgcgcgttatctgttttatgtctttgttttgttttctttcttttaggagggcacagggatctcccaaatctggtgagtcgaaaagtatctccttgagaactgtgccaggttctgttgacattttgttctggtgagggaaaataaccaatcactttcattacctttagactgtaatgatcaatggcaaatgatccagggtcagttcttgaatgtcagcattatggcaattccttgcctgtgttcagtggcacctagaggcttggcacctaataccaggttagtaagcatttttattgaattgttgatacatttcttatagaccattttttttccagggtatccaattaactgttggttagctagaaacttaacaggtagtttatctttgtatattagagattctaagggatttgtcatcacagtaggttgagaacaactgttgaactggaataattatcagataatcattgactatttaacgtcactgaggctaaaataatatttcctaagttttattgatagaattttatgcctactttacttgatttattcatttagttgtggagaacattatattaaatactgatatttcttgtgaatgtctttgctttccaactttaatgcaaacataaatatccttagcatgaaaatcacacatatgtatatttgatactgtattagtctgttttcatgctgctgataaagacatacccgagactgggtaatttacaaaagaaagaggtttaatggacttacagttccacgttgctggggaggctccacaatcatggtggaagatgaaagtcacatctcacatggcggcagacaagagagcttgtgcagggaaactcctatttttaaaaccattagatctcatgagacttattcattaccatgagagcagcacaggaaagacccacccccatgattcagttatctcccaccaggtctctcccacaacacatgggaattatgagagctacaagatgagatttgagtgggaacacaaagccaaaccatatcagatacttttagtcaaaagaaacatttcagttctatttaatgtgaatagtagtgcatatcaatctcctgcccacattttcaattgaataaaatatgagacatcttatatatatctttttatccatgggatatagacattccttctcttgcacattcttcttaatcagctgtccattatggggctgaaaatatttctttcctgaatccaatcctgtagagtgtaggagaaaggatcgtgagtgttgtgaaatataggcaataaacggggaaatattcaaagttagagaagaaaaaagagaaactgcaaacttcgatattgaaaacccagatggcaaggtcctcattaattacatctagtgctaaaacttcaaaggagtattttgaaccttgtgtgatttagaaattgagcctggtggttttccccgacaccttcagaaatcctagatagctgtgtgctttcataatgtagtttccctgactaaacttgaagacgtggctagctgaccaaggagctatgtttggcaggacttgagacaatgtttatctaaccctgtttgtttaaggaccttcttgggagggtagacctgctcttctgggaacaatcgattcatagctccttcaaagccactccataaatgttctgcttgactagaattccactgttgactctgcaggcttaatcagtattaatgaatttttcagagaaggatgactaattagagatttcttctgtggtttataatcacaacatgccatctttgcaaagaccttttgatcaagactcatttgaccggagatttttcagagatgtagcttctgatgattcaggatgattgaacaggagatttcactttcttctttttcccccaccatgataaataataatttatgttagaatatctcagtgcaaattgccagtaggaactaatattcttatattctaagtattctaagattaaatgtgttcatatatgtgagacatttaaagcagtgccagccatgtaagttgtgtttctatttcaagtaaatattgcaaagcaggcataggatagtgcttttaatgtttataaattatgcaattaaagatgcacagtaacactaccatgaacgttttggtgctgtttatttttaattgggaagaagaagcatgatggaaagcatactgagcacctggagtattggtgctgatgaccattttttctctgtgtgcctttgaacaaatcacttaaacttggagttgtcttttccctctacatgaaatgagcgaatgatgagataatctctaaggtcccttacagctctgacttgagctttcataagatactaagagctctttttttattttgttgttattcttaaattaacttcatgtttgcactgaaatcaagctagaagtcatttgtatgtatttctgcaaactgcattctatagcttgatgcatttgtgagtggctgttttggcactaaatcacacctctgaattttcactctcttatattggatggaacagttatgcaagattaaaatgttcagtcatttaactgaacatgtgtggcagcatttgttcactccatttcatccatccaaaggccactttgatttatttcatttcctatgtcacttagaccttctgtctataaataaatatttaaatcacactttagattttagaaaatgttgagctatttgttacacaacttgtgcatattaactcttctataatacatcttttaacaacatagtttcacatttagaatttctaattacattgtattttaaattatgtcttgatatgtgagtaggacgcttgatggtttgctttgtaaaatgctctaatgtaagagcttattgagaaggaagccagtgatttaataaaactcatttgaaagcctgcatcatttaaaaaatagcaagatacggtttatgaattttaggtaaacgtaacatggtgatttatctatcttgtccaatactttcagtaaacagtatacttgttataaggaacagtatgtcataatttttggtataatctcttagtaaatttcttgatgtctaatagaaatatttaatttcagattaaataatggaagtatggctcttataattgcccgaaacacttctcggccagaatttataaaacacctgaaaagatatgccagtgtaaaaaatcaggtatagtaaattctttttgttacttatttgcaaagctattaatcatgtagaaaaagatgctgcaagaattgacatcgaatcctgcctcataagaaggttttattttcttctgaatatattaatcttctttttcccaatctatttcatccaaattttgaaaagcatccgccaggattaatatagattggccttttttgaatgatgaattagtggttatgtatctgtaaccacaaagataaaataggaaatgtagtgttatattgcaatgtgaaataaattaaggataaaattccatactcaggctgttcttcagaatgaaaagaagtgaaatttgagagtttagccttcttgatattatggcagcagactttctaaagttatgatctttagatcttcctgacatttgtttgcatatctgcattgattgaaatagatctgtagatatgtatttaaaaatatgacagttttatacaaatattcattcaaaatgagaatatgtgaagatatacatttccacttaagtgatttgctttaaagagaaacagtaactattacaagccatattattttggcagctgttttgacctgattattaggaaaatgatccttgaactatgtgaatttctgaaattgtgagtctttgaagtacataggtatggttgtaaaaccctatagtttcacactttttctttttctttctttttttttttttttttgagttagagccttgctgtgtcacccaggctggagtgcagtggcgtgatgtctgctcactgcaacctccacctcccacgttcaagcgattctcctgcctcagcctcccgagtaggtgggattacaggctcacacctccatgcccagctaatttttatatttttggtagagacagggtttcaccatgttggtcaggctggtctcgaaactcctgacctcgtgatgtgtccacctcggcctcccaaagtgctgggattacaggcgtgagccaccacgtccggcccacacattcttaaaggtataaaatggtgcttggatagagttgggagataacagacgggaggaggaggagagtaaacccagccaatgactggcagctgaaccttgcttatgtaccttagccatagcaagtctctccatttttgcctcattatattttaaaactttcttaggccatcttcatgaagtttgatctgtcagtaacattatttgatcctcatgtattgaacaactaactgggctgcttaggaacttaaatcataaaaaattacagtcccactttctttatatgtcaaagtagatcagcaggtataatgtaggttgtgagcctacataacagttttatgtatgtgtttgggtggaatatggagatttattgattttcaaaggaatatatgccctttcacattttaataaatttctaaacattaaaaccaatttttaaaaaacccaaagcactatatattcattgctgtttttaagtcagaaaatagaaacaagaaaatgattttaaagcactcaaaattccatgttcctcaagattagtgtcattaccttggtagaattttttccgaatccttttttattaaataaatgagaagtaaagtaagtattaacctcattcatgtacctctatttgagaacttaaatagtattaacctattaatgtacccctgagaagttctgtatttattttggggaggtgtatgttgcacaaattgtttatggaaggtctcttttgaaattgcctatggggcaagtctctcaggcaatttttgtaaacattcttcttcttcatttttttaaatcaatatacctttcttctgattttaaaagcaatggttaccttacacataaagacagacatacagaaaataataaaaatctgtatcgataggaagacgttttctaagagataatattatgcaggatttatcatattttctcatgtactctacgaggcatatcttgcttttgacacaagaaacagttgcctgtgtgtgattcactggccttaactctgatttatttatcaactttcaaaaattaaaatccatgctattttttttttttttgcaaagaattctaaaatattttgcatagtgtatatagtaagaaagattgattcccagggtgactgctttcaagcaatgttaatttgatttgttaattatccacacaggtgtgtttatttaggctctttccttcatggtgacattaaaaatgtgaatttatataaattttgtaagattatgaaaatcagatctatgtaaaaatcatgtctactgcataattcatagcagtgctggtattcaggaaggaaaatgtggcaattcagtttaaggagagtaacatctgcttctctgaaccatttttaccaggttgaataagcgaatgttactgtataacactgtaaaatagattgaaaccaccatgtgcggagtggctcctgttccttccccatctctgtgtaaaattagatagaggctgaacactacccttcaaagtccttgcagctccatcctattgctttgccccccttctcactgtccacacttttctctttcattgtgaccatttttggtagggagtttaaaaccttaaatgtgagtgcttcccccaggatttctttgcagccctctcatcttctcaggatgccgtctcctggatggcctcattgcccctcacttttgaactgtctgaacatcatgcactcccaagggttctgtcatctcgtcttatctgcaggacctctgtcttcttgtatgctgaagaggttctgaaattcaccggcatctggaggccaacatgtctacagccgaccttatcttttcccctaaagttgttccttctgcgttgctctgtgcgggtcaatggcaccactttctacccatccaggttaccctgaactgttccttcttcctcattcctcactaccagtcccctaacttgttctgttggtctcctcttaaatgtttctaaaatttctccctcaccttaattcaaactttaatcctttcttgcttacagtagcctccttttggccttcaggttctctggtcttgtcttccatacctctttttagagaaacttttttctaagacacacattggatttctctcctgcttaattcttcagtgcctttctcttgttgtcagaataatatggaatatcctcagtctggaacacgtggcctttgtatccaggtccctgcctgtgttgcaaccccacctcttattaccaccctccaccacattcccagtgttttggcattttattcgttggctaaggttgccataacaaataccacagaaaagatggcttaaacaaacagaaatgtatttctttcatggttctggaggctagagctgcaagacaatgtcagcaggtttggtttgtcctgagtcttctctctctggctggcacatggctgctttctcacagcacccacaagtgagtggtctttcctctgttcatccccgatgccttttcctatgtccaaatttcctcttcttataaggacaccagtcgtattggatgagggcctaaagacatcattttagcttaatcgtctctttaaagatcttatctccaaatatagttatgttctgaggtatacagagcgaggatttcaatacaggaatttgagggccaaggggcatgatgttgagcacctaggagtcacactgaattctgtgtagttgcttgaccatggtttgcctctagttttgtaaatgcttcctctctccagactttcttctccaggctaaatcttatatgttctttaaggctcaattcaaatgggaagctttcccaacatccatagcctgtttgcctcctcttgtttcctctgttgaactccacacttgcaccatcatggcactcccctgtatcaaaattgtaactgtttacttctcctccccgtgccccaaacataccctcacacaggatactaagctcttggctcccgaaagtcccacttaacagcgtctgtggcttcacagttaaagcatttgaaggatggctagatcttcattttgtgaggagtgcacatgacaactgctgatttaagataatagacttactggtggtggctgtcaattcttgacattccttggcttacagctgcatccctccagtctctgactctgccatccttggcattcttctctcataaggacatcagtcatattggattaggtcccgccctaatgacttcatcttaagttgattctacctgcaaagaccctatttctaaacaggggacattcacaggtaccaggggttaggacttgaacatagttggggtggtggagggaaatataatttagatcataacaggcagttgtgtgttttaaatgaattatcaactaacatgaatgattatgtagataattctacaaggatgaggcatgtagccaaggctttatacccgaggtaggaggtctaacgcagttactgtcaaacagttttgcttggggccctctaattctgtacctcagtcacaacagctgatgccatcatatcatctactgtttaactgtgtttacagtataaactggaaagttggctggaccttggtatctacatatgtaaaatatgggtgttggggaaaatattagttttctgtcaacttttaaaactgtttcattgaggtttacatgtggaaaaggggaaaaactatgtagatgatgtttaattaggaatgtatctcatgtcatttttctgaaaactgaaatgagtagttatacatttctgctcaagttatttggctatattttcttaattatgtcagaaaatacatagtgctttttcagtatagtttccttaggcaaacaagaaaaaacgcaagttgaagtttaccttgcaccattctatagtggtaagtaaacagtgatcttgcagcttgtgtccattgttaaagtgggaatggggcaggcaaacaccttttaaaatccatatttgattggctttctcttttaaaagaagacatacatcccattttatcttcagaagtttagacttgcgttcttccaaattaaattccaagtgtgaaacttgtactagtttgctttatgtcagctaaactaattgacaagttgataatggattatatgtcttctgtatctacaggccagtattaaagattatctttaattgaaaaatctacagtatcactattttatgtaacttctcacagatatgtactatttgtcataaaacaagatttctaggtgctagatctaaaagaacccaaaaggctttggataagagattccttcttccaaaaaaacttggagatccctgttcatagtctcaaagctattaaaatgtcagcatacatgctgatatttacttgtgagagagggctcagtgaactttgattcgcgttagtagctagagataaaccaagtataatgattatttgtatttatttttagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattaggtaagtctatttatttcaccgcttattgtcaaccagtaaacataaatctaatattacaacgaaagctctcttctctgaactatcaaagcaggcagttggttagtttttaaaaaatcagtaaatcagggaagcataaagagacatgcacaaatttcaataaataaaaagcaactttacatttattcaactgttatgtagacccaaggcattttctttggttatgcgtgtctacattggctttctaatttattgttgtgcataaactacagataatgtctacaacttccattttggatttttaaaaatggatcaagatcttaaatcttttagtggagccatctgaatagtaaagtgttagatttttatccttccatcttagtttcctctcactcataattactgtaacatgttttgttcagtaatttgcttttattaggcctttacagagcattcaacttcccttgggaacaattttacatagcaactggtataaacaggtttaggaacctgcaaacgcattcttggtaggcattgtgacactcagtggttagaagaagcatgcaggggtgcccactagacatgggtgttctagaggcataactgactgttttacagaggtaatggagagcattggacaatcaaggaagtcagttaaggaggttttagagcaattattgttgttgatgatttatcaatcagaccttctcagttttctagattacagctctgttgggaatgctgtgtttgttatcaatttgtatttggcattggcattgtgtaccatacttattaggtgtatgtgaaaaacaacaaaataagttgatgaaataatgtattttctttacagattgcatccaagacttatcagtctttatggaggaagcatggaagaaatgattccaaagtaacatgtaattgtttctaaaagaaatgtacaaactagaattttaatataaagaaatgtggccatgctttaaacctgtggtccccaccctttttgggaccagtttcatggaagacaatttttccgtggatgggggaatggtttcaggatgaactgttccacctcagatcatcaggcattagattctcttgaggaacatggcactctagatccctcacataccagttcaccatatggttcgcacttctatgagaatctaatgctgctgctgatctgacagggggaggaactcagtaatgctccattgctctaacctcctgctgtgtggccaaacggatatcctaatagaaattgatgttactaacaattagcctctagggctttaaaagtcaagatgaaatatcaattcaaattctgtttttagatatcaattcaaattcttttttttacaatgtgtttattggacacacaaaaaaactttgcaaccatcataatacatcaatatttaacctagataattctgaaataatttggattctttcatttttcaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttcttaaagtggtagggttttaaaattcatgatacaagtaacaaagtaagttgataacaaatactattttgaactgggcaaaatctagcccaatatgtaattgtgttccccttgtatctgagaggcctgtgttggacaaccatagtactctgctttcactgtgctcagataacctgaaatatatagttgtttctgagtagttctgagtaggaaagaaccaaatgtaaatttccttagagaccatcctggagaagacagttctaaatcggggcttgatttttcatctatgatcctagatgttctcctgaaagaatgactagcctttttataacgatacaaagttttttaaaaatacataaatgtcataaagtttattcctgtgtatacacactctgggttcaggaggttttgtgcttacatttcactactcaaatgccttcgcaaatctcagaacattcctcaccatcactgcaggcctgtgaacagataactttcatcaattaggatggctggctagtggcagggacttcatataaagaaatctttcccagaattgtttttccacattgccttctaatttgatcactccctataacagatgttcaaaattcggccacagctctcttatgaaggcagagtcagataaaatgatattctgcaattatctagatcataagcataaaataaatattacaaaaatgattgtatttaaagaaattttttaaaatccagaaagtcatttaaaatagaacctcatatagtatgaacaaactataaaaatattttacatttca

SEQ ID NO: 8 - DNA, 145347 bp, Homo sapiens
  mutation 118832: a/t SNP in forward strand
attgctatttgggcaacaatatggctccttcagaactggtcgagaatttctgtggtctttgcttgaccttcaagttgggagtttcaaatcagaggctttgaagtctggaggagttcgcagccattaatccttccggggttgtgctaaaggcgtttctagaaagagatcggaaagacccgttcagcacaggcccattgcatcttctctttgaaaacgcttgtctgaatcaagtatcttatacagacccgagactgaggggagcaagagcgcaggtccggctgtggcgaggtgtccaccaccgtacttgtggtcaatgcctggactagagagccgaggccgtccagggcgggctggccagggaaccagaagcgtccctggactggctgagtgagggtgccctttccagcaacccagtggccatggttaaaaggcagaatacaaccgtcaaagaagtccccagctcccacataagagagcgcaaaggccaatggaaccaaggcctcctcgcgagaactagctcgctttgaggacaagatcctggggatggaggtggggactgacgtagtgagagggtctggaggaacagtcgtagctgaaggtcaggacatgaagaattgcacgtatggtagggatagaatggcaggtacaacttttctgtactgaaggaactgggagaggacgatccggttagggaggttggggaactaatctcaacgctgcgtttacagatgaagccgcttttatatggcgtatatgtttgcttagaggggccgacggagattaggagaagccatcctttggcgccaatgatcaaagcgtctgccaaggagaagaagccaagggatgggcctttcagagagggcaaggagtcatgctgctctggatgccagtgtcaggacaagaaatcgaaaggagcgaggactcttcactgcgtgcctcagtctccccgcttctgcctctttcacctctgtcctacttccggcgcgaaagcaggccactcgctctgatctagacctagttaacattagcttttcccttccttccctcaaatcccctcccccctctatccccgtcccttctgccgcctgaaagggttaatctctcctgcgggtaaaaacaggtccgcggagtctctaactggcgacagatgggccactttcttctggccacaaaggggccggaatggagcgctccgcggcatacaaatgggcaggtcacgtggttccaggctcttggctggaccgggaagaccatatggcgcatgccggggaggaaggaggaggggcgggggtaggggtggagggtgaggggagcggttgtcggaggagggcgggagacgagcaaggcgtggggagaagtggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaaggtaattacagttctttcatttttttgccccagaatagaagcaataactgaagactgatgaacctacatattctgtatgtgtgcgtttgcgagagtgtgtatgtgtattgagaccagcatccccctccataattgcccataagtactcacacataatgagtcgtgtcactcaagtaccccctgcaggctttctaatttaaattttaaaaatttgggtttcttttgtggatagcataggagcttcttggattttttaaaagaatgcacggtaactatgattatctgctagtgctgattttaaagtcccaaaagcaataatgacttcactttctcacttcttacagtaagaaaaaaaaatctatgttatcaatatatattttgtgtgcatgtattttacgcacattgggagtgtcaagctgtgttttcagtgaatgaaagggacatggataccttgagtattcacaccatggaaaataaatcaggttcagagatagtttagttgagaggggggaaagtggagaaagggagagggactcactcctgctacctgttaccgctccagaggcggccaagtccccagcagccactactggagccagaaattcagttgttttactaaaggctttttattttccttactagaagcggcaacttcgcggttgccaatcgctgaccattataattactcaatcttttaaagggaggtttgaggcgaactttgaaaagccccaataaagagcgggcggccctttcaatgggctgtttattagagaggagccttccgcacctgatccccggcgcgtgggagagcgctctgcgccgcgcccccagccctcgccctgcagctagcgcttttgtacaaggtggaaatttagcggtgggccagagatggaaggcaagaaaagaaaggcgagggaggggtggaagaccctgtccacttttgttgccaaatgttacattgatggtgaaacaatttggtggaaactatttttcctcctttctgcatttgcttttcagtatcccgtcgatgtaatcttcttaaaaatcgctgccagtattagtaaattacgcaatggctgttcaacttaaatcgctaagtatctggaagccaggacagaaatggaagtagaatgtgtgattttacagcttttttttttttttatggagttgtgagtaactttgaacacatttggataaacatgaagtcgctgaaatgtacagtcatttccacacacattatcctgtcgggcaaccaccataaacacatttaagttaatcactaggatacaaacacatatgcgtgagtggtgtacacatatacatattcactaccctcccccagtcctgtcctcactcctacgtactagcggggcacacgcacgcgccattataaaacactgcatttaactttttctcagaggcattcattttgtaatgggcaggtacttttcgcaagcatttgtacaggtttagggagtggaagctgaaggcgtatctggcttttgaatatagcgtttttctgcttttctttctgtttgcctctcccttgttgaatgtaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaaaccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtgagagcaattgttgcatttcttcttaaagggattctgtttttatttttggggaaagtagttgcttttttgctgagttaaaaaatactaaacactatatgtagaataaaagaaaagaaaaaagtttaccttggcatatgctcttgtctgtttatcttgcacagggagtcaccagttctatgtagataatgaaaagacctaactgatatttcattatttggaatatgggactggacggcagtacaaacagtgtgtttttttctttgttttaagtggcttagcctttaggttttttatttccatttttaaaaatgattgttacatgttttcttctatttctttttttaaaaggtggattttaataattattaacaagcaagacataaacaagtatcctagcttagtttgtctatacatttaagatgtataaaacattactattttcttggtcttctgttatctgtacatttttctgaactaaacagttttatcttgcaaactagtactgtcccagaaaaatttatacacctttaggaagtaccaaagggaaatgagttaattaatttaaagaatccaagagaagtaacattttataattgttctattaacatcttgtgatgatttccatcatttttccaagaaaaagcataatggattatttgtactgaagaacacactatttgtactgtatttaggaaggtgtaattatttcctccccccaccctttggggcactattctgttgtttcatgaacacaactcactggaaaaacttatggatgattctgtctattgttaagtccacttcaaaaaaaaaaaaacagtttggcatttcttttcctctggatgtattgactgacagtcatgattcctagggaatatcattttggcacttgtgccctggctctactgtggtgctctgattactgtcattagtaactccattgtttctactctgattcgggtgccacattggatgactaccccccttcccaagcttgttcctttaatctccttctcattggtgatttaggggttccagaaagctgacctcatttagcaagctgctccagaaaaatgtgagtaatgtaatggacaggaacaattagccatactaataacattgccaatgaggctgcgtcaagctgtgacagaagcagtaaggaatacttcgacgttaaaaaaatgtttgagagcaatttaaaatatattattttaacatgttttctatcagccttcatcacatgacagaaatacttttaagttagtcccaactttatctaaaatgcagcaatctcattccaagtgaatcagagttgttattttggaatcaagctgttgctttctatatcctggattgttctcactgttcttactttaagagacataatactgatatgatacttgaatactaccagccttccagtgtaggaggtaatgaagtgagcattcagatctgatctaacctattaagtagctcaatttcacctgcaattaaaattagacatcttcatgcaaactaaaatctgttgctgtagtgaagagaagaaataaaagaatgccattttgagaattccagcttccaaaatagcaaacagggaaatctagactgtgttcttttgtaaggtagaaatgaagactaaaagttaggttttttttttttttcttcccattttgccaatacaacttcattctaaaacatagggattctttcagtcagtcaaggagtaactcacatgccaccatcttttattcaaaggcaggcacagatgttccttctgcaggggaggatttaatttatgaaaatgatattgtttatgcatgaatgaactgcatgcactctgcataacacatagcacttccatctgatcagagaaataccacagaaccagtgccaatgtcagaaacatattctacaaatttactcacttaaatgtttaatgaatatttggaaggcattttcaaaccataagaaacattttaaattatcttcttttatgaattcctacccatatttaaaagagactcttacagtttttgtaattggctaatgcttatacccagtttgtaagaaaagaacatattttactaaatgaaaaccaaccaaaaaaaaatgctggcaagtttggcttcactggaaaaaatatttcgtttagttttgctgtttaatgcttgtcatgaataatatttgggattctatctgtttcttcatcttgagccacgactattcctatcaaataagatgcttaggtatacttgtttaatgtgaaaatcctatgaatagttatttctagaaaaagctggtatgtaaaatcagggggaaatttcataaagatgaaattgggctaaatattgtaacatgcataattactattgaataggaacacttcacataacatattttactttatataaccaattgcagctatatagtatgatctatctacttttaatcattaaaacaattatatataaattaaaatgaaagattataatatcaagagtgttctactaattttaggtttataatatgttacagtaaaataccatttgaaataaattttgtgttctaatttatcttaaaatctctctgtttttacatttgaaagtccttacattcttacaaaattaatgcattttctgaaagaagctagcaattactaaaatgatatatggatcattagctaacagtttgaatcaagctgttttagttctataattatacaagaaatttaaagtgaaaatacctattaagcaattaataaaactaggtttcaaaatattggctaattttctcctaatgggaaatgtaaaatagcaaaactgcttcttaaactacacaaaaacctcctcacttctccttttctctctctctaacaccacttatttcctgaaaatcatctaaataaaatatttaattccagggtctgatgaagaataaaagagccaatgcaacatcttgtggaacaccaggactgagaactcttgttgttaccattgcaaagaggcgttctggcgtcagatgcacagtgatttgtatggtggcataatcattggctcctggccaggcattatgtttcagaggacactattgtcaagaaccattcaactagaaatctgcactgtatgcactcaaaagttgagatcatctgccttcctatgacaggaagaattctgtgctggcaattgactcatggactctcttcacatacactaaggcttggtccagtggctctgatggaattaactgtgcagccaaactagtggcattgacaagacagggccacagtctctggggacttcaggagaaattgctaattttaaaatgcagagtattatgttaatgctggattaaatcttcagatacattaaatgtggatttggccatctaagcattattatgttatttgcccagttaatttagaggtagatggatggtgacaataaccatctctacagatccacaattctaagagatggatccaattgtgaaatgatatggagagatagagtaagttcaatctagcatatatgaagtaatttggtaactgacttttcttttaacaagatcaaaagctaacctgctttacactttcatgtctaaggacagccaaccagagagatggcttcacacactagcccactgctaagtgcttttcattcactttcatatttcatcatcaaagcaccctcctgccttatttatagatggggaaacttcaggaagttgagatacctagatatttgcattcctgtcttcctttcttcattcaggtttttctttcattgccacttcctcaaagaagcttttactgattcccatttaaaatagcaactgacttcaactccaccaaaatcactgtattgcccctccctctttccagagcatttgcctatcaaatgttatcttatgtatttacttgtatagcttaattttaaactatctatctctaggtcttctgagcacctgagaaacagagacaaagttgtctcttctgtgtgttgctgttcctctggtgcttagaagacctagaggatcctcaataaatattaactttccaagggaactgaagagcactaatgtgatgctaaagcctgttgccttaaccactatgctataagtcaaatcagttgagaatggagaggaccacaaattattttcagtccagcaagtgttataaacattaattctataaaaagaaaacaattgaaactaatttcttattatattgcatggcaccaaactccccccacttcctttttgaggatcatgagttgtctgtcattgtttctttttattgatatcaattggttaaatataatctggaattggaataaaagaaaaactattataggctttttccagaccatgtatttcaatgcatattattttttcctttctgttcattattctttcagtaattgcacttgttctatttttagtgttatgtaaaattactgtagctcataatttctattttgaagggttcagtgtataaacttagcacatcaatactatctttttagtgttcgcgctcaatggtgtcagttaagagatcaccatcacttttggtgacgtcaatgaaggggtattgcaatgcttaagagaactgttaatccctttccactggtgtcactaacaattgtagtgcttgtttattcatagcaggtacgtgactaagtaatgttaacatcaaagcagaaagaggataatagagtgttctaaaaagaaaattcggtggttgggtgcagtggctcacacctgtaatcccagcacttttgagaggccaatgggggtggatagtttgagcctaggagttcaagaccagtctgggcaatatggtgaaacctcgtgtctacaaaaaatacaaaaactagtggtgcatgatggcatgcatctatagtcccagctactcgggaggctcaggtgggaggatcacctgagcctggggaggtcaaggctgcagtgagacgtgattgtaccactgtactccagcctgggtgacaaagtgagaccctgtctcaaaaaaaaaatgatttgagataacatcacttgtcattgtttgttaactgaataatctttattctagccagtgcctaaatacataataaatgatagtacaaatggatataaattataactaaacctaagtagtgatatttatcacaatatttctttactagaagaatttctttgttaatagaggcaaggctacttgtttagataccttaaaataacataagatttttggataaataaattaatgattctttgattctgactggcatattaaaaatattaagcgaagagatctttgcttcccaggttttattttttgtctaattaactactggtgcatttatattaaaacatattgtcaagggaaaacgtatatatatatatgtgtatatatggtgtgtgtgtgtgtgtgtgtgtgtgtgtgtgcacacatatgctatacttggttgagtagtatccccttcccttgcccacctctctcccaaatttatgtccatccagaacctcaaaatgtggcctcatttgaaatattgtctttccagatttaattaagatataagatgtaaattgatacaagttcatgctggattacggtgggccctaaatccaatcactgatgtcctgataagaagcagacagaacacacagacacacagcatacaggaagaatggcatgtgaaggcaaagacagagactggagtgatgtgtctacaaatcaaggggccccaaggatttggggcccacatcagaagctgggaaagagacaggaattctcagcttctccttctgaatccctaagaaggaatcaaccctgctgacaccttgattttaaacttcttgtctccagaactgtaatataatacatttctgttgtcttaagctacccagttgctggtgatttgttatggcagccctaggaaactgataggtatactaaaatctctaatgaattgatgttaaatatatataagtataggagagttcatttaaattcttctgaaaatgtcttcttaaacttttaatgatacagtatataacaaccagtatacgtagttggtatcgggtttgacatttaaacaagctgacaaaaaacagctgtttaataaacatctgaattatataaaagttttattgtttattattcatgtgaatgacttaaactgacatctacatttagtgaagtgtgaatgggcctagccaataaactatgggtaatttttttaaagtctcatctttgaactcacaaaaaattatcaaatatcagctattatgtattcttcatgtgaagaaaatgtcatatttatttgatttgtggattagcatatatattaatagagcttttgaaagaacaaatgtagcactttcccgatttcatagacactcatttaacacacaagttcatattttaaagtacataattttaaaaaaattctagtccaaatgaatttaagtgccatgacttctaaaaattctgtctctatttttgggttttataggaccttgagccagtactcttctggtgagcttaagaggctaagacttcacctttagttatatggggctttcatctgattatttgtctattttgattgctctaaatacaagttagtgtgtatttcatctgaatgtatttcattataagttttggttttatgtagatctggggatctgtcttgtttttaatcttgattggtctgtttgttttgggatagttggtactttcatttcttatgcttgctttctttttcattttgtgcccacctttagtcaggtgaacatcagtaaggaataaaattttatttttttaagccactgaaaaaatttaaaaaccacatcataactctgcctctgctgactgataaaaatgctaacttattaagacaaaatgttatgcaagaagactttattggaatagagaaacatcctttttatgtaagaaatatcaacagagacatgtgcctttcttgtgacaaatgtggtatgtgtgtggattagaggtctggaatgtggcagcatttcagtacttggaggggagaattagagtagggtagaaagatagacggggagcagaggatgattctcacccagtagaaagcagagtgaagaaagaaaggggaattgttttttgcattatattatttgaactgtggattaagtctttccataagccatccctacgcctctaagtaggttttattaacttaagctggtttgagatgggtttttggtcacacacaagaattgcctgatacaagagaggctttgattttgttgttgcttgctcatttttatacactaagatggagaaaaccctggacatagtgaagacgaaattgaggaaggtgttgggtagagtggagggtagaagacctgtaacataggtacagaattacattaaactggaaggacttatatccagatataggagtcagggtagaaagagagaatgttagcagtaagggtaacagagtagcagaagtttattcttaccaggtcctgttatgtgacagtggaggcatgttgaccttctgactaggggagttaaaggagaacactgaaggtttagaataatgtctctaaggatagaaagagaaagtttcatcaagactcatcaataatagggcagcagggcttagggccaagcaaattcagagaccatgatattatagtagtttgtagtggtcttaatccatctaatttttcagcattttctcaatggccaatacttagcagtggtagtgttttatggcatttggacaacagaagtgaaagcactggtaagagagacgttgaagtgaaacaccatggggctcagaaaagcagagttgatccatctggtacatgggcaaggatggtcctgaacaattctgcagtaagttggaagatagaaaaaatacctaacgaacttgtagatctgggtaaggagatttttggcagaatattgtaaggctaattggcttctcttaactatatgagatagggttttacaagggagagataagcgagcataatttagaagaactatagggggtcccaggcagactctctggctggaaaattattctgatagcaagaaattagccccaaagcaaagatgaaaagtagggtacttccaattaaacatgtcataagggcaagcctcaatcaagagtgtggctagaaggcacagctcacctggacaaaagtgcttctaagcatattaggagcatataccacaataacctgacttggacccaaagttgagagaggccagtctcaaaaaaatttgagggaattgcttttgcataatatgatactttatatacatatctgttacatatcatatatatcatattaaaaagaaaaaaaaccctgtttttccttccgttctttcatataacccttctgacaacaaatgtggagtttttcacacactaagcaattctttagttcttgctggacacttcctggatgtcctacaattcaactcgattctcacacaactgcccagagtcagtgcagacccgcagattaaaggcttagccccaaaagactaccccccactttagatgtcaatcacaagtctcaacttcatttacttctgaaggacgagctatacattggaggaaacccctctttctttcaataatttgctagaatggctcacaaaactctgggaaacatttacttatggttaccaatttattataaaggatataactcagaaacagccaaatggaatagattcatagggtgaaaaatgggggagaggcatggagcacaactctctcagcacctccatgtgttcaccaacccagaagctctcagaactccttcatttagggcttttatggagctttatcaagtaggaatgattcatgaaatactggcattggtgattaacttaacctccagcccctttcccctccctcaacattgggggtgaagctaaaagttccaactctgtaatcacagggtgagcttccctggcaactagtcccctgatccttagggggcttctgaaagtcacctcattatcataaactcaggtgtggttgaaagggatgttttgaataacaaaagatgcgcctttttcctttatctttctgagttgtttcaggagctagggacaaaagactaatactataacaacaacaacaaaaaattcaatttttgcttttatctcttgggaattacaaggattttaggagctctgtccagaagccagtgatgaagatcaaaatacatatttcttattatatcacaattcacacatgtacatgatatccgtaagataagtgaactacataaagtaagctcacaaagtttctgtaggagttttgtccatttacaaacagtttgtaagctaaaagtatctgtgacaagcctcagtcaatttagaagttcatttttccaatgttaaggacatgcctgtgacacagcctcagaaggtcctgatgacatgtgcccaaggtgatcaggctacagcttggctttatacatttagggagacataagacatcaatcgatacatgtaagatgaatattagctcagtccagagaagcaggactactgaaagtggaggcttgcaggtcacaggcagattcaaaggttttctgattgggaattggttgagttattatcttaagacctggaattaataaaagggaatttatcatgcagatgaagctttaggtagcaggcttcagagacattagattgtaaaggtttcttatcagacttaaaagagtctgttctaacagtctttaggtctcagtgttgatgttaatgctggtcagctgtgcctgaattccaaaagggaggagagtataatgaggcatgtctgagtcccttttcccatcatggcatgaactagtttttcaggttaactttggaatgtccttggctgagaggaggggtccattgagatggttgggtggcttggaattttatgtttggtttacaagtttaacattaaaagcctctgtacctccaatgttttatggacaaaaagaaggctgaaaaagctacttggctgtaatcatgggccatttcttgctgaaaagaagaataaaatggaggcagaaccaaaagcccagaggctagagccaagagctgctgagaatgatgaattagggaaccactctcagagagcagatctggatgtgagataggaacattttctttctcagggtctatgaaactggcaacatatgctctcctgaatttcagaattgctatggaccagtgactgtgatatgctttctatatttttcccttttgaatgggtgcatctatcttgattatcctctgtctcattattgtatgttggatttgtgtgggacgataacatgtgtttttagttcctaggttcccagaataagaggagcacactcaaagagcgacatttatgagatactggatttttcacttgatatcataattgggtgagacttgaaagaaagtgaacatattttgcaaatgggagggatgttaaccactgacaaccacacccacagggtccactgtattagcctatctgcaaagacggctgccaaaaattccttctgtccatatatacattcccttttttaatgtgactgtttcacctgccagcaactgaagggctttatttccatttccccttgtgacttgtttgactaacagcaagaagcaaaagtaatgctattccaattctagacctgggccttaagaggcatgacagcttctgcttttactctcttgaaactcaatgtcattttttaaaagctcaggctagactactcatcatgagggaccacatgaaaagagataggcccagctagtttccacccattccagccgctccagatgagatgccagacatgcaaatgaagccatcttggatatttcagccccagctgagcttccagctaaatgtaagtacattcagttgatacctcatagagcggaactactgagctgacttcatccaactcacagaatcataatgaataacaaatcattgttgctttaagtcaatacatttaaagtttttttgttatccagttgtagatgaattatacagcctggggggaaaaaggagatagcacactgttagttgcctcatcaatattcatccccaaattctttttcctttttagtaggtctcacctcccacctggaagctgaaaacacctttcccagtctctctggaagctacagcacaggcatgttgcccaattctaaacaataggacatgataggaggtctgctgggtgggatttttgaaaatatttttttttctggttaagaaaaaagaaatgcccaaggaaaacctacaaatgccccttccattcttgcttttggacattttttgggagagggtatgatgcttagcactcctgcagccatctcggggccaacaatagaatccttgttgctacctggtgatagtgaagtagaaagctacaaagctcttgatttcttttcttttttttttttttttaaattttattattatactttaagttttagggtacatgtgcacattgtgcaggttagttacatatgtatacatgtgctatgctggtgcgctgcacccactaactcgtcgtctagcattaggtatatctcctaatgctatccctcccccctccccccaccccacaacagtccccagagtgtgatgttccccttcctgtgtccatgtgatctcattgttcaattcccacctatgagtgagaatatgcagtgtttggttttttgttcttgtgatagtttactgagaatgatgatttccaatttcatccatgtccctacaagggacatgaactcatcattttttatggctgcatagtattccatgctgtatatgtgccacattttcttaatccagtctatcattgttggacatttgggttggttccaagtctttgctattgtgaatagtgccgcaataaacatacgtgtgcatgcgtctttatagcagcatgatttatagtcctttgggtatatacccagtgatgggatggctgggtcaaatggtatttctacttctagatccctgaggaatcgccacactgacttccacaatggttgaactagttcacagtccaacagtgtaaaagtgttcctatttctccacatcctctccagcacctgttgtttcctcactttttaatgattgccattctaactggtgtgagatggtatctcattgtggttttgatttgcatttctctgatggtcagtggtgatgagcattttttcatgtgttttttgactgcataaatgtcttcttttgagaagtgtctgttcatgtcctttgcccactttttgatggggttgttttttttttcttgtaaatttgtttgagttcattgtagattctggatattagccctttgtcagatgagtaggttgcaaaaattttctcccatgctcgtgggtaggaagaatcaatatcgtgaaaatggccatactgcccaaggtaatttacagattcaatgccatccccatcaagctaccaatgactttcttcacagaattggaaaaaactactttaaaattcatatggaaccaaaaaagagcccgcatcgccaagtcaatcctaagccaaaagaacaaagcttggaggcatcacactacctgacttcaaactatactacaaggcttcagtaaccaaaacagcatggtactggtaccaaaacagagatatagatcaatggaacacagcagagccctcagaaataacgccgcatatctacaactatctgatctttgacaaacctgagaaaaacaagcaatggggaaaggattccctatttaataaatggtgctgggaaaactggttagccatatgtagaaagctgaaactggatcccttccttacaccttatacaaaaatcaattcaagatggattaaagacttaaacgttagacctaaaaccataaaaaccctagaagaaaacctaggcaataccattcaggacataggcatgggcaaggacttcatgtctaaaacacgaaaagcaatggcaacaaaagacaaaattgacaaatgggatctaattaaactaaagagcttctgtacggcaaaagaaactaccatcagagtgaacaggcaacctacaaaagctcttgatttctaatgacatcatatgggatgaaccaacccaggaacagcctgactctggacctcttttaatgtcagaaataaaatcttatttgtaaaccactcttagttgttcaggttgttgacacaggcactgaagtgcctccaaatggtgatgaataatgaggcaaaagtcaaagacagcaagtctagtgtcaaattttttgatgcctatgggtaagaagttcaagaaagtgagctattttctttctttttaaaatttatttttatttttgtgggtatatagatgtatacattagtcagctattttcaatagtgagaagggatgttgccacttagtataatgcctttttcatagctatcatagaaaccatatatacatatagtatagaaaatgaggatagatttctgacttaaactgcctatttcatttgtgtgcctggttacacctaattcaagactctacaatacagcattgctagcaattactgtgagaatatttcaagctccctatttgctggaaatacatttcatttttttgttccaagtttatgaatattagaacctatctaaaaaggagcttttaaaaacttgaggaaaggaaaagggagggcctacttttcttgcctgtgttatttcttgttactgctgattgagatgctagagatcatattgggtgagatgtgtcttagaatacagctgagcaattcacttttaacagtttccatctgagtacaaaaaactggtatgtgcagaaaacttgatattctgacttggcgggattctaggatttgttctatttttttctgtaattgttgtagggacatatggccctgtaccttttgggcagcaggagccagaatagcaggaacattctgacaaaattcccactcagcatgagagggaagcagtccccttgatacactgatgatgtgcccacttagcattacaagtgtttgagaggtggacacaactaaaactcacctcactcaaaatatatattgacacggagaaagtaaatacaatttgctgttattaacctttcttctcaccattgagacatgttaaatatctgaaattaataaaggaattaaatttaaaaagtttacttatcatgcatttaacacatttattgagcatctgttatataaatgcactgtttcaggcacaagagatagagccataaataagcagattaaatcactattctcaactgaggtactaatctgatataagagaggagacagaaataagtaaacattataaatcaactacatacttttacatggtgtaaagtgcaattaagaaaatattattgaatagaggtcaattttggaatggttgggcagggaagaccttctgaggtgacaagaagttggcctgggcaccatggggagctctaccatggtgaaaagtgttccagacagagtagacagcaacagcagaggccctaaatgagaatgcacttggcttatctggagagtagaatgaaggccagtgtggtaggacacatactaataataggagaaaactgatagaaaagagggtttgagcaggtgggcaggaattggacaacatggtgtctcatatgtcataatagaagtttggattttattctacctgcagtgagaagttcttaataaaaaaaaaattctataaactggagtttgagaaagaactatgttgatgatagcataagccctcaatcacttgtcacataaactccaaacttcagcagagactcagggagatcaaagggactaccacaggattacccactggctaaaattcagatccatggcagttggtcctgactggaattagacttccttgtctgttgccctcattgcagtgggtctgaatgtctctgtcggctgtgaatttttctccctctatctgtggcactgagaaggtggcccagacttccagagtctgtctcattggcctattacttggggatttgctgcccttcttctggaagtttgggtatttgttttcagagcatacttaaaggcctcctgaaagcaatgttaacaatagcaggatatattttacagtcttctactcagacttggatttttaagaaccagggatggagactgtgtttccagatctagtcaaatcccttccaaacataaagcaacaaagtgccttttaaactaggacctgtactgtttaatgctctggaaacaaatacccaagcttcagccaaaggagggaaagctatgttcaggaagcttcctgaaagttttttgaaagcaattttcatgcattagtattttacatatatatatatatatatatacacacacacacacacacacatatatataaacatatatatatatacacatgaatcactaatgagacaattgatcttcaggaactaacgtgaaataattggggtatcttggtattattgttatagataaatgttgaagaagttcattctttcagatattaattgagcacttactgtgtactaagaactgtgatagatactggggatttaatggtgaacaagataaattctctgccatcagggggcttatattctaacaaacttaaaatttactgagtgttctctgtatttcagtattgttactaagtacactaacttagtggggaagctagacaataaacaaagaagtatgtaataagaattaatagtaagtgctgtaaagaatactaaagcaggttatggtagagagattaatggcagcgtgaagatgtccatgtttcaatccccagaacctgtgaatatgttaccttacatagcaaaagaggctttgaaaacataattaagggttatctgggcaggcccaatgtaatcataagagtccttatctaagacgggggacaaaggtcaaagacagaggaaaagagacgatttaaggatagaagcaaagaggagagatgttagactgctggctttgaagttggaaaaagtgaacatgagccaaaacaaacaaaacagaacaaaacaaaatccacaggtgacctttagaaaaggggtccccagtctctgggccatggaccagtacctgtctgtggcctgtttggaaccaggctgcccagcaggcggtgagtggtgactggtggacaagcaagttttaccacctgagccctgtctcctgtcaggtcagtggcagcatcagattctcatagcagcctgaatcctactgtgaactgcacatgcaagggatctagtttgtgctccttatgagaatctaatgcctccaaaatgctcaccccttcaaactgcccccatccgtggaaaaactgtcttccacaaaaccagtccctggtgccaaaaaggttggggactgctgctctagaagccagaaaagaggagatatattttcctctagagcctacagaaggaatatataggcctgctggcaccttgattttagtcctgtgaaactgattttggatttctgacctccagaaatgtaaaacaatgcattggttttgtttcaagtcactaaatttgtggtaattagatacagcagcagtaagaaatgaatacacaggtttacaggatggtgaattatggagggtgctcaggaatggcctctttgaggtggtggcctttaaacagaaaaatgagcaaagtgaaagaatgaaccatctggtggggagaaaagcattccagtcagagggaacagcaaaagcgaatgctctgagaagggattattcttctcaatgtgtttgaggactggcaagaaggctttgtgtgaatgagcaaggggaaaaagttagtaggtgatctcggagacatagccagggtccagattataaaggacctctcgccttgctaagcattttgactttattccaagaataatgggaagtcaatggaaggctgtgagcagggttatatgctctcgttattttttaaaggcacaatgtaactccaaaatggaaaattggctctgggctggaggtgccagcacaggggaaaccgaaagcagagagctgggttgggagagcggagactgaagttgtccagctgaggggtgcagaagtgcagactgcaatgacagcaggcagaaaggactatatgttctagacagaatggacaggatttgctggtagattggattgaaggcatgagacaaaggagacatggatgatatcaaggattttgatactacagatttgaaacattctgagagggacaggtttgtgatggaaaatcatgagtctggttttagatatgttttagaagcttattggacagccaagtagagatgtcaggtagggagctggacataatacctaaagttcaggagagtggttggagctggtgacatcatttgcagaaccctggatggtacataaagcacgggacagtgtgtggatagatcctaaagagagccctagggcactccagccctggaagaaggcagcttatcaaaggaaaaagaaagaaagaaggaaacacaatccttattacttccatcttcaggacaattcaaagccagtgtttttgacttcctggcttgagtgaagcttgaaaaatggcaacttgcccctttgcaaagctcctaaggagtagccattggcttggcctgtttgcactggctctgggtgagcttttaaaatgccagtgagctctaattgtgttgattgcctaacagctgtgaatacaagatgctgactccagaactgcaactcattctgcgaagggcaccgtccttttccctctaatgactgctgaacagagccacctgaagcctgcatggggtttagcagcagctgcacttctgctctaagaaatagctcactgcagtcagatcaaactgaagctcttccttgcttttcctcgaagcttgggtacttattgtcggagcattaaacagtaagagtcctagcttaactggtgcacagtgctttatgtttggtagggatttggttaggcctacaaaccgtctgagctaagaaccttgagaaactcctgctatagttagctctttctgtgactctgcagtgtgaccaggaatgaggacagaattaagaatttgctgcctctatgatagaactgtttaggcactagaacactggaactagatctacaaccctatgaatttaatttccttttcaactcccctactccttcttttcaatatgatgataatgatcttgtttaaaaaaaaaaaaagccttctgctttacttcccactctgctcctcttcccagggactcactttcttcttgactgcttccccattacaagtactcagctccctgttttatcaccctgcttagagcagccattatcagccttggctgaacattggaattacctgggaacttttaaaaatccggaagtctgggtctcgcctccagagattccagcttagttgtcttgagcgtggcctggacatttgggttttcaaaagttccctatgtaactttaatgtgcaaccacaattgagaatcactagcctccagactctctgtgttatcaaaattaatgagcagctgattttagaaatctcagttatcaggagaaaagggtgaacccccccagggctcttctccttttccaggtgacacttctttatggcagtgcgtgaaagtgaagccctgctgcttgtaatctccctcaagggagtgcaagatccaggcaaagacaagactgcagaggcgctaccttgggggaaagtaggaccctaaatacttacacctggaggcacttacctttaatactgaatttgtcagatgcaaatttgtctatgcaaaccagggccttatctctagcttcccctcaggggttttgggaagtgcgctactactctgaaacagggttgtaaagcgtcacctgtgctctccagggaaccctctggaaaggaggtggaaaaacagaggcttccacccttgcaactctaagtgtgttccttggccagtgggatccatcacctagtattttcttagatatgtggtatctgggggccagtcccacacctatgcaataagaatctccatttgaacaagatgcccaagcgattatatgcaagtttaagattgaggagggctggtttaactcgagggtaacgaaaagtacgaaatcgtactttacaggagaagctaggcggagggagccacttattcttcctcttgcagctgggtctttttgtggtgagtggcgaagcggcgaggctggcaggccagggtgctggactgggtcaggcgcggccccgcctccctcctgggtccctgccctgcgcgccgttgctgtggcagcgctggacgcggctagagctggggctgccgcgccctccacctccttctccaaaggcctccccggacccctggctcgggcccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgagtgcccggccccaagcgtcttcgcctccctccgcgcttcctccctctccccggcccaaggcctacacccacgagcttttgctccaccctccccttttctcgcctcccctccccgtgctcgcctcactgcccggacaggttaccgagtccccaagtcgccgcctcctccttcccaactgggaactcacgcctctcgccccatcccagaacccccagggattctttcgctacctagccttttcccgcctccgagaccttccccgggcaaacgtcacaagcagcttttgctcagagtctcagcagaaaatcttgagccccaaaggggaggtaatttacaaatgtgagaaggtcaactactcctcccctccaagttgaaaaagttttaatccattaactttgatggtacattgaaactataaacatctcacagattatgcctacacaagagttctgaatccaactctcattttgctgacttgaaaatgtaactccagagctttgggagtgtttctgggtttttttctgcccctcaccttccttgccattgtctagaattaagacttcttcaggctcggtctagaaacttttgatttttaatattgaccctagattattggatcacagttttgcgatgcttagttacgtcaagcggtttgcttaacgtttgccttttattgacttaaaattttagttacctaaaaaagttataatgctgtagtttacaacaaatacttcgagtctattttcacgtcttagtcaaatagccttatagacttaacagatattttataaagaccattttgcaagtcttataagtagactttcatatagtcttatttctaagtccaaactcgagaaatactccccattgttgaattagcttagatgtgagcggtgaaagacagatgaaatgggggaggaactacatcaaggttactctacttgcgaggagatgacttgggggagatggaatttggtattcaacctcttttagctaaatacaaatttatgaaattaaaaaaattgccttcccctgttggaaaacaagacacagtgtggtatttatgttacagaatagactcactgtcttaaagtcttgctcaaaagtctaacaaaatgaaaccaactagccagggattcagcactggttgcgattgtgaattctgcctgtgctgcatgtgccatgctcgctcgcttcacgaaaacagtctttgaccttaaagtgttttcaggtgttttaaaaaccaaggtgtagtattttcttgaaccttttaagttaaaagctagggatatagctatggaattatttgtaagtctttcaggcaattcgagttatgcaatatagaagtttataattacagtttggattagcccaaagagccagtttaacctacagtgcagctgaaatgctatagaattaaaatgagacattgtgcaatgagaggtcatacaaaccaatgttgcagtatttgtgtacaaaaaaagcaaacaatgacatgagaaaagaaatgctgttttatattgagtggtgattaaggtaaaataggtttaattagtgcacccctggcagtagagtttaaaatacatcttgacagatttgtaactttaaaggttgcaagtactgattctttgtttaattatgccctaaaaccatttggtggtcttttccttcatacaggtgtaccctttttctttgtaattaatacctggtattcaaaccactttgggcctctaaaattgggggcacagaagcctagagccttagtaagtacttctgtttatggaagaaaccaagagatgttttatttaggtaaaatatagccaggcgtggtgtgtccctgtaatcccagctacttgggaggctgaggcaggtgaattgcttgaacctgggagttggaggttgctgtgagcggagatcacaccactgcactccagcctgggcaacaagagtgaatctccatctcaaaaagcacaacaaacaaacaaaaacaaacactgggaaataagaaggagatattaagagatgatatatttaaatgttagaaatgctctgttgttgaataagcttagatgtgagtggtaaaagattaaatggaagagggagctacatcaaagttactgtacttgggaggacatgatatggtaggatgtggtggggggagagcatgtccattgctggttggcaagtgactggctgcctcagaaaaggatgagggtgggtaggggagatcactggagattattagaacatacgtatgttttcaagattgcttagtttttaaacctcatagtactttgttttcactgatgaaataaaatactatgtgatctttttctaattttccatcttgagtaataagcaaagacattaatgtattttatgaaggctctgactgccaaaattgggacaaattgatggtcttgttggcagggtaaatgagcataaccgtagtaattgtagttctttttattgggttcagggatgacctggaataatggatgtgttattacccttccctgtagaagtgaggctttcgaaaagaggctataagtcaatttgggaggcacaaagtatcagcgctttttggggattttttttttttttaagtagagaaatattttaaatgtgtgatataaagttatgcatgtgcttcttaagcacattaactcaaccagatccaacagctggtctaataactttttaattgtttaaaaaaatttaattgacacattgtaattgtatatatttatgagatactatttgatgttttgatatttacgttgtacaattatccaatcaaagtagttagttatccttcacctcacactttcattatttccttgtgggttagaacattcaaaagactctcttctagttattttgtaatatatagtattttactgttaaccatagtcaccatactatgcaacaaaacaccagaatttattcttcctacctagttgtaactttgtgtcttttgactaacctctctccatccttccttctcccctccccttcccagtctctggtaactattctaatctctgccttatctatatcaaccttttataatagaaaaagattctacatgtgagtgacatgtggtatttgtctttctgtgtctgggttacttctcttaacacgatgtcctccaggcttagcattcacaattgacaggactttattttttaatggctgactagtattccattatgtttctgtatcacattttctttattcatccattgttgtacgcttaggttgattccatatcttggccattgtgaatagtgctgcagtaaatatgggattgcagatctcttcaacatactcattttatttcctttggatgcatacctggtagtgggattgctggatcatatgatacttctatttttaattgttttaggaacttccatgctgttttccatattgactgtactagtttacaatcataccaccggtgtgtaagtgttcccttttctccatatctgtgtcagtacttattttcttttgtctttttggcaatagccattctaactggagtgaggtgtatctaattgtggttttgatttgcatttccctgatgattagtgatgtcaagtatcttttaaatgcacctgttgatcatttatatgtcttcttttgagacctatcaattaaagtcgtttgcccatttaaaaaatcaagttggccaggcacagtggctcacgcctgtaatcccagcactttgggaggccgaggcgggcagatcacgaggtcagaagatcgagaccatcctagccaacatgatgaaaccccgtctgtactaaaaatacaaaaattagccgggtgtggtggcacatgcctgtagtcacagctacttgggaggctgaggcaggagaattgcttgaacccaggaggtggagattgcagtgagccgagatagtgccactgcactccagcctggtaacagagtgagacttcatctcaaaaaaaaaaaaaagtcattattattttatctgttgaattaattttcttatatattttggattttatccctttgtcgcatgtatagattgcaaatatttttctcccattctgcagctgttttcactttgttaatagttttcttcaaggtgcaaagttttttagtttgatgtaatcttattttgtctatgcttttgaggtcttattttaaaaatccttgctcaggtcagtgtcgagaataatttcccttttttcttgtaatttcatagttttcaagttttacattttaaatctttaatctatttttatttttgtatatggtgagagggaggggtttaatctcattcttctgcatgtgaatatctgattttcctagtaccatttgttgaagagactgtctttttcccagtgcatgttcttgacatcttaaaaattcagttggctgttgtaggtgcaaaaatttatttctgggctttccattttatttcatgggtctgtctggttttatgctagtaccatgctgtgttgatatagttttatcgtatatttcgaagtcaggtagtatgatacttccagttttgttctttttgctcagggttgctttggctatttggggttttttttgtggttctgcatgaattttcagattgtaacatttctgtaaagaatggtgttggtattctgatagcaattgcattaaatccatagatcactttgggtagtatggccattttaacaatataattatttcaatccatgaacatgtactatcttcccatttattgatgtgggaagataatttctttcatcaaagttttatacttttcagtgtagagattctttcacttccttggttgtttatttctaggtatctttttttttaaaaaagtactataaatggaattgttttcttgatttttcacatagtacaatattagtgtatagaaatgctactgatttttatatgttgattttgtgtcttgcaactttactgaattctaacagttcttttgtggagcattttgggttttctatctataagatcatatcttctgcaaacagggacagtttgacatgcttctttctaatttggatgctcgttacttctttctcttgcccagtttatctggctagaactttcagtagtatgttgaatagaaattgtgtaagtggccatcctttccttgttattgatcttagaattgatctcgttattggtcttttcccattcagtatgatgttagctgtggatttgtcatatgtggcctttgtgttgaagtacaaactttccatacctaatttgttgggtttttaatcatgaaattatgccacattttgtcaaaggcttttaatgcatctattaaaatgatcatacagtttttgtctttgttaatgtgtatcacatttactgctttgtgtatgttaaaccattcttgcatgcctctgatcccagtgatgaatcgcacttgaatgtagcaagttatctttctaatgtgctgttggatttggtttgctaatatcttgagaatttttgcacctatgttcatcagggatattgtactatagtttcctgtgttgtattgttatctgattttggaattagggtgatgcttgactcatgaaatgagtttggaagtattccctttgcttcagttttctgaaatattttgagaggaattgatattggtttgttaaatgtttggttgagttcagcagtgaagccattcgtttctgggcctttctttgatgaaagactttattactgattcaatttcctcacttattattggtctggtcagattttatgtcttcctaacttaatcttgataggttgtatgtgtcggggacttcgttttttctatgttatcaaatttgatgaaacttgttgaaaaccaactctaaattttgttcatcttttgaaattatttttagtctctatttcatttatttctcctctgagttgaattacttccttacttctaccaactttgggattagtttgttctgttcttttttttctttctttctttttttttgagatggagtttcgctcttgttgcccaggctggagtgcaatggtgtgatctcggctcaccgcaacctctgcctcctgggttcaagcaattctactgcctcagccttcctgagtagctgggattataggcatgtgccaccacacctagctaattttgtatttttagtagagacggggtttctccatgttggtcaggctggtctcgaactcccgacctcaggtgttctgcctgccgtggcctcccaaagtgctgggattacaggcatgagccacaatgcctggccgattagtttgttcttaattttgtagtgccttgaggttcatcattaggctgtttgtcagaaatctgttgtcttttttgatatgggcatttaatactataaacttacctcttaaaactgcttgtgctatgtttcgtaggttttgttatggtatattttcattctcacttgtctcaagaaaaattttaatttcctttttaatttcttcactgacccattggttgtttaggagcattttgtctccatgatttgtgaagttgtcagtttttctcattgttgatttctagtttatttcttttctttctccttccttctttccttccttccttccttccttccttccttccttccttccttccttccttcctccctccctccctccctccctccctccctcccttctgtattgctttgtctcccaggcccaagtgcagaggcacgatcttggcttactgcaatctctgcctcctgggctcaagcaatcctctcacctcagcctcccaagtagctgggactacaggtgtgtgtcactgtgcctacaggtgtgtgtcactgtgcctggttaaatttgttttttgtttttgtttgttttgttttgtatgtttagtagagatggctttcgccgttttgccatgttgcccaggctgttctcaaattgctgggctcaagcaacctgcccaccttggcttcccaaagtgctgggattacagccatgagccactgcacctggcctgatttctagtattataacgctgtggtcagtaaagatacttgatattatcttaatcttttaaaatttgttaagacttgttttgtggcctaacatgtgatctctcctcaagaatgttccatgtgcatttgagaagaatgtgtatctgcagctgttggacggaatgttctgtaagtgtctgctaggtgcatttggtctatggttcagcttaagtccaatatttcttgatctctctgtgtgtgtttgtgtatgtatgtctagataatttattcattattgaaagtgggctgttaaagtctcttactattattgtattggagtttatctctttaggttgaatatttgctgtatgtatctgggtacttaggtattaggtacatgtatgtttataattgttatatcctgttgttgaattgatccctttatcatattatgaccttctttgtctctttttacagtttttgacttaaagtctattttgtctgatatgagtattgctactcctgctcacttttggattctgattgcatggaatatctttttccatttcttcactttcagtctgtctttaacggtgaggtaagcctcttttaggcagcatgtagctgagttttttttccagtcctgcagctactttatatcttttcattagataatttatttacattcaaggtttttattgataagaacttatttctcccattttgttacttgttttctggttgtcttgtagattctcagttcttctttctctcttgtttacctctgtggtttggtcattttctgtggtcctaagctttgttttccttctatctcttgtttatgtatctgttgtaattgctttctttgtgggtaccatggggctaacataaaaagtcttgtagttataataaactattttaagctgatagcaagttaactttggtcacataaaaatactctagacttttttcctccgccatccctaatttatatttttgttgcctttatttctttagtatgtgttccctagccattgtagctgttgttgtttttgaccagttgtactttaaaccttcatctagaggatcgacaggtttacatagtaacatgatatcactggggaattctgagttggatttatacatttacctctattggtgaggtttatattctcacatgtgttcatgatagttatcattttttcatttacagctgtagcactcctgtaaacattgcttgtaaggctggtgtaggagtgaattccctcagcttttgtttgtctgggaaggcctttattctcctccaggatagttttgctggatatagtatcttttgtccttggccgagactcgtttttttttgttcttttagcatcttgaataaattatccctttctctcctggcatacatcagtaatttaatgttactgatgagaaatctactgatagtctaattaggattcccttacatgtaacttgatgcttttctcttgcagattttagaattctctgtcttcaacttttgacagtttgactataatgtgccacagagagaatctttttgggtttaatctaattgggaatctttgtggttccttcatctggatgtctatatctcccccaatatttgggaagtttttagctattatttcattaaataggttttctgtgcctttcttcaacttttctccatctgccagttctataatgcaaaaatttctttgcttagttttttttaaactttgggttatttcacaaaacctattttcagattttgaaattctttcttctgcttgatctggtctattcttgaagctctcgattgtgtcttttattcactgcattcttcagatttctgtgttttaaatgatagatcttgttttaatttctcattttataactttcctgatttcattgggttgtttgtattctcttgtagcctgctgaatttttttaagatcattatttttaattttgtttcaggcattttataaacacccttttctttggggtctgttactagagactcactgtgttcctttggcagtgtcgtgtgtccttgctttttcatgtttcttgtgacatctgcacatctagtggaatagtcacattttccagttgtatgcagtagctttcacagggagagacttttcctgtagatgggtcctagagtgttggttgggtatggtacattggctttggtttggggtggattcagtaccatggtctctgtgtagtttcgtcagctgtaatcttcacagcaatgtctgatttcctcagtggcctaggctgcaggagtttttgatggtggtatagttttgctagggacaggcatgtcatgctagttgtcaggctggacacttgcaggctcggagggctgacaagctgtcttttgggctccccagggaagagaaagtatgattttccagcttttcttctatgtttatttaaaactttgttgtctggctcacagtgttctttatctaaagtctagccagtggtggtggtcatattgcaatcattattacagcttcagactttctagaccttttccattttagtgaccttcagccttcattcgcttccattcatgaccacagaatagatgtagtcatctctattgaaggcaaacccatcccatctcttcagcttcatctagaaatttgtttcatctgttacactttctttctttggtttttagccttcattctctaccagctctttcacttaagcagagatatgttcaagactctcccattctaacagttccctgccttgatcctacaagcttttctctttagctgctaccttgctttttatttttatttttttctcacttgctctgataatctcctagaaaaattggcttactctgaccatctccattagttcacctcttaattattcttcaaccatctgagacctggctttgttctttctctactgaaactcttcaggcagagattagcagaagtcttctaattgctcaatgaagtggaaattttcagtccttattttctgtatttctccttcatttgactttgacttaactctcttggtttttgtaataccaccagcacctagtttatcagtctctcatgggaacttcattctatctgcctgccaaatggtggagtcccaaggactgtggtctgatctgctgttcctcattacatgctttctggtcagtattgcacactgtggttctcatctaccatcatctacctccagaagtgccatatatttagtaagtttacaagaaaagcaactttccttgctccgtagactaactctgatcttttgttccctatcatggttatggaactcactaattattcagcatcagctgtcagaatgtttaactttgctatttaggtttgtgtaagttatgggacaataactaggataactagaattagcttgtagcttatgtgggttagataatacaattgcatatgtaagtagtgaatattttggcttaataagtgaaggagtatttaggaagctatctggaatgttatctaagtcaggattctgaaggtaactctagcctcactgtcccttactcactatttctaaacacccaccaatcctgcctactttatttacttggtatttctccaatctgccatccttctctgtccgaccaatcactaccctagctcaggccttcaaagtctctcacttgacctactccttcacctcctttgaacctgtgcacaaatgttagcttcttagtaaggctttctctggtcacctgtataaaattcccatctgctacatacttcctggttccctgtattgccttatattcctcagtggcatttatctccttgtatactatataatttctgatctctgtcctttctattaccaccccacttcaagatggcaaggatttgtctgttatattagtgactgtcctaataggaaaaaaaatggcacatttatattagagtaacttgagaagaatttttaaaagtcagtatttataaagctgtagatatagagatagtgaagtactcttgggactagtaatcattgggcaggtgataccatttttaagcccaaaagggcatagtgaaagagcaggtgcctgaacctggattcagagagactatgtagaggaggccactaggcaggagctgtggcctttgcctcagcttggctgattacctcactaatcctcactaatcctaaattacccaagttccttcttttctggcccatttcacagtccaaagccaactttaagccagagggcaaggggagcacttgatgcagtccatgcagtatggcctcccagtgaacagggcaggtggaggatagaaactaaatctagatggaggagagggaagatattcagaatatgttttttctttactgtcagcaccttgaagagtgcctggcatatagataatatttattgaatgaatgaatttgttactggtttactggcctcatgaactttagttttgcctattctattataacttggtgactacattcctatatacttgataccaactcctcattaactacaaaggcagtattcccctctccccctttttaaacatcaaaactcttttttaaaaaaaattcttaaatgaatcgccagtatataacacataaaagtatgggtgccttgattggagtggtgggtaaatgatcctgagtctgtctgtttgggttccctctttgcctagcaggaatgtgactgtcttgtttaaagcccactgaagtagaaaacaggatgagagacacactcttcaacatggcataagatttccatgcttggctcctgcctatctctgcatcctcatttctcagtagtttcctcatattttaccatcctgtaattgaaagaattacaaaactagttctctacacaagctttcttgctgttccagctgctgggaattagcttcctttgtgcttttttttatttgaatgattcatgtttacattcattaaaattaatgaagattcattacagttgttttctctttaggcataattggatctcctatactgagacattgaatgcaactttgattgtttttttcccccattatatgttaagctccttgaggttcttttcaactttgcgttattccaggatttctatcgtaagagttaaggttcatccacttctctgatgtgaggttcatggcaggaaggttccatgttgctcagctgcagagtagaaaatactgagcagggcttaaatagattaggatgctgccattataatataaactgtgtttacgaaagagcatcatcaattcagaaaatatctttttcattgactacagtggtgcctgatgatctttctattacaatcttaaattatggtcattttaattatagaatcatacatgggtttatttatgttaaaataaggtaattatcaagctagctgtgacctatgagaaaaatcctgaagaaatgatgaagggatcaggtgactgtttttgaagtcaagtgtgaaaggtcagaccactctgggtcatgggaccctgccaaggcagagcaggtcaagtgctgtgcccagtggggccaacccccagtatggtgccagggactgggtgtgagaagtcaaaaattaagaatacacctcagaaaggggacatggacagatgccacagacttatttgcgtatttcatgatttagcccttagcttgtgctgatactggatcagatattttcagagttcagtattttcaaaagcatcgctgatcacctgttggcattgttttacatctcaaccaaggaaaaacttttgggacatctgtttaacaaggggtaagcttttatttgaaatgttcgattaaagcagaagagtcaggcatttttttgtgcctccccaaagaaagatttgtttactgtcctgtgtgaataaatataatgtcattatttcccgtaaaggaaaagctgatggggagagtaagtaatgggtaagattaggcaatgttaagctcatatattagtatgtttaagagtgatcaatttagggatctctgtgacagagatgccaaatgctcacagtgctatctcatgttggaaacatgtgtctcctccacttttcctcagtcctctgaaatgacggccctttagggattgacagatactatacagatttctgtgctgatatgtgatttgtctaaaacaaaagtttcacaaaacaattcttaccattgccatttaagagtcactctgatatgctctgtttccattgcaaacaaatgctcattatgatttgtgaaattaacttcacaatttcctaatggataacaccttgaagtatgaaaagcactacaggatcttttatagcttccctcctccagctctctataatctgctcccatctgtggtgtaggaaagatttcagcagtggccgctgaaggccctaagatcttgtctcaacagatagcaaggtgcataacagactttggacaggttgtttaacatgtctgagttactgtttattcactggcaaaatgaagggcttatattatattgtctctaagtactatcagttctgaccacctatgaactttcattttaaagaaaatacctatttctatggcctttaggcattagggaattttgtcaaattaaataaatctcagtaaggtttgatggtcaatggggcccactgtctggtgtgtgtggaggggtgttgtattttacatcaggaacttcagagccctcatgaatttctaattagaggaaccacctgggaaatataagtcaaagccctttgctcgccttactcagctttagggcacagtgactagaggtgggcaatcgctttggtgtaggtattgtcattggaaaggaagaaaccattttctggaggaaaagaattggttgaggctagctttaagcagctatttcatgatggacaaaaggactagctcatccattcttcattcgtttctctgtatcctctatcaaatttctgagtaaagattttatacaatgcttgattagcattcaaatagtatgtttcaaagattttaaaaaaaataaaactaggcctttgaatcataattatggcttataactctatttttcatatacttactatctcaagttacaaatttcatgttatgtttttttcaaaagagtattcctgccacaactcagagctcagctgaattagagcagtgactagaaaatctgagaaggctgagcttcaaaataaggtctggaaagtgtttcttattgttacaagagagtcaaaatgattttcttgagctttaagtttatgtaagtatttacttgacacttagcagtttaaaagataatgtgcaaaaatatgaaaatgagaaaaaacaatttcaaaacaagagttggtgattacgtgagacttagtagagcaaagtatattctaagtattaatctgtctaagctgtttgggaacagatgtacgtgaaatggataccgggtgttctgttgtgtacaccccaagtgagacatctgttggtagactgtgtggtcagaaataatggaagcaggggttaaaccccaatatgacctattactcatgtgaattattgaaggactaattactcagtaaaacatgatgctttgattcatcagtctacacgttaagaaaaaagcctctttagaaaaaaatttagttctgtttctaagctgtcaaatttgaggaaatttttaagatgtatgcaaagactcaaatttccatagtaactgcaaatactatctgcttataaagttttaaaatgttttgacaggtctactaatttatcataaaaatagcctcaaaagttttagctttttgttagggtaggttgggtctcacagaaaacaaatgtagagtgaattttctaaagcagggctgtccagttagacttcctgaaatgatgggagtgcactatatctgaagtgttcaatacagttaccaccagctacatgtggctattgaacagaaacatggctagtgtgactgagaaactgaatttttaattatatttaatttttattaatttgaattcaataactgcatgtagcaagtggcaactgcattgtacaacacagctctgacacatggagagttgaaaatgtttgtttactttcttcccaagttttcattttagtctttgtttctacatagaaaggaagatatagcttttgaaaaatgaacctgaatgtagaactgatatggttatgcaatttgagctgcctatttaaagataaagcaactgagtttagagatttcaaagtggcagagtcctttaacatatttcgtgggctggccacggtagctcatacctgtaatcctagtactttgggaggctgagatgggaggattgcttgagcccaggagttcgaggccagcctgggcaacatagcaagaccccatctcagggaaaaaaatatgtgtatatatatgtatatatatatatatatatatatatatatatatatatatatatgcatacacatatatacatatatacacacatatattaacatattttgtgtgtacaaaaaatatttttattatgtgtagattagttggttactagtaaagttgaagtcttgtctatagaaatcattgtatttttcatggtcattgtgatacattgtttgaactgaaatttggcaaattcaatctgtttcttactacaagaatagtacatagatttgaaatggtaactctcttagtctgtgtactctgaccctgtgaacgtctggagactaatgttattcctaaatatgctatgtccacatggcagcatctgaaggcaaacactttttaaaactgatctacttttgtggacccttcctctctctctttcctgcatcccggatggggccctctggggctggaactggcacagaactattcccctaggagtgggttcattgaagccaagggacacacaaattgagaatcagatagactggaccaaggtcattaaaccagagagggcaatccagatggggttgtccaaagtaggaagttctgaagtgaattgcagaaatccaaacatggcaaagctaaaggaatagagaaccagggcaatggatatagagaacagagcaattgggtatgcaggaagatgctattgcctagactggatgtttttgtaccctctgtaatttgagaaaatggaccgtccttgttgaaatggtcagggatgtagtagataaattcattgcagttgtgtaatctcagcactagaatactgatcataaccatatcacttgttatcccacctagcctgccacttgattgggttattagattacatttcagacattgacaagtctacaagcatcattaaaatcctaaacacagacttctgaccgtattcctacccaagttttagaagcactatgccaatgacgggggtagtatatgctgagcaggtgagttttgattgtgtgtgtctacatgtgtacgtgggtgtggtgagcaacaggaaggaactctcagccatgactctaaatgctcttgtgttggccaaaattggtataagctaggaggagaaacacaaaggagagagaggcatgaagttgaaggacattaaaccatttgcaaacttttggcatgcaaaccagaatatgaggaaacttagtgtaatgggtgactgaattcagaggtagacaggcaatcaggaaggtataggcaccaaaaatagttaccattggtgagcgtttttgtttttgtcattggcatggtgttatgaacttatgttaagcctaagggtaagtctaaaataatgtaccagctggcatcagggaattcccatgtacattcctagattttcattagaaacagtgttctggaaactaccactgctgctacacagcagtgcccagtgcttgactgaaaatagtgaacacttagatttgtttactctgccaggttctgtgctaagtatcttatcttgtttaaccttagcaaagaaactatgtagtctagatagaatttttatccctagggcccagaggtgttaaataacttgcccaaggtcataccagtaatttcagttgctggggttcaaagctaggcagtctgactccagagcctgcactgtccccatttggttatgttgcttccccagttaagcaagcaagagtctatctgacatctgagttggtggtagtaaagcatcatggtctgaaccaaaataataaaaacctttgaaacaacattatctgacttctttcaggcttttaagacagttccatcatcaacagcttattccatttctctggccacttccagtttctgaacaaatgaagaaaatgggagtgataaattggagtttttaacaagtttttttaaatctaattttttttatggaaaccaccaaacatacccaaatgtaggaataattatgtaataagtcctcatgttcaaccctaagaggggtgaagctctatgtgacccattactgagtttaaacagttttcaatttatggccagtcttatttcatctatactctacccacatcccttcttcccctggaatgattgaagtaattcctaggcatcatataatttcatctgtaagcatctcagcatgtatctctaggagataaagattttctaaaaaatcatattactactcttcaaatttaaaataatctttatagttttacatatccagttagtgtccagattttcctgatattttctctattttttaaatatgtcaaccttgaaatgaggtccatattatagctgatggctatgccttttaaattttctcatccacagattcttcttccttttttttcctttcaatttatgttttgaacaaactagtttggcctatagtttctcatgggcaagaataaccttcagactgggatggccatcactctgatacccgtaaaggggatgaggcaggttggggaagggagagcctcagaccatgatcagatgtcacaagatttttgcttacctagggtgaggacttgggaaaaagattgcccattaggagtcctgccttgggcaaaagtggccaaacttcagctgtgctgtcacaggctgtgggctgccttggaaatgtaggacctcaactcctctgaagttgaggtggagcttgagggtacgaatccctggtggccattataatgactacactcattgggatggcatggcaagttcatcctcaaagatggatcctagcatccaccatgaccaatgaggtttttttattgttatgatcactataaactcaaggatttaaacctattaaatgtttttcaattcacagcaatgattatttttactgatcttcaaattgtcacattttggatttttagaccaatgggagccccttcatcttgacttctgagttcttttgacattcactcagctgtctgatagcttccctgctttctggaatggcaagatattccaggttcatcttgaacatttcatgcttgagatatggaatcaagctcatcatcagagggtcctggttccttttactggatagtggtattagagacctcaatttgagaactaagcaacatcattgctaaaacttcccctatgtgtaccttgttacttaggtttttcaaagaacagagctagaaaatatgttgggtttttttgttttgtttttaaagaaaaaatgtatcataggattatgctgatacttccaattcaagtgcaggcctaagcttttcacattgtctcttttctcctacccttaaagtcctgattcctaactataacaacatcattactcatttgctttatcctgcattatgtagacacaatagagtaacaacaccaatgctgccaatcaaaagtataattactgaaacccacttaagatagtcctgcaatttttttttttgttcatagagtgtacactactagggaggtgtagtcaaattactatgttttaaagacacttggaataattcatatctgtgaagttatacccccaacttatttgttttttgtattattgtttcattttgcttttgatgtttaggcatttcttttttaaaaatcaattttataattacgtgaaatacttatatggttccaaaatcaaatctactaaacaaactatattctaggaagtatagcttttatgtttcccttctatgcttttccttccttcctgtaggtaggaaagcttatttgttcctcaaagctctgggttgttcttttattttatataaataaacatgtgcatatattcttttcattacccccacagtacccaccgtcttaaacacatgtacaatatatgtgtttttctaccttgatttctttcttacttagcaatatgcccagaagttcactctgtagcgctttacatcagcatcaaaatccattatgtactatcgtttattgacctctctgttggagaaatttggattgtttctagtcatttttgttatcgcaaatagtggtttaataaaaaactttactttccgttttttgtttttcaatgtgcttttaggatagatgcctagaagtgagattgttgagtcaaagaataaatgtgttaataattttgctcaatattaccaaattctttcaaaagggttgtgcaattttgctttttaaaatcattattgtataagggcatgtatttcctgaaaatttctccagaagagtttattgccaaactttaaaaaaacagcctgatacataataaatgatatctcagcatagtttaaatttgcatttttcttgttaaatcattcatgtttttactgtagtcctcctaacatttagggagcaccaattatggggtctctagaaggttccaggattctgtaatcaatttgacatgatttctgtcttcagatattcacaatcttcaggaagatatattgacaaaagaataactacatgatctattttgtgtgcaacttagtacttacagagcattataaatgcacatggaaaaataggtaaaggagaaaatcattctctgttgggcgggctgagggggaagtcaggaaaagctacagagaggttcgagggtaaactttaatgtgggccttgaagtatgatttggagttagcaagacagacaaaggagcaaggaaaccattctagaaaaagaaaattttgaaaaatctccagaaaaggatgctttggcctatttggaaaataacattgtcttatttatgggggagatgacagtgctttgtttttagtcagtagtttatacaggactttgaatagcatgcaaggaagttggcgtctcaacctgaaaattgaggaaggtgtgacaaaggctgggcattaggtgagatcaagtatttctgtttttttttttggtaaattaggtagcaggatagattataaatgggctccacactgaggagcccagtgtgatggctgatccagcagatcagggggcagtggctgcaaagctgggagaatggcaaggtaagcctggatgcaagggatattgtcaaagacaaaatttgggggatgtgaggcttaaaagggaaataaataatggtgatggtgagatttctagcttgggcagtgggatagatagtagacgctgcgcaaattcgtttttaaatcagcagaatgagaagcatcttatttgaaatatattctaccaaatcttagcatcaaatgtgctagtgactagcaaaatatgtaaacagaagggaagtagcttgaaaagtacacaaactggagaaattgctcctgaaggactgtaagttgaacccttttaagcctaagatctgtatttcctatgagccctaggctctttccttgtgtatcctgtttcttattagagtagaggctacttaaaaataatcatagtttaaagcgctctattttcagaaaacattattcattagatgttagtaaataatgtaatctttatacattcataatatttctgcattattggagtgtaaaaagtcagtgaaatagtcatttgtaaagatgtcagtttttatctgtggaaaatagctgttcataccattttaagcttaaaagttcttcatttacttcttaaaatatccatgttggtattattttgtctaatacaagtaattaatatttaccccaaattaagcttttaagtttactaaatgttacaaacataattcaaagcactgtttagtgtccatctgtgcaggaaaaataagatcaatacaattgagcagctgttagcatgtattggtttccttatattttaagtatgttttcatgttttgaaggtgtaaagggatgacagtatgttttgttgtggttttcatcatacagataaaaacttattacagttgaaatcttggtgaacataatacattttaaaatttccattcctcacccatttatctagatatttagacacagtaaaataaataacatggatacatttttgtcatgtgatttatgttttttaaaaagtagaaataaatttctctaaaagttatttttattttttaaatttagcatttttcatatttgaggaaaaaacaatatgtcttggtaccctagcttctgaactaataacacacctgtcattttacaggttattttaatgtttttcattgggatcaaacctactctggaaatatctcatgggtgagctttatttttatgaaatgttcttggcacttgaagacctttgtaggtacatgccagactcatcttacatccagttcttctgcatggaaaatatgtgcattgaaattctaagtgccttttcaaatttgaccttcttagagaataatatgagtcccaacaattaggaaaactatggaatgccttttggcctttacttttcaaagattttcagtcagtaatgtttaattagcattcattgtgtacattgtccttttttgtgtgatatggctagttccaaaggaatattctagaagatctcagccttctgctattgaaggtgataatacactactaagttatgtgttgctttacattaaaataatgttgcagcagttacttattgcttaactagcgggtataggacatcaggttgaaataactgattttgaagtgaagagttcttgtttatatcttaaactaaccaagtatgttcattaactttgagaataacaatgatctttttcattattcttgagtagactggataaatcagaaaacccatgttagaggtccctgtaaaaacttcagtcttatttggtaagtccctttataagagtttcaataaaatcaggtaaatttaaactctgaaaattctacgtactgtctatcatgttcaatttactgttaaccagtactatgcactggaaaaaatttttttcaccttaatgagaccactggtcattactgctgctactgatgctcttttgtctgcacatactgttgcaacataatgtgttgtgcatttgatacggatattatcatattgccataaggagctgctattattttagacaccaactgattccatgatagtgtcagatttctttaacatatgcttatgtttttgtacaaatgaccccaagaaacatctgctagttttgtggtggtatctactgtttcttttttagaatttgacctgtcagtcactttttaacgtgaatctacaatatttgagttgtattcctttctcgtttttatgctattgatattaacaaaattgagtcagttttatggcataattcagagagaaaccgaagctgtctatggatgttattttaaaaatacctttttcatgatgattgtgcctttaaatttttgtcattgattgacactttaaaattgaaaagtgcccttttaatggatcctttaggttccaaaatcttaagttgaaaatttctgtctattggtcctgaaagtactctctgaatttgataagtatgtagtagttgtggtgtatccttggtcagtttatatcctgtgctaattgctaatcttacttagtttctttgatgcgtgtgtgaagacaggcaaagaaaaaggaagtggaatttctacaaaactgtgaaatctttactttatggagactagagaaatttctaagtaaaagaagacactcattctattgtagttaggatcccttcttttacttgcttttcatgatcttgactgaaaagcaacaattgagatttccattgcccgacgctttctcttctgcttttctttttgtttctcttgcatttttaaagacagctatttattcaaaaacaatatgaacttttatttattggacttaaacctggaacatcaacaaaacaaagaacaaacaaaactacctttccaaatttattttattagaggatgctatcaatacaattttgtattatgttcacacttgataccaaacctaaacccaagaaagtgtgtcctgtgttacagcctatccctctgtttaagataataactagaacaatttacttttattttctactcatctgctttctgtgtatcagctgttgtcctccctcagcctcgaagcatgtcatcatttccatctccgtgctcattcagtcatccttgctgctcttagtcccctttttgtcccttgggtgacttatgtcattaggacaaccttctgtccccacttggctgaaactgagctgaggcccttgccagttgcattaggtgtggcacctttcatggctcagtttgggcctctgtgatatctgtgtgccttctactccaaactccattctgccagaggtggcagggtgactggaagctttagtttcagtgacaaaacccaagcgtggctatgctgagtgtctaagtagctttcatttaggcctgaaataggagagtcaggcgcctctgtgtcccctgagaaagagagatttccctcagctctctgggcccagcactcaaccatttaagtcagctggttagtataatttccctaaattgtggtttagtttccctatgagtaggactggagtaggaccaagtaaggaaagtccctagtgacctttctgcctcctgaggagcaggccatttactttgagttgtagcttcccatctgtctgtccccactaccctatccaaggccctggaggagccacaggatgagggaggagattcatggaaaagcgccttcaggtactgggtatgtctggagtaacatttaaagtttaaaagactctttaacaattttcctctgatacttactactgcctatacttgtttggttttagtacagtaagttttgcctatcgtgggggtgaagaaaatagaaatattcccattaactttgtatggtgcttggtatgacaccctgaacaggtgcacccgtaattgtttacttgatgttctttttaataagtcaattatatcatcggaaattgaagaatagcaaagttaatttgtttaatcattctatgggaactcttgcatgctcgttcactagaggaacattgcgtttctcccttaaaggacaaggctttgttttgtttttaataagacacactctttataattaaaacaaaatcccagtgttaagggatttctgttttaaataattggatttctttcctttgttcctctaatccctctatatgagaaaaaaatctaatggtgtcttaggataaatatttttagattaaaaagttctcttaaccactgaaatttaataatacttctcaaagtttatggatgatatagaatgtaatgtaaggttgagaattttagatttggcaaaggcaaagatacaaaaactagtgaaaaacaacaaactggaaacacttttaaaatactgatgtatttatctttgcaataaattattcagaaatataaataaactcactatttacatagttttatttaaatttgtcctcaaaatactaaatttagtactatatattttcttctttcagataaatgctttcctgaaaatggtattttaatatctacagatggtttagtttaacaatggttggggtaaaaatgacatagggaaaagcaaaatgtgacagcccagcttggttacctttagagaaactcagaataaactctattcccatttccttctctttcccctttccatactcgagagcccttttctgagactcttaagtcatgtttgggccttggagaggataaatagcagggtgggtggtaaaaggggagagtgctttgcttgaggcaaagttttcctccatatgggaccttcctcaagccctcccttcaaaccctttaaatgagagcatgagctcctaggacagaggtcatgtggaaagcagcattagcatgaaggggggtgctgtggaggggtgtaaggtgcaaaaagcagcattagcatgggggaaggtggggtggaggggtgtaaagggaatgagatgtgaagtggttaaagggccatttttctagttggcctctgggctttgatgaaccttttccagtgtgcctgtttctccacttagccctgggctaatcttgactcttaactttccaggtgtgtatctatgctgatttctcctgggtttggaagctctgagaagctctggttctagttcaatcacaagacttttaaagaaccagaaaaataaaacaattttttaaaaagtaatgaagaaaagacttttaaagaaccagtgaaaacctgggagtaaaaatatagaagacttgagaaatttcatctttacctttcaagtgggcagcatgagaaattcttgtaaatggtgctttcaaatcttacacaaggttctcagttacctttatttgtactccctagactgtattgcatcccttgctatgttgactaattcccacctaaaataattcaatggcctcccaatataatctggcattctaattaataagctaagaaattatttggtttttcactcattggcgttaaatattcttcagtgcccacatttggaaatattggaacacagaaatgaaaaaagatacaatcagtttctctgcttgccatgttttccttgatatggcaatacgacaacaggtcaccctttgaagaaaattcagagatgctaaagtagaaattaaaactgaagataagtcaaggcaggatagtataggagtctgctacagctgccatagcaaaatactacagcctgggaggcttgaacagaaatttatcttctcacagttcttgaggctagaagtccaaaatcaaggtgccattggggttggtttctgaagagggttctcttcctggctttcaggtggccaccttcatacagcatcctcacgtggccttttctttttgcctgcatggatagagatctctggtgtcttccttgtaagaacaccagtcctattggattaggaccctatgctatgacctcatttaacctaattaccctatttaaggccctgtctctaaatacagtcacactgggggttagggcttaaacatattttaggggaacacaagtcagtccataacacgtgatttgctatagttttcctttacctaaatcttttccaaccttgagagtggattttggccaggtgtggtggctcacacctgtaatcccagcactttgggaggccagggaaggtagattgcttaagcccagaagttcaagatcagcctgggaaacatggcaaaaccccgactctgggggggcagggggagtgggggaattagctgggcttggtggcgttcacctctagtcccacctactcaagagggtgaggctgaggctggaggattgctacagcccaggaggcagaggtcacagtgagcagagatcacaccacttcacttcagccctgggttacagagtgagaacttgtctcaaagaaaaaaaaaagtgggttttattcttccccttaaattcctattaatagtgaggtgaggcttcttgtgttttttttttttttttccaagacaatggttaatgtgtgattacttaaaaatgatatataacactaagaaataaagaattgttaagtgagaaggaacatattaaaatggcttggaaagatgggtaattttttacattttaagtaggttttctcaactctaactctgtggaacttggtcaatctaatcagtctaaatatagcacaaataataatagttatatggacaggagaaatagtagccctcaaagatagtgaaatacatctgaatatcactaacaatgtcatgaatttgcttgttctaaagttttctgaaagtatgaattcataactgagtttttttttttttgcctatgactactaatgtttgaggagagagtagtgtcagaaccacccccccatttattacatgtttatttcatattttggtactgaaatcagtgtttattttgtgtcttcctgataaatcttgccaataagtaattaccttccatactgaaaagttcttaggattaccaggttgctgggggcaaccttaaaaggccatgcagaacattgacttaggtggctattaccctgctttattcaggtctgagcatttactttcctactacaatcagaatactgacctacatttaaaagtgcaacactgccctgttatctaaatccactgtgttcctgagaggaaataccagaaaagagggcaccaatattatttttctgctgttcttgatcataagtgattacctttttttttggttaggcattctgcttctgaaagataactgaggttgaagttaatagaactaagattcttatataaaatcataggaaagataattttcaggattattgaatcatattgaaaaatgatataattgtgttaaaagataaggactaaaatgagttaattcaatttggaaatagttaaattagaatttgcttctgtttttgatgaatactgctttttgaaaaatcttctgagtatttaagcttttactactctagtcattctctctaaagtagacatagaagcgtgttcttatcttgatttggtaaggctctgaaaatgcaaagcaacagatgttgtacccagcataattatatgtatcctggaaacacatctttattgagtgggatttgttcttggggaaacaaaaatttggcaaacaaaggacattaacttgctgatctcagcagtaattacttgggttagattataataatcttgtgtaggtggtaactgcatgcatatattacaaaatctaattctaaaatacgtacattaaaaggaaaatgaacttgcgcaaactttagatcatgtatccccttgaagagcagaaaagatctcaatttcattatttgaaagttgtttgaacagctttttggaagaggtttccaggattccaaatcctaatatgtgtattgatactgaggctttggactaatctttgggggttactgccttttttatgcccactgaaaatagagcatttcaaacaaatgaactgatctctgatctttaagcatgccagtaactctttggaacaaatccatagttatttttaccaatgactgtattaaaacagtactttctgtattatctcttccattccaaggccattttaaaacaccctctttctcttctcccaataggtaaagtacgacagagctccttaggactgggttatggagaattatctggaggtcaatttgagaaccactgtgcaaaccatttcttaaataagtagctacaaggttgtccttacaaaaatttctgaagttgatggtgttgcgttttggagtctgaagcttaaataagagtttgtcagtggtcatggtctaaatagctgattactaccaaggtcatctaatttttttttaacacaaaaaaatgttctgagcacaaatgaaaccttcaggacaagacatttatgttttgagaatgttcttaaatgattcctgtcgtgtatcttattttacatatcttaatgatcagcatgtattttttgttgttgatgatgattttataaatgtgctatcacctagtttctaattcctaacagctccttcatcagtagaatattgctgtagcacagttttgccatctgttaagaaaagatggtgactaataagagtggcacatttcagggctggtgtgctatcgcaacatctagtgttttagtactgaggacagtgatgtatgcagtgttccttacagccatggggtgtgggaatgttttcctcttcggcaaagtctgtgtatttctatagctgaactctcaggatccagaggaaaaccacaagatgatgaaaccagatgattgtcatcaaatttctattccccactacatgattattagttttcgtcaaaagaaatactcatcctatcctgggttggaattggtaaagaattttgcattgtgactaggacacctaaaagtttttaggatgagtacaaatggaatttgatagatttccccaaaatgtttgggaaaagatttattcctccctaggaacagcaagagtagcagcatcacatgaggcaactcctggtaattttttcttcttgctcttatttcaatgatatcttttcattcttttctgtatctctcaatttctatgtttctcctcttaatgtatcctgtaaatttcttagtagaacctttttactaatgagggtttcctagtttgctttaggaggcactcaggatgcccccttttgtaaggcagtaaattgaaaataagaacttggtgaaggtccacgtgacggttagtttccattctccattgtaccaaactgctacagggaaagaaccatatttaatcaacctcaaatcctcaatatttaggtcagaaaacacttggcatagaagagacactcaaattttgcagctaaatagattattgatagaaaatatgtttcttgcctctacaagcaatatgaaaccaatacaatctctaaatatcttcagactactaggggcaaatactgtattataagaataattcttcagaaaggaaaatccagctactctcatatcacctctctatgttgaaagctagggaagataaactggcttccagccagtgagagtccatgtggacctagtgctggctggagatccctaatccaaaggcaagagccagatactggttgtctgctgaaaatcagaagatgacctctctggtagtaaggccagtgactcatccctgcatcttttatcctcttctgatttgtataaggatctctcctttttccccagtacccactctcaagaattgctttcctttttaacatgatcataccaaaatgtatctaacagtaccttgatttcctttctgaggaatttagggagcatatttactttgtcagactcattagaggtttggcttcttggtcgggttcttaaatggacaacttgtttgggtgatttggcagagaataggagaagccagtcccctctgatagagcaaacctggggagctgtggttgacccacctgctaactgtcctgtacaattaggcatgtggcatcagtgggtgactgaccagagccaccatctcaatggcggctgttctttccttcctgtgccttctcagatctcttttttgttcttgttactccactatattggtttttcttgagtttttttcaagcaaatatcattattcacttctactgcagttcctctgttgttcgctttttctcttagtcttcattgttttccattttgaacattcagagatccatcaaaaaaagtaaaataacaggaagggagaggtaaacaccagtcaaatgaagtattataatagtgtattactatactctttaaagtaattgaagggtggttttttggggtcagaatatctgttagaatttggaatttgccactcttgagactggggcaagctatttaaactctaagcttatctgtccttcctcacaatctgtaaaatgggatcataataatggcacccagtttatggtgtagtgagcattcactgacacaattaatctaaacttatttgcactacatagaacagaatttttgtctattaaacaatatagcgttttaggcatgaaagaaactttagattaaattaaatatcatttttcttaccacagggtaagtttctgttttgtttgcccctgtttctctaactcctagaatagtttccagcacatagagattaaacaaatattcgttgaatgaatgaatgcatctattctaatcctcttgttttaggaatgacccgtcaggctcaaaagtgaaagcatttccctcaagattggtgacagagttggggactaaatctaaggctttctcttcctacaccagtgtcctttctgagaacacgatgccattttctcaatatttgtttatttatatggtaaattggtaggaagctgtgtggtactataagaggataaactttgataatgaggtatacttgctatcaaattctaacattctcatttaaaacatggcataccatttgtcttctacattttcatatgtaaagtgaggtgatttctaccttatagaactattgtgaggattaactgaactaatctttgtagagcacctggtcccatttattttttttttttgctcaccccaccccccaactttctagctagataacttatacattcactctgtttttcattccttcttgaatctcctgtggccagacttgacccctgtcactctacagcttactcgtcaaggtcagtcctcatctgacttgacctactaagagtctgacaagtagtcacactatgctccttgatacagctttcttcacctaccttcttggatgtcattcttttggttctcctcctaccccattgggctgctttttcccagtctccattcttgggtattctcattttcccatgtctgtcctctgacttcttattgtctctgtttctgttttctctggttggaccttctctagtttctggcttcaaatactatctaaatgctcatgtctttcaaatttgtaactctagtctagacctctcctctgaattccagttttataaatcttctacttaaatattagaggtctaataaacttctcaaacttatgttctacaacaaactccacattttctcctgcagcctctaaatatgtacctcctatagattttcccatttcagtaagtgggaacttcattattctgattgtccaaaccaaaaacacttggagacttgctacattccaccctttgtctttcattctacatccaacctatcaacaaatcctgttgcctcttccttggaaatatatccacgcttgagcagcatcattgtcaccacttggtgttatacactctcatttctcacctggagtattgtatttctcatctggagtagtgtctgtccaacgatgtcccccatcagtctgttctccatgtagcaatttcgtttttgtttgttttaagattgggtcttactttcgccttggctggaatgcactggtgatcatagctcgctgtagcctttaattcctgggctcaagtgatcctcctgccttagcttctccagtagctaggactacaggcacacaaccacacttgactaatttttttttttttttaacttttactagagatggggtctccctttgctgcccagtctagtcttgaactcctggcctgaagtaatccttctgtgccagcctcccaaagtgttgggattataggcatgagccaccatgtctggcccagatgttaattttaaagtgtacattagagcacatcgttcttctgcatgttcagcataaaatccaatgtccttaatgtagtctatattaccctacatgggctacttgtgcctgatccctctactcttatgtcttatccctctcctgctttctcactagcaccagccacatcttaccgttccttgaacacaccaagtatgcatttgccacaggaccttgatgcttactgttccctttgcccagaaacccttggaaccagctatgtgttaaaattcagatatttactgattttagagagctaaaatggggtatatataatatattacataacactcacagctggtttgtggtagcatttcataattaaataatatttctgaatgaaacattaagaatgcccatgctaagagggatgagtaaagactcaactctcattgtcagttcagctgcagaatgaggtcagctcaagatttgctgccaaatgacttaagaaaaaaatgtttttggagctttggggatttcagaattgcagatgagagattctagacccgtacctacacagcatgctcccttattttgttccaatctttgttcaacgattatttattgggtagtcaaggaagatctctgtctaaaaggcttctctgtgtggaacaagactggcatgtggaaggtttccaattaacgatattgaaagagtgaagctcaaatcatttttcactcaaatacatactatttagaagacagtggccagtttaagaataatcattattggaaacaaagtactatttgattagggatagttaacacaaacacttattagtattagggatatgtgaaatacttaatggatgagtcatgtgctgacataaaacccattatccattttagttcctggtagcctaactggttgaactctgttttattgatctattattgatttggcctgtaacttcaagttacattttaatgtaatttcatccttttctgatcaccttgtgtcttcaagcatttttaagcagttgatagatagttgaaagatattatcactatttcaatctaaaagatattatcactattttaatctacttaaaatttttactacattcattttaagtatgacttatggaacgaatcgaaaatacaagatagtgaaaaacttgtgaggatcacctgaaattttagcattcactttccttacatagaggaacttagtctctctaaagaattatgagtaataaagtatcataatgatatttgtcttagttttggttaagtgtactccacaggagaaagttaggcatgagcaggaattattgtagtcccacattctcaaacagttctccagtaagaaagattttatgtgtttccagaaatcattttcctcctcttcagagctttgggaccataattgtatttaaattgctaatctgttttaaggaatcataataaattgtttaacatttatattcaatcaactttgtaatttgtataaatttttcagggtgacatttgaacaatttttaagaaaatgggaaatacagaagtattcttagttttaatatattttaaaaagatgacatgtgatctactgactgaaatccttcaatcatttttgtttttctccccaagattagatagaatggatgtgattttatttttaatttgcattatggagagtacttttggggggttttatgaaaaagacttcatttattttgttagtggtacttcagttgcataagaaaatgttcttttaaatatagtggtcatttgtgtgcagccttcaagttagcaaacatgcctttgagtagtcactatttttgaaggtctttatatctgattgcaatggcttatattcaatagtcctcctactaaatgaaataaaaatggatgcctcttctgccacagaggcacaggtggacatgttggtagcaagccccatgcggtgtgacacatggcacagcccaacatgggggcaaagagcatgcggcttgagctaggagtcactttatggctactttagtgtagatttgtgtttttctgtggaacagccattattgaagacatttatatagtatgatgtttgtttttcattaaatgctgattgtgatttcttaaaaatagttaagacttgattagcagaacctatttagaagccagagttcccctgcttcacctcttgctatctatataaatgatatttttgactctgtcctttataatgttggcaccctgtgcatattagatgtaatcagggctgaaaggaaacttgaatccatctggaagcaataaacttttctaaaagactgcacagtgttatttaatcctgtgacttcttactgtgagtgaaattaaggtttgatgcagttgtgtcacatcgtattgatatcaaatttatctttctaaaaaaaaactgacagtattacagcacagaggagaagatggcttgctgtaatcctgtaagctattttacattgattacatgctacataatgtacctaagtatataaaatacttgatctagaatgtttatgttttctccaaaattttctcatcaggtaatactttctcaacttcacctttagttttggcttcttatcatagtactaactatgcggtagtaattgtgttatgatgaaaggcatggagaagaaattataattttaaaactattataaagtggagacacacttgtataattaccatctatgtagactgccaaggtataaacatttagcttattttagtatcagactctttgaatcaatttaaggctttttcaataaaattggcttcctctaatttctactccaaaatggttaaaattttgttttacttcaaatacgttgtagggtatcatatttcatgtgactaggagcctaaactatatcagctgactggcataatttgtgaattatatgtgtgtttattaaaatttaaagtttttattaagacttacaattttattaagacttaatttttttccttacattttgagtaagtccaactgaaaataacttagagacttaggaaatttgactacattttataagtaatttccttgtaatttttctttcttgtggaaacaattcttactgatttacttaactcttttttcaatggcaaaaatgaaaaccaaatatatttgtcaactatattcttttaattgtggaaatgaaaggttcatatcccccatttgcctagcatattaaaaataaacatgacctttgtcttgaatgttgttaacttggattttaaaaatcaaaccaattataagctatattaaaattgcttatcaccttccctttgtcttcagtaagtctgggcctaaaaatactcatcatatgaataaataaagttttacaaatactttttagaacatcttgaattatatgtgtgtttgaagcttacttttggatgttcggtcaacaaggcttctgacagtttctttttatcttccctctattccctgccactgtgcaccccaaagtgatccctgaccacagtggtcccattgctggcatcaggaaggtagactgaggagttcaggtatcctagaggctgttaggtgaatctcttctacctctttcctggtcctaggaccactggacacttcaagtaaaaataacaattactttaatctctcaggtaaagtttcttctcccttccagcaacacagatctgcctgtgccgagttcaaatactctgaactttcaacagttgttctgaatacttttttgtcatcttatgatcaaatattgagagcattgaggggataactgaatgggcatggtataaaagtcagacttttagtgtttctaagtagcagaaccctttggacaatttagagggctgtgcgatatcctcaccgtgactgctgggaagtaatgggatctgacctgcagaggtactaccttggctgacaataatgacaaaagtgagagcaaagtacatatgactatccttgaggtcctcaggaaaaaaagagtattagtgagttgaactgtatgtaagggtctttaccaataaggaagcccatgcccagacataatccttacaccctggcaatagaaaccatcattgtggtttacatctcatcctgttcctacagtccagcaagttcaggccacaaaaggtttaagcactttttcctttgttctcatagcaacagttgcccatggaggttcagttacactaatattaacattttaatatacacaaagaagtgcctcgaatgtagtaggtattcaaacttgttaaatgaaagaagtaaactttcagacttaccttgaactactacagttttattctttctctaacctctcccactactaccatcttaaaaccaccatttaattagtattttataacaagttattaaaggctttcaaagacctttgaaccttcaccctctggtaagttaataacttctgatatgcgattaaatgtcaactgagtagtagtgggccctaagagctcagagggactgagaaatgaaggttattgtttagaagagtggctcaatgtgcttcgacagttggttaatatttgaaaagactagagtcaagaaagccttccatgtgctaggaaatgaaggagcaaaggtccagaggtggaaatgtatacagtgtgattaagggattttctgattgatagtaaatacagtcaataaaaaacttttattggaagcctagcctgtgtttgaagcattaagctaggtgctgggatacagagattagagatgaagataatgatgaagatattgttgaagtgaattgctgagaagctggagaaagggccaattaccataatctgaggctcaggaggaattggtgcaaagatcatctggtatgatatatatgaactgtatatacaaactgatctgtgtagctgaactgataatgccaaaaaaaaaaagactaggtttttgattaagatgaatccattaaggtcatgttttctgttggtgccattcttggagacctcccccaaccctatacatttataaatgtttttcctgagggactgagatggaagtggacatataaaaggaaaggtctgggcaaatacataagtaggtagtaaaatcaaggaacaaatgatctcaacaaaattgcccttcttgaaatgaatgaaaatgatgaaagccaatcacattgcatgatgaacttggggtatagaatatgaaatatttaaaattgctttatttcatgatgtttcagatgtagtaggaacttgttgcatagatggtgtaaaaacaatctagtaataaaatcttaggtatttaatacaaggtgaagaaagatgcaatgcataaatcatgccattttaggcttaattttcataaggctatgcctgtctttataagactatataccaggagttctcaagctttttggtcttggaacccttttatactcttaaatcgttgaaaaccacaaagaccatttatttaagttataaccattgatatttgttgtattagaaattaaatagacattaaaaatatttactatttaaaaataaccaaaaagatgggcatggtggcccacacctgtaatctcaacactatgcgaggccgaggcgggtggatcacttgaggtcaggagttcgagaccagccaacatggtgaaaccctgtctctactaaaatacaaaaattagccaggtgtggtggtgggcgcctgtaatcccagctactcaggaggctgaggcacgagaatcacttgaacccagggagatggaggttgccgtgagccgagattgcgccactggactctagcctgggcaacagagtgagactctgtctcaaaaaaataaaaaaaataaaaataaaaataacagtaagttcattgcatattaacataaataacatatttgtattaaaaataactattttccaaaacaatcaaaaaagcagtaccactcttctattttaaattttttcaaatctcccttttctaaaaaaaaaaaaaaaatattgtgtaagtttaaggggtacaagtgcaattttgttgcacggatatattgcttagtggtgaagtctgagaatttagtgtatcttcacccaaataacatacgttgcacccattaaataatttttcaacacccacccccttctcactctcttgagtctcctttgtctatcattccacactctgttcctatgtacacattatttagtacccacttaaagtgagaacatgtggtatttgactttctgagttttttcaactctggcttaatagaagacagctgaaatctcagaatgcttcttcatccagtctgttgtgaatatgttgctttgattcaagtatctaaggaaaatacagttttacacagatgtgcagctgaaaaggaaacatcttttaatatgttcagataattgtggatattgtcctttgatactatagcaaaacttatcaagtgctaatttcttaaaggctggttataatttgaaatctgaaaacatatctatttaattgtagtttgctatttgaaaatttattggtctgtcttgtactttgaatggatattttgcccacgtatgattttataacatcctgtattggccttttggaaaatttggtttactattatacagtttctaaatgttgataatttttattataatatattttaaaaagtctaatgtcactgccagtctcatcagaaaattctttgagattagaaagctgttaagatcatcatcacacttacaagttttacaaaattttaattttactcaaaactttatattttatcattgacaaagctctcagttgctttgcttagtgactgactcactttgttcattttccagaaagtgtttaccaaatgctgctgcctcaataccagagtctgtattgtcagttgatctttcaagtaaaaagtggtgttctatgaaaaacagctagttcagctgcgactgaaatgatataagtgtttctcctggagcaaaccaccacttcgatttgtagcagaaatgctgtatgtatactttccattgttattactcataacatttttaaaaatatactcaagggtggagatttttttaaaaataagtgttattgcttcatcaagaacagttaaatgaaactggattttttaaactgagtttgagttaatgaagaatgcagcaattattagtaaaatttggtgctccaccttgattcatactgacactccaggagttttacccactatttcttttgtacctttagtgcaaatgttaatatggtaggaatggtaaatgacatctttagtattattataaaaatcgtttttaccctgtatactctttgagactacacattgagaattgctgatgaaggtgttttaatttatcataagcactgaaaagatttacttaattcaccaatttctcctgaatatttgtttatataaaacaagactatgtgtatacacctacctttttattaatggtagagatctaggaaaattaatttctaagaactagccaggatatttggaatgtgaataaatcatatatccagaaaaaagctttagaagattgtctatgattgaaagtcaaacagctctcatttctattatactgttctttttcaaagaatttaccaattttatgtggtatttatgattaaacatacaccatgtaatttaacatttttaatgtcacttttacatcataggtattaaagattagcatttttattgtctgtattttaaagctcaaagaataacatttaggctgggtgcggtggctcacacctgtaatcccaacactttgggaggccgaggcaggcggatcacgaggtcaggagattgagaccgtcctggctaacacagtgaaacaccgtctctactaaaaatacaaaaattagccgggcatggtggcgagcgcctgtggtcctagctacttgggaggctgaagcaagagaatggtgtgaacctgggaggcggagcttgcagtgagccaagatcgcaccactgcacttcagcctgggtgacagagtgagactctgtcttaaaaaaaaaaaaaaaaaaaaaaaaatttagatttttgactgtttcattgattcatcttagacttcacatgaaaatatctgtatatcctcaaatgcttacattcttaagaagtatctcagccatttacacatgatagaaacaactaaatggaaaaaaattgcagttggaaattcactattttttatttgatccgataacaatgtgacatttgcgattggactgtaattttctgtctttctctctgaaaataagttcaaaaatttccctctaattcttttactagataagaagcctacttcgttgtaactcttgatatatgtatgtatttaggaacttaagcttttctgctaataaatgttatgtcataattcttgaggatagtattatattgtgatgggttttcagtaaactacaggagcagccctatttgtttaaaccctagtttaacctgattattaacaattaaattgtgttttcttctaacaattaaagtgtgtttaaatttattggtcccttgcttcacagatttatctcagtatgtggtgtattcaaacagaattttgtatttttaattaggggattagataaccaattctgaagagccaaaaaaattgttagacatcacattgcttaaccatctaatataccataagtgtgtgtatacactatgttgtgggagccatctatcaggcaggcctgtttttcaggcagtattttaaaaagtggacatgtgcagaaactgtgagcacaattagcgccaagcagataaatccagctctaatcctgtttacggtctacatcagacagatgtgccaagattgatttagacaagcccgaggcttacagtaatatttttaaaagtgccattcgctgttctatttttgttaaacctttgctaaatattcttaagtcttgttggttttgctcttcttattaaccaccgtaagtaacctactttaagcaggtcccgctttgctctcatggtgacaaggtaacctgccaggagaggttatctttattccctgtaattaagttgacttttccccccaaaaaaatacaacaataggaagtgggtgctgaattaaataaatagcatgatacccagtagatgtatacttaagttccttgcaagaacagatggtccccagtatctctgtaagtaatgtgagaggacagttaatgttctgaaacaactagctataaccagtatgatactaatgaaccagtagatttcaaataataaaccacatgccgccaagcaaaattatatgtcattcataaggatttaattatcataacttgcaaaaaagtgtcaatagatgatttctatatttttatctactgatatcaaatatcaatttatgaatagagtttcacttcatattttttaccaataaaggtatgttttaacattaaggtagaattaaagttatatttaaaatacatgccccaaagtatgtggtgatttttttttaactcctcttttactatactgtctgtatgtattgggctgtatatggaaatgtagcttttacatacaattaggaaaacaattgcttttatttctagcagaaacttgtactataacagaagtggctagcatgggaatcagagtagttatcttgtagatgacaactgaagcagacataaaagatgtaatattttttcagcactcaaaaatttataagtaaaattttataaacaaaaagcagtatttttgtgattcatatggaaaataaaatgagtctgagtcattcttaaggtgataccgtaaaggtgtatagataagaagtccatttttaaatatacccaagacaacagttttttctctcagtatggtttgttttcccttttttctctttaattatgtttcccataagtatttgtatattctaagaatgtccaaaaaataaatgttttgcagtgggggttgaaaagaaagaaagacctttttagatttcagctgatcttatcagatgatctctagaaccttgaaccttcaaccttcactgaagttagctggagggcttttcacctggaaacctgagaaacctcagaagccttctgctttagctctctctcaagtctaggaagccagtggcctgcgaccccacagagccagctggtccactcctcatataagaacttcggtaacaatacaaagacatagcaaagcaccatctaatctgataactcattaaacaatatttagatggctcaagactttaaataaaaacattttaagcttgtttatagaatactaacaagttttattcccaaagactatattcagagtgagaaaacaattttccttaaaactaatattatatacatgttcatatatgttaggaactagttatatgcaaaatcaagtgactcttgtgattagaactggtcacatttattcatgtagcataaatggttaatattgccaaaatgagtaatagatcagattttctatgtgagatattgacacctgagagatttacagtgtttcactgttgtgaaaaatggagtgctgaagaacatttgtctattgttatacatttgtaaaagaattcacaaattactaatttcaaataagaactaaatatttcttctaagcctatagtttttctttttaatttcttctaagcctacagtttttctttttaatttcttcttgtaacattggcaaaaagaccattcgtgtgaaaacctcagattttgatctgtacacaaatgcaggagtagagattggaagcttgagctggaaaagcaggaaatactgctcagagccttacaaggattttcagaattttcactgttgggtcctcctggttgctgcagtctaacctcgcatctccttgaaggcagccccagtttctgatgaaatactcttcagttaatttatacatatgctgtcttgctgttttcctaaggactgcaggcagaactgtggttcacctactgttttaaatttggctagatttaaaaacagatgatctcacttatatgtggaatccaaaaaagtcaaacttatagaagcagagagtacaattgcggttgtcaagagctgggggaggggaagcaaggggatgatggttaaaggtataaaatttcagttagacagaatgaataagttctggatctattgtatagcattgtgactatggctaataatgtatacttgaaaattgctaatacctgaaaatcactaagagactacgtcttaaatgttcttacaacacaccaaaaaaaggtgtgaggtaatgaatatgttacttagcttgattttaatcatttcacattgtaaacgtgtatggtactgatcttgtacctcatttcattttccatatgaatcagaaaaatactgctttttctttataatatcttatacagcatagatacaatttttagtggtcaattatattgtaatatatacataaatatatatgattttcattggtcaattatactgtaataaaacagcaaaaaataaagttgtaattaaaaaataatttggaagaaaaaattagcaagtggttggagattgaggaagatgggaccaataagtcctccaaggagagtcatacattagttttttttaaaagtccattattaatcttataatatttaatatgtttaatttcttgacacttattaatccaattaagtatgagaacactgtggataaatctaaaaaccttaaagttgagtaaaataaaccagatacaaagaagcacatactttatggttacatttatatgaagttctagaaaaggcaaaacttagctatagtaaaaaaatcatggtcctgagggaataactagagagtggtatgagggagctttctataatagtgggaaaattctgtatctttattgggatagtggttatgtgagtgcatatacttaaaaaaactcatggaattatgcccttacaaatctgtaatttttgttggtaatttataccttaataaaaaacaaaacagatgacagggttagtgattgtttccttgaagaaggtctttacatgggtctgttgttaacgagttgtagtaaaaatcatccaaaatgcttggattcaaatcttagatctgttcctaccagatgtgtgaccacagacaagttacttacattccgtcttcagtttcttctcttttaggaaaaagcatctagtttttgttgtagagattaaattagataatacaaatgaagtacagagaacagcgtttggtgtgtaacacatgttcattattagctacccttattttttagagaatggaaatttttaaatttaaactaatcaaactattttaggataagcaagtgaaacaatctttttttcaatcgatcacagaaatattttcactgaagacaaattagacatttatataagcaaactacagtgtcattaccattcaaattttcatatgcatattcatgcttacatgcatatgaaagcattacacatatgtattctataaatatatacaaaacagtaatggaaatgtgctgtactattttgaacatctttctagtcagcccggcattttatttacttttgagacagggtctcactctgttgcccaggcttgagtgcagtagtgtgatctcagctcactggaggctggaggtcctgggctaaaggaatcctcctacctcagcctcctgagtagctgggaccacaggaaagcaccaccatgcccagcttatttggtttattttgtttgtttgtttattttttatttttttgtagagatgaggtctcactatgttgcccaggctggtctcaaactcctgggctcaagttatcctcctgcctcagcctcccaaaacactgcaatcacaggcattagccactacactgacctctacattttaatagctgagtagccttctgttatatgaatatacttttttttaacaaaaccaatactccattattgtacatttaggttgtttccaagtttcactcaaataatgcttgggtaagtaagtatttttatttattattattatttttttgagatggagtttcactctgttgcccaggctgaagtgcaatggtgtgatcttggctcactgcaacctccgcctcctgggttcaagcgattctcctgcctccacctcctgagtagctggggttacaggtgcacaccatcatgcctggctcatttttgtatttttagtagagatgggatttcagcatgttggtcaggctggtctcaaactcctgaccctgtgatccgcccacctcagcctcccaaagtgctgggattacaggccgtgagccaccacgtctggcctggataagtattattttagctaaattgtgcatatttattcccttagagtaaattcctggaagtaaattgctggatcaaaaccaggtatattttaaagaattttccttttctacattaaaaataattataattctgattacaagaaaggaaaattatggagcttcataagaaaaaattagtctcatatttcatacctcatattgcatatttaataggtaaccagtgttaaatttgttgtgtgttttccactgggatttctttttatctcctttaataaaagcaggatcagatccctcagattactttgtaacttgcttttattctactttttcatacctcttagcatgaatgtctttccagaccagaatacagagatttcacttactcatttatgagctgcagaagatgactatgatttattcaaccattctcctattgaagagcatgaatattgcttcagatacttttgttattataaatattagtgcaattaacattttaaagtcttttgatacatattcccaacttgttctccagcaattaccatttttgcattcccaccagcactggggctacttccctttagttgcaccatcatttagcattatttttgatcttgtgccaatctaaaaggcaaaaagtggtatcttgttgttttaatttgcatttctttgattactaattagattgaactttttcatttgttcattggtcaatttgcatttcttcttttgtgaaatgcctgcttgggtcttttatgtactttaccattaaagtgtttttcttgattaaatagattatgtaactgtcatatgttgcaaatatttctgtccatttggcctttgcttatgactttttatgagtctttaggacttttgaggtctttattaggtattcaataattttaatgttaaatatattgatgtctgtcttcctttgtgtcttacggcttttctatttaaggttacgtaaatttctaatatacaaatattggtgtatattatgaaatagggccctatttttctttacaaaagattagtcagttctaaatcatcctttgctatttctagcggcgcttagatgccaccattatcacatcagtgaatttttaaatgtgtaattgtttcctgatctattcatttctctattcctagatacttctattgtaatagctttaccaaatatatctgatagggtgtgtactccccctcattacttcatttatttatttatttatttagagacagagtttcagtcacccaggctggagtgcagtggcatgaacttggctcactgcaacctccgcctcctgggttcaagggattctcctgcctcaacctcttgagtagctgggattacaggtgtgtgccactacacctggcaaatttttttttttttttttttttttagtagagacagggtttcaccatggtggccaggctggtctcgaacttctgatctcaggtgatctgcccttctcggcctcccaaagtgctgggattacaggtgtgagccactgtgcctggccccctcattgcttttaaaacattttcttactgtaatatatttattccaagagaattttcaaatattttatgagattccttgtccattccttacatcaaaaaataccacggagattttgattgaagttctattataagtagttacttggggtggggggaggggggagggatagcattgggagatatacctaatgctagatgacgagttagtgggtgcagcacaccagcgtggcacatgtatacatatgtaactcagctgcacaatgtgcacatgtaccctgaaacttaaagtataataataaaagaaaataaagagaatactggcatggaaaatatgtaatcttggaacttgttgtatctccacttattcaatcctttgtctctcagtagattttgaatggctctttatcccacacgagtctagaatcattttgctaagtttattcctagatataatatgctaattgatatgggaattttttttatctccattataccttcttcttgggtgtagacatatttgtagccagcttcctcactgcatattttttattaggcctaatggcattaagtttattattttggattttacaaaaaaaattatgataacatctttaaatagttagtttcaactcctcctttccccttaaatccatcaattactgtcttttatttcactttccttatgtactgactagaatgcctagaataattgaatgctatgagtaataataggtattcttgccctgtttttggaaatccttctggatttcagtaagtgtgatgttggcttttggtttagtatctttaaatttgcaatttacaagatattttacattggaatagtcattgagttgttaagtaaagcacaaacatgttaaattcagactgaagtacaggacttcaatgaaaagttaaaagagtttatttcatcactttcattttttctttccctcagtggctgtttgtcccctccccccaccccgctccatcccccagcttccttcctttgtgctcttattgttctaggtttgactacataaaaagagactctcaatttatatgtgatacaagaccataactaatattataaaattagtctagaagaagttatttgcaacctatataataagggactaatttcaagattatttgaaggactttaaagattggtaagaaaaaaatagacaaccgtttagaataaggcaaagcatgtgtagaggcaactcttaaaaaaaaaaaagtgagctgggtgtgatgatgcacacctgtggtcccagttactagggaggctgaggcaggaggatcacttgagcccaggagttcagggctgtagtgcaccacagtcacacctgtgaataaccactccattctagactgggcaaacataagaagactctgtgtcttaaagaaaaagaaatgaaaagatattcagtttcattaattgtttgactagctgatttttggaaaatacccacaaatataaccaagcctacaagttattttaaggtgggtaagagatacatcttatctatatgcattcacctatgtgaagcggacacccagtaacacccccgtgtggaagacaagcttccttaaacttcacaggacagtatttcccatgtagtccatcatagggtgaggatttttcaggacctttggtaagcctgcttgctttcattcttgagggtagaggaagggtgcaagacttccctggtctctcccaagcattttggggaccctggccataagcctacttgctcaacaggtgcaaatgactggtaatatgctgaccagatgcaagtgtaccaccaatgatttgctgtgactgagtttggtttcctttgcatatactatccagctttttgtttctaatatattcttccttaagggaaccaggacttcttggggaatccagatgagcttgaaacactgtttttataagagaagggctgttttcaaaaacatctatagttcgtaacaaaggagttagattgaagggactctcactgttcagtctgtgacaagcatgagtgttaaaatggagacaagaattttagttaattgtaatgttgaatttgtaaaaggctataacttcataatatgatcaaggggaacaagcaatctaaaatgtgttaaagtagcattttcaaagtgcggtccagggactctcagggttggtgaggtcacaactgtttttataatattgctaagaatgtatatcactctccttctctccaaggatacggtggagttttccagaagctatgggatatgtggcgatagccttgccctaatggagtgtgtgctttgtgctttgcatttttgtcctttaaaaatgcttggttttaattttgaatacaataattatagatagatataacctacataaaccaaagttatttgcggccctcagtctttaagggtgcacagtggggcctgagactaaagagtttgggaattgatgttctagagaaaagtcagtcttactgatgagggttaatcaattagtatttactgaccgggacaggacaaaccattcattttataaagacacacagagcatttcactaaaatacttttactctgattaagtggtgattttagtaatagtaatgattgtttgattttctgatacctgaaggaaaaagagcctgttgaattgatactttgagggtgttgagttttaggtcactgggtgactgtagaaatggaccaggagaagaactgaaacttgagccttctaagaaatagaagaccaaaaaatgtttagtgttaccctatcccatgaccacaataattgagaaaaaggcctttccgttccctcttccctaccctcccccttctcccctaccctctcctcccccctcccctccccctcctctcccctaccctctcctcccccctcccctccccctcgtctcccctaccctctcctctcccctaccctcccctccccctcctctcccctcccctctcctcccccctcccctccccctcctctcccctcccctccccctcctctcccctcccctccccctcctctccctccccctcttctccctccccctcctctccctaacccctcccaacctttcccctccttctctgtccccctccccctccctccctgtcttcctcccaccccccactccctgtcttcctccttgtcttccatcctcccttccttcctttccttcctgtctttcttttcctttctttcctttttcttctttccttcctgtcttccctcctctccgtctgtctccttctccttgtccccttctctctgtcttgcctttcctttccttctgtctttttctttctttctctttctttttcactcttcctttttttaatttcccttttacttgccttctctctttcattccttccatgctttcttttttttagtggtatgtatactttgtgagcaatcagactatagcttgcagaatagttgggagaggccaaaaatgcccctgagaatgcaagcaaggaacttcttagtgagcatatgaacatcctcactccaatcggaggataacattgttcatacttcaaggactaaaaagctgagagagggtctctgctttctgttacttttagcactcgagtcatttctgcatgtatttctactgattactttttctcctattttggttcatatgttttctgcttctttgcttgtctagtgattttggattagatgagtgacattgtgaattttactgtgcaggatggctgaattttttttctattcctgtaaatatttttttggcattgttctaggatgtagttaagttacctggaaaaagtgacatccttttgagaggcttgcttttaagttttgttaggtggaatcacagcagtctttagccagctcactaaggaccaatactcttctaaatacttaccataatgtcatatgaatttccatgtttttccacttcagctggtaggaacacctgtgtcatctctaagcattgtactgttaattcttctagtagttcttatctggctttgtacatctgctgatcaatactttcagctaaagtctcaaggggacctctgcaaatctacagtgttcactgttcagctttctcttctgtagtaaattgcacagtgaactctagtccccttagccttcctgaacccccagttctccttaactcagggagatcaccaggccccaccaggattcctgtatctgccctgtgacctggagattctctgcaggcaataggttggggcggtcgtagggtccactttgttttcctcctcttcggcttcactgtcctgtgttacctgatgtccaatgtctgaaaactactgtttcacgtatcttgtgtgcttttgtagttttaggtgaaaggtaaaactagtttcttattattccacattggccaaagcagaagttttggaagtctttttttaaggtctaaaacacttctactttgagagtcaattgaaatggtcttttccacaataattattttctgacctatggtttaaagataagtcatgaaaattttatgccactatttttttttaagtctgattatggttaaattcagggggctatttcctcctagattgacagagtttataatgtttcctactcacaataattgtacttctgcttcctctttgcatgtgttactttaatgggaatgtatatttccttttcgttaaggctgccttcaacaatttgtcataaagtcacttctgttagtgaattctattttttctgttactttactctatccttagtaccaaagagctccttatgtgacaccaatttattactaaaatgtcgctttgtttatgttcttggaattcttcatacattgactatcctcagatgtcgaatgttgtaggcctgtgtggcagggactctcttccatttattctatttttaatctaattcttgacaaaataaacccaatttttcttttcttcccctttccatctcacgtagggactggcataaagggcaatccataaaattacaaatgatgaatttttttggttttaactattattcatacatttaagatatggtcacaatttttatttcttactagtaattcattttattttttaacttttaggttctggggtacacgtgcaggtttgttatataggtacatttgtgtcatgggggtttgttgtacagattatttcatcacccaggtattaagcccagtacccattagttatttttcttgatcctctccctttgctcactttctaccctctggtaagccccagtgtctgttgttcctttctatgaaacacaatggttttaattggaaaatttatttttttttcaggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggtaagtactcctcatgggaaattttaatcagcccagtttccttgatatacatgattaatctagacatgttttgagtaaaaacaactttagtgatgttgagatagtttccttctgttcctagtttttgtcgtgagaaagtgttgaaatttgctaaatactttttctacattaattgagataatcatatttttccctacatcctgttaatgtggtatcttatattaattgattttcatatgtttaacatccttgcattccaggaataactccccaatggccatggtgtataatcttttaaagatgctattgaatttggtttgttaatattttgttgagtatgtttgcatcaatattcataaaacatattgttctgtagtttttctgtactgtttgtctgactttggcatcagggtaatactggcctcatagaatgagttaggaagtaactcttgaatgactattttcatgaagaagcttcaataatctgaaataaaatacttaaataatttagttcacctgagagttgtttttagaagcgtatttatttttctattaatgtcttttttgaactatataagaatgtattctccttccactcacacattgatggcaagtgtgtatttgtactctgtggcctgaaaataagatttttttgaataatcttaagaggccatgctttatactctggtaattgagaattacctatttcacagtagctttttctaaaggttaatttccagagaaaagagaacatgtttattaggatatatctcttaatgaattcagtgtatctgaaatttctaaatgacattttcatattttgcatactaaataaaattcataagtacaaatataatgcaattcataagtacaaatataatgcaatttggatttctagaagttatctagttaaaatatgatcttaggatttattttttttgtcttagatttatgaatcttgcttgtttttctgttaattcatttcttcttgtttgctgcatcagtcagatcagagtagaggcagcttgtatagttgatggcacagtttagggttagatggcacaggatagaaatgggtgctagacaaagagcagtcacagaggcatgttagaaatttccagttccagcatcattgatgaagaaaaccatgaggacccaagttgatcaaaggcagccagccaataaagctatgctcatgcgagatgagctgaagtgacattacattaaaattggaagaccctcttactaagtggctccatgcttccctgctagcccctttgggacttccaagaagacttggttatttcaagaagacaagaacccacagaggctgtagtttagtttatctctctggaaacatagagaatatgtataattaaataaaagcactttaatagtgaatcctttacagtgttatttgaaatttatgtcaagtgatttaaaaagtaaaaatgaaaattaataatttcagtggaagtaaattgattaacatgaccaggaatacataaaacttgcatggtcttgtctataaaataaggatatgtcatttaattaggagagtcaaagctcattcttgcgcttaaggtctgaggaactcttctcccatggggcttatgaagggctacactgaggcaacttcctcaatatatctcagccataaaaccaagagaaagtaagaagcagaggacatcacaacaaagctcaattcagtaaaagcaattttataggagtagagggacttgtcaaaaacaaaaacaacaacaaaaaacaatgtccaaatatttattcagcttaatgagtgatgtttttgtttgatctagggttaaaatctagacaaattacagagatgaataaactacatatcctttagtctaccatcctctgaaaatgttactttttgaaactttgattttgataagagctggaggcactcagggagtcattctctggcatggtctttgagtacagagtgattttgctgattaaaagcaaatagattgacttttaaaatcaactcatacaaacaaactgttaaaatcctctaatgagagtgaagaaacctaaccaagactgactgatacattactgctccatctctgcaccaaagtggactcagggaggcctgtaggagatgccaactccttatcctactccccacaaagacagttcttggctatcttcatcagacacaaatgaatggttgaggctccaaagctctctaccaattcttgtgttacactggcacttttaaaaaattttgtttattttttatttttaaatggagtctcactctgtcaccctggctggagtacagtggcgtgatcttggctcactgcaccctttgcctcccgggtttgagcaattctccctgcctcagcctcccgagtagctgggattacaggcacccgccactacgcctggctaatttttgtattacttagtagagatggggtttcgccatgttggccaggctggtcttgaactcctgagctcaggcaatctgcccaccttggcctcccaaagtgctgggattacaggtgttagccaccgcacctggctggcacttctcttaaaactaatatctcaagaagttttttctttaagaatcttctttcaattgcaggtccatgtagttctggtattcattaaagtgcctatcccaggggttttggtatgttgtgtttcaattttcatgtttcaatttttttgatttatgcattaattttgttttttcagaattcaggtgcaggttgtttagtttccatgtatttgtgtcgttttgagaattcctcttgttcttcatttctaattttatttcattgtgacctcagaagacacttgcattgattttgattttttttatcttattgagatgtgacttacgactatgtggtcaattttagagaatgttccatgtacagatgtgaaaaatgtatattttgtgttgttgggtggaatattctgcagatgtctgtcaggtccatttggtcaagagtctgatttaagtccagtgtatacctttgttagttttctgccatggtgatctgtctggtgctgtgagtggggtgttgaagtcccccactattattgtatagctttttttccccataggtctagtagtatttgttttatgaacctgggtgctccaacattgagtgcatatttatttaggatagttaaatcttctggttgaattgaaccctttatataatgccctcctttgtctctttttgatgttgttggtttaatgtctgtttcttctcatacaagtatagcaacatctgttcttttttaattttctatttgcatgctagatctttctccatcccttcactttgagcccatggttgtcattacatgtgagatgggtctcttgaattcagcagaaggttaggtcatttaaaaaatctaatttgccactttatgtcctttaagtggagcatttaggccatttatgttctaagttaatattgatatttgaggttttgttcctatacatttgatatttgtgtattgttaagtagttgctttctagtttgaattgtgtaattgctctataagatctctgagccttgtacttttgtgtgcttatatggtagcaagtattgttcttttgtttccatgtttagaactccttggagtatttcttgtatggcaggtgtggtggtaacaaattcccttagtgttttcttgcctgggaaagactttatttctccttcatttatgaagcttaatttggcagattatgaaattcttggctggcattttcttttttctttaaggaggctaaaagtaggcccctgatctcttcttgcttgtaaggtttctgctgagaagtcctctattagtctgattggatttcctttataggtaatttggcccttttctctagatgcctttcatattttttctttggtgttgaccttgcatagtctgatggactatattccttggggatggtcatcttgtatcttgcaggtgttttctgaatttcttgtatctggatgttaacctctctggcaagattagggaaattttcctgaattattgcctcaaatatgttttccaatttgcttacttcttcctcttctccatcaagaatgccagtaagtcataggtttggttgctttacataatcccatatttatcaaaggctttgttcatttttcagattctttatgtttgtctaactgggttaatttgaaaaggtggtcttcaagctctgaaatcttgtcttctgcttggtgtagtctgttgttaaaacttccaagtgttgttttgttttgttttgttttgttttgagatggagtctcactctgttgcctaggctggagtgcagtggcatgatcttgactcactgcaacctctgcctcctgggttcaagcgattctcctgcctcaccttctggagtagctgggattacgggcgagtgccaccacccccgactaatttttgtattttttagtagagacaaggttttgccatgttggctgagctggtctcgaactcctgaactcaggtgatttacccatcttggcctcccaaagtgctgtgattacaggtgtgagccaccatgcctggcctgcttccaagtgtattttgatgttccctttagtgaatttttcaattccaaaagttctatttggttttatcttaatatggctatctcatgtttcatatcctgcattgtgtttctggtttatttgaaatggattttaaatttctcttggctctcactgagtttccttgcaatacatattttgtttttttagtctgtcatttcaaagttttcaacttggttaggatccattgctatagagctagtgcaattctttggaggtatgaagacactctttttgtagtgttggagttcttgggcagattccttcttatctgagggagctgttgattcttatttttgaatttcctattggttgggcgggacttaaactttttttttttttccccttgagggtatgactatggtgtatgttgtgtgtgatcattcaactttgtttctgggtgctttcagggggccaaggctctttatggattccttgggcgtggtagctttcttaaatgctgcttattgtagcaatgtattggatttgtgagctgacactctatctcatgtggggctgagggtgcagaagtctcaggaagcttattttgtggagtagtgctaagcctttctggtagtgggctttttatttgatagtacagttcaggctgcaatccagtagatggcacttaaaaaataagaaccagcttgccctcagttaggctgatgtccagtagaagcacctgtcctgacaggggagtgacaggaagagattctgttggtgtgtgccgaggcctttggggtcgctggttggggggagatagggggaggtgcactagctcctcatgcaggaatgtgatctgcttttctatcataccccatcagagggctcatgaccttcagttcataaagattttttccttgggttcccagccatagtctgtctgtaggttatgcatatgcccctctgaaggcaaccaccaaaatggtcttggggcagagcctcttcccccagtctagggcagacaactccatgacttgtatgtcctccattgctgggacactgctgctctgtgtagggatggggagttgggccccaccctttatgtaagcctaagtggcattctcactttcagcaggggtggagccatcttgaaaaccatgaaaaactctttcttcgagtacctgtgctggcccccagtgggaagaaccactgctgcgtcttcaacagcgtgtggggtgggagggtattgccacagatgaccccctctccatatccgttccttgacatggtgttgccccctttagcgattggcactgtgcccacctttcctttgtcccaaaggggttttggcaagttgtgtccctctcccttataggtggcctacactaggggggttagatctctagaggttccatagctccctgggaacttgctggccccctgggcttttcaaagtcagaacaggttatgaggtatgtttgctggggatctggtgctacagagactcaagggtagagaatccctgggcagagcagaggcccaccactggtgcacaagcaatatggtgaccaccatctcagtttgtgtctgaggggagtatgggaacccctgcaggagctggccacccagttctctatccctgggaaattcctaaattaccaccaataacattgccctgggtcacaagggtggggccttgaattctttgggggttgatctctgccagactctagctacttttcctttctgcaccccagcttcttcccatgggcactccaaaaggtcctggctctctttccccagttttccattagaaacttgtccatttgacagtaactttgatcttctttctaagaagagctggcatccaaggtctgtggtcagctatgttggaaaaaagaaggagaaaaaaactagtttgtattaaattctgaaagactagtggcactggttaagtctttaaaggattgttaacaaaagaaaatctttttaaaccaaactcctaattttatcagaattgtaactgaaaatataaatgtatgaaaacataggtattatgtaaaatttgctcaataaaagaataggaaaaactactatttatcttggactgatagcatgttagtttgagatttgaaccctttctactctagtaagtagtggtgggaaaaattcactgtaggagtctgcagacataacaaactatcattagactgccaagacctccacataataaagcaagcagagaatgtcaaataagtatgtgaaaaatgatcaaaaaagagaaattgaaaatataaatagggtgctattaaaaaaggatagcatttatgttatgacatatgtacacatgaatatcactttttagaatttcatccttcttaggacttattcctgagtccgaggattgagaggttctgataaaataagtctcagtgggttccaggcatgggctttctttaaaagtctctccagggattctaatgtgttgccaggaccaagtaccatggacagccaagatctcatcagcacagtttgattgaatgaacttatgtagaaccctgaatgccacacttaaccaaagaaacctttccagggattaattataggtgacagaacatgctatattcttattaaatattattaaaagttaagcaatacccattcctgattcatgtaaaattctcacttattttccaagagttttactgtatgactggtttatgggatgcttggaaaaggttgacagacatggcaaaggttcctgcagtgtttctctttgtccatcaacagccctagctcataacctctaccctttcagctaaaagcaattagctcttcagaagtgattcattctatttatacttgggataagtaacatcaggcagtcttccctagggcttctcacgggccctggtggcatttttattctaagagagggttatatttttacatgtaattggtcataattatactaaaaacaagtaattggtgtcttatacaagaaaattatatttctgctttagtcattgacagagtatcctgagaataagagttaagaagtatattcattgtcatcttatttctgatatatttcaaattcttttgctaggaagaagcccttttgactgtgctttgtgtaacaaaacttcttcggagaaacaatttagataaactttgtcagatcttatgtgattatattcaaaatgctaattgaagattctctaaacattttcagtaaaatgttgaattgttttcatgctgttaaataagttaacatgtcttcctttactaaagtcattattataaaaatgtaaatcctaatgataatagctgatgtttattaagcatttagtaggttccattttttgatagcaacttttatgaattatctcattaaatcttcataataatagcatcaagaactacaaatatgttttcatgtaagaagggaaataaaattatgagttttgctgtgaggtttgaagaatgaaaacaatgcatgacttagaaaatagtataattaagtgaattttattatcattatcatctcttagtttataaatgaaaaaactaaggcttacataatgtaaaaatcagttaacaaggttaaacaaccggtagatggtagaggaggagctgggaataaatctgtacatgtctgaatctggagcaggaacccttaactgatgtgtcattctagcaggtcatcagttactctacaatacctattaagtatactttatttactgtgtttagatttatagtagatttagactctactgtaaaaacaaggacttcatacacctgctagaaagtatccatatcatcttgtttgaaagttgtcccgctctagtgttcttttctaatcatgatgattcagaactccaaactcttgaagcagggcaacccgtagggtcagcattcataatttctcaatacttaaaaaagtttcctcatgactgttgctattattgagatttctcaaatgtcttggcctgaattgggtgtgcactatgaaaaaaaaaatggcagacatttctttttgttaaaggaattttaaaaacacatataaacacactgatttgtgacagattaccaggctttatgtttagcagggtttcctaagcaaaacacaaattctgtaaatctacagaattagataaaacattgactcaatccttagatgagagtataatggattatcacttaataacttctgtcactgaaaataaatgatgtaaaaagtaataaagttctactctcacagtatgaataaataggaaatacataatactttaaattaggcaacaaatcattaagcccccagcattcattagactatcattaatgataataaaattgtgtggtatttatacagatattatatgtaactccaggaattttgttataattgtgtatgaatatatttgttgtttgaggcaggtagatggatatttgcagcagctatgtgctgaagcattctggtaatagttttcaaatcaaccatttttttctccttgtcgatcatctttaaagcaaaagcaccgttttttactatattttttgaaaaaaatacattaggtgtaaaattatatattttgaagaagttcactttctgtttttactagtttcacacctttgttattttttcagtggaaggagcagagataggcaaaggcgaagcctgtgtgtgtggtcaggttcctgggcccttcatagcatctgatgccaagctgtgttctcttttgtgtcattgccttcccacttgctaattacgtgacagagctagggacttccctctgtctagaatgccccccatctcttgtttgcctagtgaaatctggtttgaagttcaaggtctgatacaaaccaggtgatcctctgcaaaactaactgtacctgagcaaaccaggcacttactcttttatatgttcctggcactgctgatactctgatagaaaacatcatcacttaatgctaactgtgggctcacaaaggggatacttctactgtaagaagactgtaactcttcttagcacagagattagtaagtacttgaaacagagtttcacatataataagtgttcaataaattttattttttatttctaacacttggcacactgcatagctcagtaaatgttggtgaagtgaactgagtattctccttatctattatgtggtaggcattattctagttgcttctgttataaaccaactcatttaatccttatcacagcacttttattgtggtcaatattttttaatcctcacagatggctaaggaatcagcactctgagagattggttgacttgctttgggtaaggtgcttataaagtggtagaacaagattcctatccaggccttctgattcaaaaatacattctttttttttttttttttagtagtgttttctggaaaggcagggtataactgactatgctgtgtatttgggactaagtatattattgtcaagtatattaaaaatgtcgcaacactggaaaggagtccatcaatgggctatgcaggttgagggatttgtagatgagaaactgataaatttggttagcaaggaaagccatcaagctgtgaaccctttatattggcaaaagagagggtcctttgaaatctaagggaacagaactttcctgttctccaagtttggagcagaataggtaagctctaggcagtctaatgcccaacttttaccagtggtgttttagttttttttttttttccaaaaggaaatgatggaattctttatatacttctgaattgtctatcttttcaaaaataaaaattttcattttgcagtacatacagaatcaaaagactttcaagtcctaactccacaaatgtttattttgaagctctttaaactgtttaccacggatattagtaaatctgtcagaaatgaggtgacttacttatccttgtcccaccagatatgtgggaaggatgatcacgctagatagcatggatgggtcctctatttatctctttttacttgaatggaaaacacatcattcagattaatcaattagtcattgtgactgatagaatttttatatggataatctgggtttggtccctagctttaccacttacttggggtctttatgtcttctatggtctcctatctgtaaagggaagttgataatgccaatctagctaggttactgagatgcttaaatgtgtaatgtatgcaaagcagcaggtactcaataaagggtaactcttactattattgtatagctctccaggtatgtattgagcttctatagaatccatagccccaaactctttagccctttgagaccaagattaagcattgtctttccagaggagagggtgagagagattgccattatactaatagaattcatcattatcaccgtcatcatcatcatcatgatttcttggtgtgtcatggaatgtactgtgtttcacattaccaacagatgttaattttcacaacatccctgagacaagaaactatgattacattttacagataaggtcatgcagctataaagttgtgaaattgggattcaaactcaggcagtctgtccccacagtccatgttcttaacccaccatgctctcctgacacttgaaaagttaggaggcgtactccatagcctgtaatgttgctgcagagagaatctaattttaaatccagtgaagcatattagttgctgtctttgatatgccattcagattgtgctatccttatgatgcctaccttggttgtatatgtaactgggcgtcaaatatataaatactcaaaaagtgataggtgccaataaaatattttatagttaatacttatgtaatctgtgttctctgtgtttgagggctggttctaaaatactgctctatatttgacttctggttaaaacaataaactttgctcatattagttatatagttgataccattctcatgttgctaacatgtctgtaagtaacagttgaaattgatctggcaattttagagctgtcagacccaggagatgagagaaacatttaaaatgtttataacattaaatcagctgagtcaagagagagaaagagaaagatgattcagatttcttgtactggtggatgtaagtgcttggaactgaaataaaggagaaggtgtagggagggagaaagataaagaagtcttccctttatacaagttgaaattgagttttctttgagatatagaggtgaagacattttaagaaacttcttaaaactctctaatgtggcttttcaacctgtttccatcaatttggcacatctcacttttcggcacaacagaatattctaggtttatctcacaccttccttgccccagcccaggaatcagccatttctctaagaaactcttgtttattttggtggggaacagtattgggaaaccaacatctgggagctaaatatactcctagtggttaggaggtcataccttgtagactcttgtagctgacggagttaggacatatttattagaaatcataagtttatattgatcttgctaggatctatccaatcctacaagattcttccctgtgtctctcctttgtatttgtgtatcctttcttccatattaagaactgtggctcccaacaacaaggcatgtgcccatttgcccaatcgtatgatgtataaaaactactttgagaaaagtggcagccaaaccactaagaaaaataaacttgctgaaatgagttcaagatttattggcagctctttttttggcccctagactgaaagtatatatttcaagtattgtgttcaaaaattatttgggttagctttttccacctttcataatagtaatattatttacttgaaatacagttggctttgtttctatattcagtttttttctctctatcttcattaatttcattatatatatttaatatgtaggacattaacatgtttccaaaagaagaaaacactccttcctgtatcatttccacctcatctctcttaccccttataggtaaccaattgcactggtttctagtttatcttacttatattcctatttgaaaagttacctcatatatgtatgttttttaaatttttatacttttttacacagaaagtaacgttcagtatgtactttgccactttccttttaaacttaacagcgtatactggaaatcactccatatcgtgtcacagagagcttccttatattttttaatagctgtataagacttcattgtgttgtctgtaccatattttattcacttccccatgtgtggacattttgactgtttctagtatctgcaattactaataatgctgcagtaaactttgtgcatatcgtaccttggtaaatttctagacatagatttctgggttaaaggttaagcacatgtgtagttttgttagatattgataaattcctttccatggggtttatatcatttttaaaatatttaccagcaacgtataacagcgtccattacttcaaagcctcaccaacagattgtatgttttaagtacttttatgttttagaatttttccaatgcgataggtaaacaatggtatatcaatatagttttaatacattaaagttcagcatcttttcaagttcggctagtctcagggctattcttaatatcttgtgaattatcttcatattattttcccatattccataatacttttggttttttttcctcctcaattctgacaagttctttatatttcaggaatattagccattttatttgatatgttacaaatatttttctcccaatatataacttttctcttataacgatttttttttcatgaaaagtttttaattaaaaccttttatgggcccaggtgcagtggctcacacctgtaattccagcactttggaaggctgaggtgggcagctcatttaaggccaggagttccagaccagcctgaccaacacagtgaaaccctgtctctactaaaaatagaagaacattagctgggcttggtggcacatgcttgtgatcccagctactcaggaggctgaggcatgagaatcacttgaacccagcaggtggaggttgcagtgagtcaagatcgtgccactgcactccagagtgggcaacagagtgagactctgtctcaaaattaaataaatatataaacaaaaccattatgggccaggtgcagtggctcattcctgtaatctcagcactatgggaggtcaaggtggttgaatcatttgcgccaaggaactggacagaccagcctgggcaacatgggaaaaacctctctctaccaaaaaagaaaaaaaaaaaaattagctgggtgtggtagcatgcaccagtagtcccagttactcgggctggtcacatgagcctggggaggtcaaggctgcagtgagcagtgattgtgccattgcactccagcctaggcaacagagtgagaccatttctctaaatacatacatacatacataccttttgtggagttaaatttacacactttttctttattggctctggcttttgcattgtagtaagactttctttacactcaacttatagataaattcacccatgttttcttctagtacttgcatagttgaattttagatctctagtccatttggagtttattttttgtatggtagaaggtattgatcctattttttcccaaatagttgttacccagttgtcccaaaacaagttattgaaaagtccatctttgtcccagatagactggaacaaaatgaattaaagacttaaatatgaagatttttacttgtgtatcctttcttcctagaaagaaaacataggcgtaaagcttcatgacgttgaatacttcatgccattggtctggcaataatattactattatgaaaggtggaaaaagctaacccaagtaacttttgaacacagtacttgaaatatatactttcagtctaggggccaaaaaaagagctgccaataaatcttgaactcatttcagcaagtttacttttcttagtggtttggctgccacttttctgaaagtagtttttatacatcatacaattgggcaaatgggcagatgccttgttgttgggagccacagttcttaatatggtagaaaggatacaccaatagaaatatttatatttaagtctggcaatcatttttaagatgtgaacttgaacaggcaacaaaagcaaaaataggtacgttggattacatcaaacccaaaagctcttcacagcaaagggaacagtcagttgagtgaagagacaacctatggaatgggagaaaatatttctaagccacacatctgacagagggttaatatccaaggtatataaagaactgcaacaactcaatagcaagaaaacaaataacatgaataaaaaatgagcaaaggatctgaatagacatttctcgaaagaagacataccaatggacaacatgaaaaaatactcagcatcactaacaatcagggaaatgcaaattaaaaccacagtgagatatcgcctcacacttgttagaatggctgttatcagaaagataaaagataagtattggtggggtgtggagaaaaaggaactctagcccactgttagtgacagtgtaaattagtatagctgtgatggaaaagagaatggaggttcctcaaacagtttaaagtagaactaccatatgatccagcaattccacgactgggaatatatccaaaggaaatcagtatattgaagagaactgtattttagtgattattgcagcattgttcccaatagccaagataagggatcaatctgagtatctatcaatggacaagtgataaagaaaatatggtgtgtatacacaatgggataccattcagcctttgaagagaaggaaatcctgtcatttgccacaacgtggttgaacctggaggacattagctgagtgtaataagccagccaccaaaagaaaaataccacatgatctttcctatatgtggaattttaaaagttgaactcaaggaagtagaatagaatggtagtgaccaggggtatgcgataggctgagggatcaaggagatgttggtcacgggatacaggatttcagttagataggaggaagaagttcaagaggtctattgtataccatggtgagtatagttaattataaagtatacttgaaaattgttaagagtagattttctgttcataccacaaaatgataagtatgtgagataatgcatatgtaaattggctcaatttagccatttcacaatgtatatatatttcaaaacaacatgatgtacatgataaatatacagtttatttttaattaaaaattttaaactctctaattggtcttcaacatatagtacacaagtcttttcacgactctttataatggaacatatgttcttggaatgctaaaaattattttttttggaggccctgcaaataactaaaaatttatcttaaaagccacacctaattacttacatatgatccagaaaggatactttgaaaaagctttttaattgataaaatcattaaggtaaaacatattcataaaagtgttctctaataattttataattttctagttcatgaaggattaaatatacaactatcatttgaattggattttttatgaggttaattgtatttaaatgctaattattttaactaattttgtggttgacttctatgtagagtagggaaaaagaatttcctaaagccagttacgtatatctctttttagtctggatttttaattaggaaaagtgatatagttaaataggtctactctatagcatcttctaaaatgagtaaaaattcattatatcaggataaaaaatgataaagatatatggatgacacatttggctgaatttttcttcttcgctgttctcttgctctctatttaaatagtcttagctcttttatcatttaaattctgaagtattgaggtgattattccggcagcaggtgattctgctaattactgttcagtcagttttagctattagaaacagagatatgtttacattgctgggctgcatgtaaatttagaagttacatggctttgtttttactttgacttacggcattaaaattattttcatctgtgtatgtaaagatctgcatctataagcttttgtggataataaggtgaaattgatgcattttaatataaattgccaatataaaatatctctaactcagacctctactggaaagttgtcaaatcttatgtaggaaaggcttttaccatcactgttacacattaactgggcatagtttaatattaatagctcctgagacttgtggttaactgaggtttctatttcctgtgtttgggttttatctttgcaacaacttggttgcttttctgtgtaaaatagtggtgaatatacacaagagtatgacaaggttctgggctcttaactttgatgaacaccatgccatttccatcatgctgcactcaaaacagcacagatgtgagtctgggagtggcgtccctgccgctctcatgagcctttgtttggagaacaccctgattaacccccacccttcacggttcattgactcactgatagatcaagtttaaactagtatatattagcacatttgttaccaacagaggaacagttggccattctgttttacattgctggttcattgcaaactggcgtgctaaaaaggtctgtactctagagtatgaattgggaagttaccaaaggactgagaaccaagtcagttgcatattaatgttgaattatacctatattttaatcttggattgtctacttgggggatgcttacactgttgtcaagttatgaataagtgataattaccactttgaaattcatctttttttttcaaggagtttaggggatttaggtgtctcaatatagctttcatattaaacagtttgtcataattggatgagagcagagcaaggtcatgactacctgatgccttgtgttggagcattttaaaaatgttttccagagagttatttgtacctaatgactttacataagtccttacattatactttatttctaggtcacctaaaaatgttaattgtttagtcaagagggttaggatgtgtgtctgttttctcatgaaaaaaattaagctgttccctttttatcaattttcttgcaatctaaaggcttttttttcttaccttcctaacctagtgactaaggtcatcttattgttacagttcctttcatgggagataggtttactgcatcatttggcagtttcatagggtgaattttgtcttggcttcatctttccttactggttgtcatcccctgggccacctgcttttttgcattttcctttctcttgtgagatgatgaagctctgtgccccgatggggatgagagacagcactctgagttcaagtctaggataaggcaatgggcttgcttttcaaaacaaactagtgtcatacgggctgctgctttcaggtccactgtctgattttatcactgatgacttgtttctggaaggcaaactgatttaagttctgagcaaaagggtcggtgtttattttcaatgctactattaatttagagttttaatttagaaaagattttttaccagttctcaaatatgatttttctattgactttaagtttgtagatataaggagtagacatgagatagagactgaattgcttttttgtttttaaaacttggcagtaataaggggttgcttgttttttcatgctaaatattttttctaagggatctagatacctatcagaaaacttaactttgataactctggttctttattaagtatttttgtcttattttaggaattaatagaaatagttgtaattttagacttcctttataaaataccaatttaaagagaagctttttgcttaaatgattgttttgcagtgttgtgcttttgttttctttaatgcagttgaaatcgcagctttataacttattttttaatttggggtttttaaaagaatattagttatttatttatatttattgggcacctactgtgtgccagacactattctaggaactagtaaacatagcagagagcagaatcatgaagttcttgacctcaaggagcttaaatcctagtggtagagggggaattcaaaaaaatcaaataaatgtatttctattatgtcaagtgatggtatgtactaccaggcaatcagatgaaaatatttcctcttctatacacagtgggcaaggaaggcttcattgactgtggagttttagaagaaagctgaaagtaatggggaaagagagccatatcgatatatgaaggaaaacatggtccaagcagaggaaacgaaaagtgcaaagaattgagcaagaaagtcatgttcaagtggagtcagcaggggaaagagtaggtcacaaatgcggctgagggtgggtcatgaagggccttacaagctttgtatgagtttttacttttattctgaaaaaaacaaaaacaaaaacaaaaaaaaccggggagctatttggggattttaatagaaaagtaacataatttccttttaaaatggatatgtggccactaagtggagagagtggtgtatatatgagtggatggaataattgatacaggcaagcaggagacaggttaaatgaaaaatggattaatccaggcaaaagatggtgacttaaattaagctgggagtgggagagatggtgagacatgcttagactttggattcatttttccagatagaactggctgacagagacatgtcatttaccaacatagacatggcagattttttttttcttttctgagacaaggtcttgctctgttgtccaggctggagtgcaatggtgtgaccatagctcatggaagcctcagactcttgatatcaagtgatcctcccacctcaacctccctagtagttgagattacaggcatatgccactgtatccagccaactttttttttttctgtagagacaatatctctctgtgttgcctagggtagcctttaactcctggcctcaagcattcctcctacctcagcctctcaaagtgctgggattataggagtgagccaccatgcctggccaatatggcggttattaagaggataagtcaaagattacatgaatattctgttatgaaaagtgtcaaacatatagaaaatataaacagtattccagtgggcacccatatttttatcaccttgattctacagatcttaacatttttctgtatctgcttcaaacattttattctgccaatgtgttctaaagtaaattgttgatattgtgatagttctctccaaaatgctgcagtgtgtagctctaaaaatagatatttttcagataaccaaatatcattaacctgccaaatcaatgaatgataattgcttattaacatttaatacttggtccatagtcaaattctccatattttccataatgtcttttatagttaacttttaccaactagtgtctgatcaagaatcattcatttaactaattacatttaaactgtaacattacaacatgttttttcgtatgttttattctctctgacattgacttatggaagagactagattatttgtcctgtagacattttatcatacataagagttactaggagagctctgattactagtccccactctcagaaattttgattcagttgctctttccagtgagctgctggtgatgctggactttcattctgaagaccatactttgagcactactgctgtaccactatccgatggcttctttgtgatatcgtttaacttgttgttctgttgcctgtatttcctctaaactgaattttcaatctaaaggcttactgagattcatgtttgatactttgggcaagaatacttcataagttctagtgcttaatgttaggtagcacttaattctgactatttcactattcatgaggctaagctaaggaggtgacagcctgatccttctattgtaatgtttcatgtgaaactactagataatttgttgagttggggggtgggtagggaagagatatctagttttcaataaatatttcacctaatggttttaacacacattgatcatccttgcctgaactaattatttaattagggatggcaacatggagactttctaattcaatctttttttttttttctaaatgaatggccttgtttttatttttaaatggatgttacttcgcaactggggttatttgattacccagaaatatagcgcatattaaaaaggtaggataaatgcttagttaactaattaagcaatttttaattaccagttttcacagtaaggcactaaagtttctgacttgagcaaagataaagtggaaagataaagtggtcgtttagtgagatgggcaagactgtggataggtagactaggtttggtgggaaagtcagaatatcagttttgaatatgttaagtttgagatgtctattagaaacatatgttgacgaggccaggtgcaatggctcatgcctgtaatctcagtactttaggaggctgaggtgggcggatcacctgaagtcaggagttcaagacgagcctggccaacatgtgaaaccctgtgtttactaaaaatacaaaaattagctgggcttggtggcatgcacctgtaatcccagtaatcccagctacttgggaggctgaggcgggagaatcacttgaacccagggggcggaggttggagtgagccaagatcccgccagccactgcacttcagcctgggtgacagagcgagactccatctcaaaaaaaaaaaacatatatatatatatatatatgttgacaatatttcagttgaataaaataaaatattctagctattttaggtagaaaggcattttataccgatactactactaaagggtaagaagatatgactgtagtacattaaatatgctgatggcctacaactgttgctgtgttgctttttcctcttcaccacacatatgcagcctcatgaaacattttccatgaccagcacactgaaggaaataaaaggaacctagtttagagatggttctgcatgatacaacaaaaatgagctgctaaagcattacaatcccactcaagagtattcccccatcaaatagtggggctggtattttaatcagttgatactaattgtcaaggtgtgatggccaagggattgatgtttatcagtgtatggacagtggttcagagtttggtgaattagtcgagttgaaagagaaagattggtgacaaagatgtatgaggtggaaagtatactttcacagaataagaacagaaaatgagatttatgtttttttgtaaacgttcaacaaagaaaattcattcagaggaggaaataggtaggcaagatgccctattctacagatgttagtcagcatcactgcaaagcaacctcagggcttatgcagtggacacttaaaatagcactggtgcagggatgggagaaataaatggatttaataagcactgctgcttaccaaggttgattgaattgccactattgccaagtgttctacctgcaaacagatcaaccttgagccctggatatggcaccatgtcccagagcaaccagccagccacctggtggcaggttgattgcattggatttgctccattatggaaggtcagtggtttgtcactgctgcgatgaatgcttactgtacgtttggatttgcattccctgcccaccatgtttctgtcagcaataacatggccttattaaagccttattcaataatatgacatcctatataatattgcttttgatcaggagactcattcacatcaaaataagtgaggcaattggctgtcaactacaggattcactggtcttaccatgttcctgttgtagcatattgtattctacctggaagatgaaaccttgtgacattaaagtagtttttagttccataaacataatacaggggtctatgaatcaagaagtggaggtagaagtgttgtcttttacttcacatctaatcacatgttcaaaatattttttcatcttgcctctgcaactttgaactttgctgacacactgaggttttagtgtgaggaaacaatactttcacatgggaacatgatagtcgttcaattgaactggacatttagaataacctggccacattactgaactgtataactgaaacaacaaatgaaaaaaatgaagatgctacgctggcaaagatgattaattttgattattgggagaaatagtattgctactgttaggaggaagactatatgtctagaaactaggaggaaacctgggttgcctccttgtagcagggtaaaatgagtgagtaccttgtctaagaaagggaacatgaccaaactgaacccagaagacataggaaatctaaacagatcaattaacaccaaagaaacgggcattttttggtacttctaaaaaagtaccagactgatattttcacagagatgttcgttatacccttaaggaacaggaacagaaaacttctatactatttaaactattttagaggatagaaaaggaaagaaaactccagattttatttatagaacttgcatgaaattgataccaaattctgacaatgcaagttcaaaaaggaaaactagagatcagtgttacttatgtcaaacagctcttaatagaatagatggatatggttatcaacatgataaatatgtttatcacattttaaagcctacatggagaaacatttgaggttttcttattctagaactgacaggaatgtcctttattatgagcactattagtcaaatttttctggtggaactaatgtaagtagactgctgaagaaaatgaatggtatgaacattggaaaggggaaattaaatgattattatttacagataaaataattgttaagctggaaaatccaagtgaataaagggaaggcctacaattaagcagttaaggaaagggctaggtatagaaatcaatagttttgatatatgcaggctatagccagttaggagatcagttaggggaaaaacacgttgacagcagcaacgaaaagctgataaacctagaattgttcaccacttatcttaaaatgtttaacatggtactgagggacacaggagattatttatgtggaaaaacataccatgtttctatacagaaaaattgaacatcacaaaagtattatttgatcttaagataatttatatttaatgcaatctcagtgaaataccaggagaatgtttttaagctagacaaacttatttcaaagatcatatgtaaaaataagcaaaaatagatgtgaaaaattctttaaagtaatgagagaccagtcttattgactattaagtcattataaaactataatgtttaaaagatggtactgacatatgaatagatcagtggatctcagatgggcagtgcagaaagagatccaaacacatacaaaaatttagtacctctaaaggtggcatttaaaatctgtggggaaagatggattttccaatgaataatgttgggataggtagatagccatctggaaaaaatgaaagtcaaatcccaactttttaccttttatcaaaatgaacttcagatacaattgaaaatataaaattgagaccataaaagtattagaagaaaaatgcagtttttaagtctcaaaaggggactcttaaatatcatacaaagcccagaggccataaaagagatgattgataaattcaaatataggtccgtgtaagcgaaaactttcagtatggagaaaacataagttattaaggcaaatgacacactaggaaaagcatttgtaactcataacaagcctagttttcttactgtgtaaagtactgccataattgacaaagaaaatatgaagaattggcaagtgacatacatagaaagttcatggaaaaaataactcttaaacatttacaaaattttacaacctctcatgaaaagagaaatggaaattgaaattagagtcacatacagtatttcacttttcatttgtcaaagatcaaaaagtttgaacatactgtgggtttatgtttataaggatgtaagaaaacaggcaatctaaattccttgtagagtgtaaattggtagtaataagagaaaaatttactgaatactttgtgccaggtgcttttctaagcactttacatttaattatctcaattaacttatccagaaagtaccattatttctgtattacacgtgaggaatttgaagaaaagttagacaagtaattcaaagtcacacagttaataaatgacagagtgaagatttgagaccatttcctttttctcaagtgtccacttttggtcgcaactctgctgtttctgtagtgagtgatttaacactatatgataaaaccttaagagtacgtactctttgatccagtgattctacttccagaagtttgtccattttgcatcaaatagatggagaatagcattcattgcattgttatttgcagtaaaggaagattggaaacaacctgaacatttatcctcaaggactcatccatacaaaagaattgaagtaaattcatccagatgaatatgaggcagctttagatagagtgagatggcatcctatgtagtgatatggagtcatctttaaaatacagtaaaaggaaaaagcaagatacagaatagcatgtagggaagctgctgtctatgtgaaaagctgtagaatatacgtgcatttttgtatatgcatagaatattcctagacaaggacaaacatggtggttcatacctgtaatcctagcactttgggagactgaggcaggtgattcacttgactccaagttcaggatgagcctggccaacatggcaaaaccccatctctagaaaaaatataaaaattagctgggtctggtggtgtatgcctgtggtcccagctacttgggaggctgaggcaagaggattgcttgagcctgggaggcaaaggttgtagtgagccaagatcatgccactgcactccagcttgggtgacagagcaagacaccattcatctctctatctcttttctctctctctctttctctgtctacacacatacacatacccccccacacacatatatatacacacatatatgtgtgtgtgtatatatatgtgtgtatatatatacgtgtgtgtatatatatgcgtgtatatagatacatttctagaaggattctcaaagtgatatcagtgattgttgtgcaagaaggaaactagatatcagtgaatgcgctaaataaggtgattttgaattctgtagcatgtgtatgatttacctatagagaaagcagtctagcatgagcgtgggtttctcaaatatagaatgtttgcagtgaggtcacttggtgaaaagtatagccatgtcagacagatgtaggttcagattccaggacttccaggactgctgaaagggaaaggggctttggatctccttcagctccaggcagcattgctcctttcccagctttgacattagctggagggaagacaagttcttagagctctatgtgcttgggacaagaccccttccccctactgccttactcgccaaccataactgctgcaaacaattcttacctcttccaccccatgtcactgcctaaaacccttcatcacctggcctcccatgcctctaagtctctgtacatcccctagcctgatactgtccccaaccctcctcaactccagacaccattttactctaccctctggaattgtccattattagcaaaatctcctttattttcaacctcctttctaagtatttcccccacattcttgttgtaatagagacacagctttcccaggactgtatagctttccttgcagtcctctaaagtggtaactggtttctctgccatacatttcataccactggtcctggagatattgtcaatatcttaatgtcttccttccatctcacttaaattttgagaccataattcctttttcctctcttaaaagttctcagtgttgaagctcaatccattagatacctctagctggcactactagttgcagtcctgtgcagactactgagtcattttctttactccctgaagacttaaactctatcttactctcactctctctgacattactcctattaaaatgttatgtttctttagctattctttcagtttttggtctcctctccttcaacgaggatgatttctagaatgttggttctcaaaatgtggcccctttgcagacatcgtcagcacctgggaacctgttataaatatgaatctgcagaccacaccccagactactaagcccaaaattctgggggctggagcccagaatctatgttttaagaagcacgtcaggtaattctgatgaatatgccagttccttagatcttgttattgtcattactgacaactttctctgagaccacaatttgaatctaccaatttttcactagtactcacccatcttaagtccttactttccccttaccagccagacatttgaatattccttgactcttctctttcacatactatatccaaagagtcaacaaatgctgtcagctataccttcaaaatacatgtagaatctaacttttaacctccactgcagtcacttcagtccaagcacaaccatttcccacctggagtattgcaactgttcttgtttggtggcccttggccctactttatctactttccgcaaagcagccagagtgtttctttcaacacctaaggttatatggcttcattgattgaaattcaccgtgcttcacctctttctctacaaaagccaaagtccttgtaaatgcctgtaaggctcgagggtgatctgaccttccctggcctgtcgtgtttcggtaaaagtaagctgagtctttcatagttaaaggacagcaatattgtcctgcatgatattttaaaaacccaatcaagaatcacacattgcatttaattttcatgcctttagtctccattaaaagtgtgccctttgtattaataattggagtgatgagggacagagtttaagaatatataaatattttgtccccaactgactgtcactggatggctttggcacccattggtgattcttacctgaatcagtaattattgtgatgactgaaaatagtgatttttctcactgtataattcttctatatttattaattaccttaatattatcctatagaacagaatgttcccttctcatcttttgtttgtttagtgtcagtattactcatgaagttgggtgtttagaaaattcaatgttgtataatactgttattattcaatattgtattttctcagtttgagtcttccatctgcgtcctttcatgtaaatagtataaagatcagtaatagaggaacatagagtaaagtgtgagcagagaagccttactctgagacaaacttcagagaggtgaactctgttgctgattaagaaaggcttcactgaggaagtgttgtttgaagtgagctttgaaaagtcataaaattttgacaaaagtggggatggggtggagcttaaaggaaaaactgtctgaacaaaggaaggcccggcagactaggaatttggcaataatacagtggttttggaccttgatgaggaagttgaaatggaacataaaaaccctctgcatttagctccatttatttgctcaggcagctctcactgcctaaaattttcacccctgctgttttgctcaggggtgggatgaggggtaatgagggaggaaattttagggggtgaaaacagcacaagccaaaaaccctgctcagatactcccttctcttgaagccttttccagatccctaataagaattaaccaccctctctcacacactctgttgtactttgtccttctctgttaaccagcctctgtgttttgtgctgtctgtatttgtggatacatcttcctcctttaaagcacgaatcatatcttaatcccttggcccttcttcccagtacttagcacaagtgctcaatacatgtttctttaacgcgtgtaacagaggaaggcgaggagagtgagtgggattgggagcaggaggattctgaatgtcattttaaggggtttgggctcgctcttcaggcagcaatgagccatagccgcctttgaactgtgcagcactgaccagagctgtgatgccaaaggatgcagtggaaggggaggacagccagcatgcctgggcatggtccccaagtcagaggacatcagtgggagaagggagaaggcatggaagcaagtggctaccatcttatgaatctgagcactcattcaaaggtggcaaggaaaaaggaaggcattgagcacggttttgaggtttccagcctgggtgattggaggctgatgcaggcttcttaccaaaaagggccctaggcagtttcaccaggaatgtttaaggagtttatcatgaccctatctcttcctcgtctaaaactctccctaaaatcaaaacagtatgtcctgttgaaatactttattgtatcaaatataatgagaagtaaaatattctctctacttgatgtatgaaacactgacttcttgtagtggacaattttcacttgtctttttagtaatggtttttattaaaaatagatgttaataactgcttgtttaatctttaaacgtggccctctgagagcagcttaccgtaaaagaaacggttgtcagctttctttttgctcctcagtccctcctgccccttcctaacaacagaaaatttgctttgcacctgctccaactgggttcgaagagataagcatcttgcaagcccagaaaattgtagtatcaaatctcagccccaactgtgaggcagcactatcattgaatccctgctgagaggcgttgctttcccaattcccaaaagagttctttctcccctggccccttttcaggcttgaactctgaccgaaaccctctttttaactcccagcatgcactgcacttggtactgacactgacccatccctgcttcctctgttctgcactggactcatcagtaggtcaggcgttggtagccctggggtcactggggtgcccaattccaataatgagcacatttagctaaggagaggaaatgtacccttctatttgttacagtccattgctttttttccagaaacaaatgctaaaagaacatttgatatattgtggtttggtaaatacacatagcactgcctaatattcacaaagttgcctcttttttttgcatcttccttcataaattaaatatattgttctaactcatgatttattttaagagggatatacctatttcacagctaggaaaatgttttcaaataaagttatattcagaatactcttgcaagaatttcaaataaaaatagcaaatactatttaaatgcatataacattctaacagacttgtgtgtcattttaaagggaaagaaaaaaaatgatgacaaggactttacaactttgtctttaaaatttcttcttaggctttccaaacagaccgaagtcattaaaaatactccttaacccccaaagtcacaaaaaagaagctacccaggtttattatgagaaggttgaacctctgttgaagcttgcaggaataaaaactgatgtaacaagtaagtaattttcagaatataatttcaccatctacaaaaacatacaaaagcaaaataatctgaatttgtccttaatgcaaacttgggaaactacttgtaatatctatagcatttttacgtcttcataacctactgcagccagctcgagggttataatttaattatttttgttatttttattagaatattaatattttctctttagaattttttcagatattttttcagacttaaacaattgttagatataattacaaaggaagctgtatacttgtttacatcttcatggagatgtttgctacttacacgttaattttgcagttaggcaagaaattgattttttgctcacttatatagttgatgtctttccatggaattcttccttgggttgttttcgttctgactctgacccctggtggttaggtcaaaactaagcactgaactgctggttttattaatagatgaatttagagatgctagaagcttaaatttgttgtctaaactaagaaatgtacttaggtttgtgccaaggaaaatagaaacttgttaatgctaaacttaatagatgattagtaatatcctttttgatttttttaatttggtagtcacatttctttgtttctttgagacttattttcgtatggtggggaactgagtagaagagtcgatgctatggagaatcgcaaccttcctagctttatttctatgtggcttcgctaacagtggaaatttgcaataaattttaattgatgaaaagtattataaaataagcctactcaggggacaagcccagagtgcaattggaacttcctagtcccagttatagattcctagggaagggattcacagtgatgtggctttactcagctgtaaacaaaggagataagtttcaagatgttaataatatcattgaaacctacacctagtgatctgatggattgaggtagaagaaagttcaaaaaaaaaaaaaaagcaagttttgtaggaaggtcagcccccatgaaatgtgcctataactatagaggttcgagagaaactaccatgaaaaactcaagaggaatttttgaattaaaataaagttatagtgaagaagttaacctttatgtttgtgaccttcggcttatttagaggtgatttacaagtaaaagagaaaattcagatttatgttttctttctactgaagatttccaaagattggctgaaggaaaagtttgagatttgtattagggtgagacaattaaaagttgaataaacatattggcatactcaatgactattttgttcattgcttttacatgtgaatactacaaagcagcttaacatggatattgctatatagcattcacttcaggaatctcattgtatgcttgctctgtgttcaacatagtgcaggatgcgagatgaataagctatcatacttggatgactttctacattattagagattcaaaaaaatgcttaaaaccattataactggggtatacataaaagaactttgatgtctcagaggtgatattttgatcggaagattcaagaaaagcatttgaactaggcagtttttaagaggcagacaaaaaatgagggaaggaagtcaggctaacaggcatgtactgtaaaagttgggagggggggcggagagagagagtgtgtgtatgtgagagagtccatgtgtgttacacccatacatctggagagtttgtgccataactttgctctactttcctcagtttttacattatctgaaatcttactctatcatcataaaatagctgccagtgaatttcatcctttcttattaatatccagtgggatggggagaggtgtgcatatgtgtgcaagagagacccaacatgctttaatcctgaagatgaattaaaatttccttttttaagtttgggcacagatactgtattagcgcagtcaatctggaataatcatttatttaaccatcaagactcttcccaggggctgaggacagatccccttttcctgatgactgaaatgcctcagctgaatctggattctgttagggagaagaaagggcaaaatgacttctaggaaggctctcaacaatgtatactacaggaggtataattccaggttatggatggatccttaagctgcactcagcagtttactcatcgtgtattgatccacagttggtgtaaatttttttttatcatactgttgcaatctggtttggcaaagatgactccaccagcagaattaaaattaaaaaggaagagagaaaaagagattggagacaagaaaactgatatacaaggcctgaactaaggcagaggaaatcatctaaatgtgctttccttcttaattgtattggagacaaaactattatgttctaggatttttttctctaaatttgtaaatattactaagtaccatatttaaacataaaacaatagaatattccgtaaagcaaatttagaatttacttacatttgtgcagaatggctaattattagctgcctaacactcctcctacaggcaaatttataaaattacatcatttgcttataaaaccattttagtatgcatattggctcaatatttatgaaaaatatttcttgaataaacctgtgaatatttgaaaagttttagtcttcctgcctatcttacagtgttatttttgtagttgaaataatatatttgaaactttgtatattatactacagaaaggtggtcataatactgttagtttcagtttcaaaaattatgtcatagtaagatcgaattcgtactttatttgaaagtatatggaagagtaaagcagaaagaggacatatcttctgcatgtccagtgggacattgttttaatgtatccttgtgtgaatgggtgagtccaaatggaattggaattacaaaataaaccctatatgatgagttaattaggaaatagtgctatataaatatgaagtataatatgaagaattacagctagatatatacactataaggtactgtaattttttcataaatttattttaaaaatggatcttaccacattaataaaaacacacttctttcattttgggttgtgctgaaatcctaactacttctgaatatagatcagcatcttttgaaatatttgtgctaaagttgcatccccactctgctaccaccaccaaggtagtatcttatctaatagcatcagaaaaacttccgggagaacctggaaagaattattttttcctaattacctattcgtacacaaatcaaagaagagtatgaacgataagcccatgctggcatatgatatcatttctcttgcttctgaaacaaagcaagttttagagattgtaccattaaaggtgtgacagatattttgaggatcagagatccataggataattcatagtacaatagagtgaaaaagttaaggcagcagagaaatcagactgaaaagaactttcgaggccatatggttcaatttttctccttgtgggtggagcacaggtgtgtggcactcaactttggcttggccacctacactagaggcagagtacgttgttactggacaatactgtttgacattcttatgaatgttcagagttactgtacctttgggcagattagaaaaggcacctcctctgtgctgacttacaaaaaggtgccctttcttccagactaattcatcctttgcttataaaaccatttcagtatgcatattggctcaatatttatgaaaaaaatatttcatactttcaaaatattcatatttcaaaaatattcagcccaaggtcactagattcagcctaaagtcatttgttagattgcaaatccgtcattcccgttagccaagtacctttgtgctaggcataaactgtacaaaatgagaacttgtcagctgacattcgcctctttgtaatttttatgtactagagttaatgttatctcttgtagtaatatgaaataaatgtgccccatctattgtataggagtcattgagatatttgaagagagatatcctgtctgcccctcatctcttgttcacgataggtacttccatcgccttcagttactttttgcattaacagagctgctagaccttatcatggtcattatcattatcatactcaaagacatttatctgaaggaaaccttgatctctgccagctcagggctcttgggagtgcctagtcaccagataattttacctcctgggcagagttgtcaagaaagtggtgtttgttatcattttccccttctttctcctaaaatcacgcttctaacatggctgttaacaagcctcttcatagtgtttctctggttgtttatggctctacttgaagccttccatttcttggaaatgcctcttgcctttctaaatctcacccagcagaaagctaggccatctaatgaaactgtgtcacaaaagattccagtagcctgaggcatcactccttccaattttacctgcattttaatacaaaatctgaaaagtaaatgttcatgcatcatatctagctagagagaaagataattctgtgtaaaagattctttttgttacctcttaaataattgtgggtgtatatggccagtcctgttcccagcattcagatgtgagttaggaagttggaactttatacctggggacgatgaagactcactaatggggtatatacaaaaaagtgatatgattaaatatgtatctgaaaatggttattctggctagagtgggggagaggtttgagggagacaagataaaaggctattgtagtacaggtggagtatcccttatctgaaaggcttgggaccagaactgttacagatttaggatgtttttagcttttggaatatttgcattatacttaaccacttcagcatctctctaatttgaaaatcatggacacaggaaggggaatatcacactctggggacagttgtggggtggtgggaggggggagggatagcatcgggagatatacctaatgctagatgacgagttagtgggtgcagcgcaccagcatggcacatgtatacatatgtaactaacctgcacaatgtgcacatgtaccctaaaacttaaaagtataataaaaaaaaattaaaaaaaaaaaaaaagaaaatactccaatgagcatttactttgaacgccatgtcattgctccaaaatttttagatgttgaagcgttttggattttagatattctggttacagatacttaacttgtctacacatgaaagatatttagtgatcagatcaatcagctaatttagggaattagctgggagaaatggaggaatgctatggcataatttaaagacagaaacaactggccttggccatggagtggttctggagagtggaggaaagggacactctagaaagaagtcattttcctgtcttggggtagatgatggaacacaaaaagaacaatatatttgagagagaatatatttgaaggtatacataatggattctgttttgagcttactaactttaaagtacctacaggacaggaaagaaaatgacatttcagtatcatatcccacactagaattttatcaccaaaccaagaaatgtttccttatgtccaaatcaaatctcacctgattttatttcaggtgattttctcatcaacattgaatatcaaccttaagactttcttgtcttcctgaggaagttgcatttgcaccaaagaggggagggggaaattcccagcagtgagaattgtgttcaaagacctgtaaactgtgaaggcttcacatctcctatttagaaagagcacaggttggcaatctcataggaaaaggcaaatagatgaaagaagaggctgggttacattttttgaaattacatttatctagcaatcctttctttgtttgtttgtagggggatgatttgaatctggctgtcactgattccagggcccacaatagcctgtctaaatacatatttggtcctttctactatatttaaatagtaatccagatcactctttatccttttgcctaacattgttttgtataaccacctattacttcatattataattcattatttcattagcatatattgtctatctccagaatgcaaattcctgaggccaaagactaattcattttgttcattttgctaatatattttatagatgtagatagtcaggttcttttcattttgtttctttgttctagatctttgattttattggacttttgcaatgttacttaaaaaattgctattttcaggcaggttgcattagtgtataatcaaattccacccacaatatcaaaaaaagactattacaaattaaaaaaataaaaatagcattcaataataacacagttctaaagctcattattggatctgaaaaactttaccaatgtaagctttggtataaaagtaaggcttggtgaactgattcttagcataaatattttttcatgatattcttatttttaatgtgtatatgtaagatgttttattttgcattttaaggttgtaagtacttgctgtagttataaatgaatgatcagcacacatcttctttgataacctttcaactttattaatattaatgtttcatatgtagttttattatggctttcttctgattggaatttaatatagagaggttttattcatgtgagtgttaatggcattttgaataagctatgggagaattacaatgtaacactgctggatacagaatgattcttttagacaccaagactaataatttttaacaatatcgaaaaacattgtaggaaaagcttgaaccatgctggcaccagggacagacaagcatgaaagattaatgtaatcttgcatataatgacacacattcttacacaaaaaatccatctgcaatgtcatgtcagtcagcagaaatctttgatgggtggatacagctgggctgtctcttctggcagagctgccctggaaaatgctaaatgtggttgtgatgcttggtgccatctgcagtgtgcccgtttatcctgtcttcactggcatttacgatactgcatagggcatcagtgactgtggagacagcgatacagagtgacagattcatttcctcggagggtctgagctctggtgggcctgtgtgccaccctccttcttgggtctgggtctcttataattggtgttggctttactttgtattttcacatccaactcttcctctttttagtctaacagttccagtacacattcttctggtttgtaaatcttacactaaccttttgactaatttattcatgtaaggttgccaaaccgatttaagattgactgttcaatgccagctaatatgccttatttccaaaatactgctcctcctaagcctctgatttaaaggacatgtgtcttatttagggaatactaaacaggcaccaggacaaattgggtaaccactatgcgtgggatattcccaaatgactttatgtagttgaaacaaatatatgaccttctcttacataaagctataaaacatcaggccagtaacacttagtcctcttgcccatgattaaaatataaatattcaagaataaatgctgttttatgacttgaccatatgtttatcatattattttgccagaacaagttaaaaagtgtgatcattgtttaaaactgtcactttgtgtatgtgtgtgtgtttttttaatagtaatggaatatgaagggcacgctctgtcactgcttaaggaatgtgaactccagggatttgatgggtaggttatattattaatcaatatatgttatatcatttatgtattaaatgccttcactagttttagctacatatttggaacctaacatttaaaaatatttgtagtgtatgtactttggctctatcttgttcatatctatgtaataataattaatgataatatgacatggtcatctatctctcaggatctggcataggaaagcaaaaagaggaatctaattattaaaatactgggaaatgacagtgtactactctatacttactaatgtgcatacatttgcatctataattatttgcttttaccatatatctagagaagcactaatggaagatgttatactggtcacatggcataactatatgatgatcttcttttgcaaattaattgataggtttaatagctacccattggttaacttgtctgtgatagattgagggaagatattttataaatacaagtaaataaatacattatttccagaaacaataagaaataattttaattatctcataatgtagtgactacaatttaggtatgttattcacagtgggcatcggaaaccattgttcgcaatacattggagtgtacagagattgttcactggcatgcaaacgttagaaccaaggcaagtgatataaatttcattgccattttttaaaattaggtgaaccaatttgctaaagtgttggactgatgtgtaagactaaaacatattatattcctttagggaagttctttttacgtgagtagatatttgagaatttaaaaagttgacaagtgtgtgaattatttgtgttacatggtgatgggcagggggcaaagacccataaggtcaggaaagggagttaggtctgtactttcaccaaagtgaaaggcattaaccttcccaaagactgatttgaatgtgctggggagggaagtgatgcaatcaaaatggagtattggcagggctgtttttcagaaatgcttatttatttatttattttttggatgaggagaaaacaatagctgttgagaaagaaaatgtggtaagtaaaacatgatttttccaaaaggaatctaattgagggaagtaaatctagatagcaatattatataaacattgggaatcaaaaatatggggtaggagattacttcagaactttatacttagaggtagacaaaaacattaataggcttcatttagaaaattgtcttacaagtatacaatttaagaaaagtccttgtgggaatcatgcataccaactacctatttgaatatgctgcatagtccctcactagacctcatgagtacatgaaggtagctgcattgcaaatgagtacctgcttcaaaacttgattaaagaatgagaataaagatatcacagatattaaacttgttcttacacagcagcattacagaatgttctgctgaatgcagtatctatcaatatgttttactggtatttgtactgggtaaagggatgaaaagaactttgcagaatgaagaaagacgattgctgaagtgtagtacaataatatttttctctttacctgaacatatttaatccttatttatttttcatggcaggtgttgttatttttcagtgtagagctaaaagatgtatagatttttcagttattatattttataaaccaaatagtttggcctaaccattatatgaattgagttatgtaagtgtttctaaactctatggcatgctgatttatttcagacttacaataatttcaaatttctactgaaagtcatcttccgtgttctaagactctttaaatcaggggtccccaactccgagactgcagatgaatatcagtcagtggccttttaggaactgggaggcacagtaggaggtgagtggcaggagagggatcatttccgcctgagctccacctcctgtcaggtcagcagcagcattagattctcacaggagtgcgaaccctattgtgaactgggcacgcgagggatataactggtcatgcgagggatctaggttgcgtgctcttgatgagaatctaatgcttgatgatctgaggtggaacagtttcatcctgaaaccatccgtctcccaccccaccctgcagtccatggaaaaattatcttcccacaaaaaagtccttggtaccaaaaaggttggggaccactttaaatagcttatttatttttgtggggtcagttttcccagtagaagctgatatggtagttggagtaattatcttaataaactggcaattttaagtcactgtacttagaattacatagagagatatatgaggagaataatagaaacatagtttcttcaggtacttcaaaggaacaattctcttgcaagtaaaattgtttgaaaatggaatattctacattggtgagttttctattcctgaacctgttctaaagagtggctaaaggaaaattttgggggaaatttatagaaaaggtgcagagatgagagaaggttaaccccaaaatgctatggcattttgatgagagacagactcaaatttctttaagaactttggcctgaagcacctccgtctgacactagtggaactattaatagggagtgattaggaaatcacctaacagtttggtttctagatacaggctgaagaagttaagagccaagaaagattctatgtatagtatttagtaaagcaaaacaatttggtaagtaatgtttaagaaatgctatttcctaagattttggagttgtatttattttttttaatgaattacatatgtttctatgagacatcttgtgacatttctaaacccaacagaaacagtgtatcagcacttatgacagctagttctccactgcagtgtgtcctaggaaacactctaagatccactgttaaaccttatgwgagcttcagattctatattgctccctattttactgggcatgagtaggaagttttaggaaggaaaataaaagaatatcagctgcatagacttgaagcagtaacacttgcatttataagtgtgagtatagttttaaaaatctatagattttatgcaattgtaaatatatgaattcctcgctattaatatttgtttcagaatttttaaaaaaattgttgagttacttttcttttgttcatttcaccattaattagacccataatgttgtagacattatttggattatattgacattttatcagattgaacatatctgtattacttagtaaggtaaaaagcaaaaacaaaaacaaacttttccagaaagaaaaaaaactgtgaatcaaaactacaacaatatattgaacatttcatagatgatgggttcatagataagtataaaaacattcattaaaaaaatctttatcactctttgaaaaaggatatattatcacccagtgtttcttttctagacagaataattctgtttggagccatggcaaggagtttacttattttaaaaacaagatttgtcacatgcaaaggattagttactctaaggtttatgttttagagtgacacaagtgtgattaactcactataaatgattgaatactttgctttttgcctttcttgtatatttagactcttgtgatatttttgtaagaagctgttgatgaaaaaaaccaaactgtaaaatatttaaagaggtttattttgagccaaatatgagtgctcatggcctatgataaccccaggggggtcctgagaacatgtgcccacagtagttgggttacaacttggttttatacattttggggatacagaagttatagccaaagacataaatcgataaatgtagggtattcattggtttggcccagagaggcgggatatcatggagctggtgggaaggggagctcacagatgaattcaatgattttctgattgtcagttggttgataagctttgctgaaagattagaagtcagcagaaagaaatgcttgagttaagataaatggggtggtgtaggctgggtgcagtggcttagcagtggctcacacctgtaatcccagctctttagaaggctgaagaggggagatcacctgaggtcaggagtttgagatcagcctggccaacatggcaaaaccccatctctagtaaaaatgcaaaaattagccgggtgtgatggtgtgtgcctgtagtctcagctacttgggaggctgaagcaggagaatcacttgaacccaggagggagaggttgcagtgagctgagatcacaccattgttctccagcctgggcaacagagcgagactctgtctcaaaaataaaataaaataaaataaaaaattataaaaataaagataaatgaagttgtggaagcacaggttcttgttatgtagatgaagcctccagatatcaggcttcagagagaatagatggtcaatatctcttatcagaccttaaaaggtatcaaactcttagttaaatctctcctggatcaggaaaagacctggaaagggaaggagattctctatagaatgcaaatttctcctgcaaatgatagctttgcagggccatttcaaaatatgtcaacaaaatacattttgggataaaatactttgatttcctctagggcctgctatttgttatttaatgctataccagagtcaggttggagttggggatcttattgctaccaagtctgttttgtcagtcttatgatctattttttttttttttttgagataaattctcaccctgtcacccaggctggagtgcagtggtgcaatctcagctcagtgcaacctctgtctcccaggttcaagcaattctcctgccccagcctcctgagtagctgggattacaggcatgcaccaccatgctcagctaattttttgtttctttaatagagatggggtttcaccatgttggccaggatgatcttgaactcctgacctcgtgatccacccttggcctcccaaagtgctggaattgcatgcatgagcctggccaatgatttacatcttaatgccagtgctggccatttgcgcctaaactccaaaagacaagagggtataaggaggcatatccaacctcccttcctgttatgacctgaatagtttttcagattttctttgtgaccttcatggccaaaaggggaggatccattcagttagttggcgacttagaattttatttttgttttacaaaacttatttcctaggttgagtcactttacctgaacatgatcttaatgattgaatagttgttaacataaataaatacatattttttctaactcacttaatttcacactggttctactggtaaactgtttttcaaaataataagattctcataaggctatttttattaggtttcatatatagaaaaggtatctaatatattgaataatattgtagcttctaagaccaaaatgtcttatttcaaatccctgttctattacttactagtggtacaatcttgaaaaagttactttatctttctatgttttagtttcctaatctgcaaattgaaggtaatattacctattgcatacagttatttctccacttaaatgagttaatacatggagagtgcttaggaaaatgtctgatatatatatatagtaattattcactaaatatttctttattgttataattgtcatttgtattagtttcaaaagatttaacacagaatgtattatgacaaaatttcagatgtttcagaacatgctcatagggaggccacctctaataactctagcaatatgttaacatatgcatgacgctataattgtatgcaacattctaggagttaagtgttcgcatcctatgtatgtaagggtcaagttatttggtgctaaattagatttttttgggtatgactccacatagtctttttggtcacacccatatgtcagcatttagacagccatggattgagggttacgtttaagttcacagattagaaatctcatagagatttttgaaatcaggtaagtttcaagtcaaaccttggtttttttcattcataaagatgggactgtggcctattttgcagacttctgaggatttaatagaaattagtaaacacattacctgatatatagtttgtccttagtaaacatcattccttttctctgaataggtggtcatattgcgaacctctggaatcagtttagacataagaataaaacacacctaatcaaacatgacctgggtcatatcttgagtcttctaaccagagtagccttggattgcccaggctatgtggagctagtgggatgaggaagatggggactagagggaatagatggccgagagaaagatggtgggaactgactggaaagacactttcagcctttggtcaccaccctccagagcttcctaaacttagagaaccagtaactactgctgactgtggcccatagacagttttgtttgaaatagtgtttttaaatatattgaatgctagttgcttagtatttacaaattaggagactcagccttaaatcagaatctctggcttctgtagaaaaaccagatctgggtccattaggcctcacacgtgatgtgagtgggccacagcaaagaagtggctgcgcctttagattgagcctactcttccattcctgctgggcccttgtagcccttgagttgtgacacctgctttcactgaggcaaaatccactttccattgggttaactggtgacattttgatacgtaagaatattttgcttcttttgaacataaatgattatgaaatgaatttctggtacttctgtgttattttaatggattctgcccccatagtctacttgatataaagtcttaaaaaatatactagtagtactatctaggatcaaaggctaatagtattacatctagaagcaccgtatagcaataatgtcaaggagatgaaattcaggtcaggtttgtaattactacattcatatagtaatgataattagcagtttcttaaagcttcatattttatatgatttttattgctatctgtcttttcagagctttattgagaattagcaggattttatgactttggttggtgttagttaaatgaattgcagatgacagtattattaacaagaaatgagaatgatatgcttttggatgttaacagagcaaaacgctggtcagatgtgaattaacatgttcaaaagttttcatatctcttaacacacttaaagctattttgtctatggggaattatctagttattatatttgtgaagtaaacttacctgtgttgtgtttgtgttgtcttacccattgacacatattaacatgtttaaaggtacatgtgagcagttatgcacatagactacaaattagtaaactattttgaagtctagatttcatgacttattaccaatcattctgaagttttgccttctttgcttgatttgtatttttctagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggcaagggagtggctacagattcattaaactgacccttctccctcttttcctttcttacttgctaatctagacagcacaacacagaattaatgaacagactttgaaagatccagacttctggcatccccactagcaaatgtgagacttttgacaagtcatttaatctctttgagccttatttttctaatctatagaatagggatcacagatatattattcactttattacaaggttattgtagtactaacgtttggtttagtaaagggtttaatatatagttaaaccatcagtatatggaatggttattattctcccttcgcataaaaaatctgttgattacacagtaccaggtaagaagtttcaaaacagggccactccagtctagctgcttacaattccatatgaggtgaatatggtaacttgcataattgatgtataaccagataaccttgagaatgccaaaattacttgtgactggaagggaggataaggtttggaagggtgagattcttaagggcaaggctttttaatctttctactcactgccatttttcagcatctagaatagactatgccacagtgatgctcagtgaagcctattaagtgaatgcatgtaaagaagactttatatagtaaatgacacttggattaggtcttaaaatgggttggagctggcctgaaaaggtgagaatgagttattttcttggctgcaaaagtaataaagcaaaggcaaaacccaggagtgtttgaggaatagtgaaaaggccattcagtggaagataatggtatcaaaataggcccaaccatggaggctcctacatgccacagtaaggtctctgaattgtatttgataagcagtagggaataatgggatgtttcagagcaagggggcaacctgattggagcttgttccaggaggattcattttgcctcaccgtgtggaatgattagaggttgggagcaggagaaagtagaggtcagagacacggagaaccgttagagcaacactgtgatccagaaaagagggaaacatcattcaaaagctgattgtattacacaatcactcatccctatttaacgaacggtgctgggaaaactggctagccatatgcagaaagctgaaacaggatcccttccttacaccttacacaaaaattaattcaagatggattaaagacttaaacattagacttaaaaccataaaaaccctagaagaaaacctaggcaataccattcaggacataggcatgggcaaggacttcgtgtctaaaacaccaaaagcaatggcaacaaaagccaaaattgacaaatgggatctaattaaactcaagagcttctgcacagcaaaagaaactaccatcagagtgaacaggcaacctacagaaagggagaaaatttttgcaatctactcatctaacaaagggctaatatcctgaatctacaaagaactcaaaagaatttacaagaaaaaaacaaccccatcaacaagtgggcgaaggatatgaacagacacttctcaaaagaagacatttatgcagccaaaagacacatgaaaaaatgctcatcatcactggccatcagagaaatgcaaatcaaaaccacaatgagatatcatctcaccccaggtagaatggtgatcattaaaaagtcaggaaacaacaggtgctggagaggatgtggagaaataggaacacttttacactattggtgggactgtaaactagttcaaccattgtggaagacagtgtggcaattcctcagggatctagaactagaaataccatttgatccagccatcccattactgggtatatacccaaaggaatataaatcatactgctataaaggcacatacacacatatgtttattgtggcactactcacaatagcaaagacttggaaccaacctaaatgtccaacaatgatagactggattaagaaaatgtggcatatatacaccatggaatactatgcagccataaaaaatgatgagttcatatcctttgtagggacatggatgaagctggaaaccatcattctcagcaaaccatcacaaggacaaaaaacgaaacaccgcatgttctcactcataggtgggaaatgaacaatgagaacacttggacacaggaaggggaacatcacacactggggcctgttgtggggtgggggaaggtggggagggataacattaggagaaatacctaatgtaaatgacgagttaatgggtgcagcacaccaacatggcacatgtatacatatgtaacaaacctgcacattgtgcacatgtaccctagaatttaaagtattatatatatatataatatacagccttatgaacatatatatatataaaggaaaattaggcaaaatagcattacttgaggtactcaatagcctggcagagcagacattaagggtaagagagactggacttgaatttcagtttggtacttgactttgggtgggtaattagcctttattagtcttgattacacatttaaaaggtttaataaggccgggtgcagtggcttatacctgtaatcccagcactttgggaggccgaggtagtggatcacctgaggtcaggagttgaagaccagcctggccaacatggtgaaaccctatctctactaaaaatacaaaaatgagctgggcatggtggtgtgcgcctgtgatcccagctactggggaagctggggcagaagaataacttgaacctgggaggcagaggttgcagtgagctgagattgtgccactgtactccagcctgggcgacagagcgaggctgtctcaaaaaaaaaaaaaaaaaaaagtttaataatgtccatccccatagggccattacaagaatcaacttttaaaaagtcacacattatcactaaaaaagcaaaatatttttccctatgattatagaaaataatgcacattgttgaaaaaaattcatattttgataaccctattcatttagtatggattttagaatacttagtattgttgataagttgacagagcataagatattcaaatgcccttttagagtgtaaagtctttcagaaagtcagaatttaaaaggagagagatattcagatataatctgataattctagagtatataggaaaacctaaaatggtttctaagtagaagacaccaagatgattttgactcaaagagaaaaatgatgcattttgggccatcttttcatggcattttatttcttgacctttttgctttactttagtagttctgactataatggtggaaactttccaacatttccttccatgcaaagtggatgtgcttaggacacttcattagtacttaaattcctgaggtcattcattgactgccatacatcagaaatagaaagatgggtgtccctacaggtatgcctttgacataaatttggtggttggctataaaaactggtggttattcttatgttttagtatgtaattcagattttataaagaaatagcatttagttttatcactattataattttgaagagtatttctgatttggggagcattttatgtattctttggatatttgtagtaatgccattttaacctgtcttgtttagaagacacagtatgctgccaaaattctggtcattgcataggagttctagcattctaattccatctaataggaggggaaagtcatgtgtggggtatatttaatatgatgactgtatgcctagtcagggcttttgatagagaatgggaactagaactaggcaggaagttttcaagctgaacatgaggagacagtgtgcctttgaagccatttgcctcctggagagagacacccagagggagagtgtttagtaaattaatccactgagccaacagactaagctgctgaattatggtcagactcaaatggatcagatgtggagaagcctgtatttgaactgctggccattaggaatggtgtttgttgctatgggaactggtgctaaggaactatactgagagactctgattaaaagggggagggggaatggagaaaaaagcctgagaggacataaaaataaaaaagcaatccagttgttgtaaaacaaggctcaagccacatactgatggctgtgaaccatatattcctatagagtttgcataaataaattcatgctttccaattaatttgaggagaataaaatattgccgagggactgttaatttctatgatatttcaggcaaagaaccaaagtgtaggtgccgttttcatgagaattttagatatgcttgactaggaagtcattacatcacatttatctgtttggatgtgggagacattaacagccttatgaatattcatggtatctggttaattaagttaattgttctgcagaagtgcttgcacttccaaggacattttttttttttttttttttttgcctccatagtttctccctggtatttcatcagtaattctttacatgaactgctacttctgtccttacttttttgtatttggaacattttagcagctctcaggaggaagtggtaggcaaagtttctggtagtgttaagaaaaataactttcaggctaattaaaatgtttaccttgaggtagaacatttatagcttttgtgagaacattaaaattacgccattgttatttatgtgagcagcatgttcttttggcatgtagacatcttttcaaatagagtacagtttcctgaaacaaaatgtaatccatctttcagattatcccaacaaaatatagaacaagctatcgttttgcaattttacatatactttctcataaactttccttttttcttcagagtgtcaaaaaccacatttaaagactaagatacagattaatgagtagtcaatgactaaaataattttctgacttctagtcatgtctgttatcactgccaacttctacagaattagagaaaagttgcaaagcctgagaagacataaacaatttttaaagccatctctagcattctaaaaaaattttgtacttgggcatacccaccgtacttcaaactcacagggaataaatggtctttattttcttaagtcatgatatgtgtcattctctattgcacatgacattacattatgttttttaatagcctttctagaggaatgcttttacggtctactcataattaaccatggtaatggaggaaatgtgtttcatggagtactgtaatccatcgataatcctaaatatctgactctaattatgtggcctcctccaaaatctttaccacaaatctgattgggaagcacaatggattgacttgtttcttccttttctcctgatccattccagatttattagcaattagatggtcaaagggcaggctgtagagggccacaagatcattggaaagaccttgataaagatccactgagtaacaggtttctacactacttgttctcaaaacttagggtccatagactcaccttgtgaacttgctaaaacagagatacctgggtcctccctcctccaaacacattctgagtccatgagttggaggtagaacccaggaatgtacgtttttaacaagctcccaggtaatgatgctgcttggaccatgcattccagaggagtttctcaccaagtcactgtgcatacaaaccacctggggatctaataaattgcagactctgaatcagtgtgtctggaatggggcctgagaggcaacattttaaaaataatatattttttacttccattaatactgctattactgttttaatacctattatccttatttttaaatggacaaaaattgtatgtatttattgtgtacaatgtgatgttttgaaacatgtatacattgtgaaatggctaaataaagataaacatgcataaaattgacataatgatcacatactgattttacattgagaacacttaaaatctcccttagaaatttccaagtatataatgcattgttactaactattgttttagcctgttctcatgctgcaataaggaaatacccaagactgggtaatttataaaggaaagaggtttaattgacttgcagttcagcatggctggggaggcctcaggaaacttacaaccatggtggaaggcaaaggagaagcaaggcacattcttcacaaggtggcaggaaggagaaatgctgagtgaagtggggaagagtcccttataaaaccatcagatctcatgagaactcactcactatcacaagaacagcatgggggaaaccacccccgtgattcaattactcctacctggtctctcccttgacatgtggggattatggggattaaaattcaagatgagatttcggtagggacacaaagcctaaccgtatcaactgtagtcactaggttgtataacagatctcttgaatttattccttttacctgaaattttatatcctggaccagtatctccccagtccttcccacccattagccccagtaaccactattttactcttcgcttttatgagtttaagtttttcagattctacataaaagtaagtatttgcctttctgtgcctgtcttatttcacctagcataatgtcctccaggtttatccacgtgttgtaaatgacaggacctctttaatgccaaatagtattccattgtgtatataaacaggctgattgtccctaatctgaagacttaaaatccaaaatgctacaaaattagaaatgtttgagtgccagcatgatgccacaactggaaaattccacacctcatgtgacaggtagcagtcaaagtgcagtcaaacctttgtttcatatagaaaaatattttaaatattatataaaattatcttcaggctatgtgtataagatgtataaaacttttatgtttagacttgggtcccaccccccagatatctcattacaccaacagtgtaaaagtattcccatttctccacagccttaccagcatctattgtttattgactttttaataatcgccattctgactggtgtgagtgtggttttgatttgcatttctctgatgatcagtgatatttagctttttttttatatgtttgttggccacataaatgtcttcttttgagaagtgtctgttcgtatcctttgcccactttttgatggaatttttttttcttataaatatgtttaagttccttgtagattctggatgttagacctttgtcagatgggtacattgcaaaaattttctcccattctgtaggttgcctgttcactctgatgatggtttattttgctgtgcagggattgttttcttgatttctttttcagatagttgtaagtgtacagaaatgctactgatttttgtgtgttgattttgtgtcctgcaacttaactgagtttgtttattagctctgacaattcattcatggagcctttagggtttcctaaataaataagatcatgcctacaaacaaaggcaatttagcttccgtatttatgatttgcaagccttttatttctttctcttgcctaattgctctggctagaacttccagtactattttaatgacagtggtgagaatgggtattattgtcttcttgaggaacaagacattgtttctcaactcatgagagtaattttaataagcactcaagtattgtcattcctgtttgacagtaggccgtattttgagtaacaagggtcacagcataacttgccttttggtgaatcagttggaaccagtttgccatttagttaaaataaacttttctttgcactggtattactagaagtaattgtgcttatttataattaataataattaaatatgcttattcttagttacctaaaaaattatgatattaatgacctcttggttgataatggctaagctgcctcagcttctccaatttagcaacccaagtacatatcagttcaaagtaacacaaattgaagcaattatgtatgatcacataggaatgcttctgattaacaaaatccagaggactggtctttgccttcataaccggaacacaccacatgcatggtttcacagctcttggctattattggacttacttattatattctttaattcaagaaaaattgtagcttcattcattctgttcttaataattttaaattctctttagcctcctgggaatgggaagggctagctggtatagtcccctgtatctcagatttcagttacacataaacattaaaggggcctgacttagggcgctctttgcctctgtggactggtggggaaaatccaggtgtgtcttaaattctaataatcatgaaaatcagaaatcataatgtttcaaatacaaatcttcatacatgggaaatacaattgaattaaacattttcttcaatgtaggagacatttgtcagataacagaggggattctcatttggctaagagcttacctctaagattcattaaatgtgtttagagcatattttttgtagtttgtagttattttatttttctgagttattatttggattattttctcttttatttatgtatgcatttgtcactgctccccagaggcacctcattttggcattgaagctaaaaacccattcattaaggttgggatggagtgggctttgatatagctagcatttgggaggtagaaaatagacattcgtgatcaaaaaagctgtaagcggttactataaactatttttaaatttctaagtattttaaatattgaacaaatgtgtagacatttgatgtgcatctatactgtgaataagaacttaaacttctaatattcacattaactttcctgattttataaattctcgtttatttttcatctgaacattgaagaatgacatctacataaagtaaaagcaaatgttagtttgaacacattctaccctaatagtgcatgttttaaaattgctttggcaggatctaccaatgtattggcacattctcttcatggagttcctcatgtgataactgcaacattgcacattataatgggtaagaattcttccaaagcagttcatattttataaggaaatgttgatttatataaggaaggccatcttatttccatcagactttaagaaaaggcaggttctttgtctcttagagtagagaaatgtttgactaaaaaaccaaaaggcaatgctttactatgtggattgcctgtcttttcaaaatacttgctttgtaaagagcagtaaatgaagttttattgtaatctgtacagaaaaaaaatattgtagtgtgctcaaaattataattttataaccagatgaagaacattaatgaatactccttaagtatatccaacactgatgtaggactgtaccaagactctaggactaggattatgttattaatgaaaaaacataaccagaaaaaaatttcagccagtagatgtctatagatattttattatccctattggtaaaaagcatataagctcaggtatatgtaacactaaactactgttaaatctgtgtttaccttgcctatctactttaacttcgtttctttgaccatgttttataggaaatagcaataagctgaaaaatttagtactctgtgtttcttcactagtacctgaacaagttaaaaatggtaattattgtagttataggtaaagggaactgaagagaaagtgaggatgttcatggtctacagtacctttagatattctcctataagccaataaatatgctctcttatgtttgctgttttgatacaagtcctactgtactcactgattaatatttaatgtaatattcaagggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaagtaagtctttttcttaaaccaaaaattgtatcccaggttcaatgactgttaataacaaatttcattacattttagggcagaagactgtgaaatatcatttttaccatttaacagctctgatgatgtgcaagaaaggtaggtaaaaactcaatgtaatacagataacctgtatctttaaagcataaaacattctgacaaacaattgatcagacttaggatctttggttatttttctaacatagtagtaaagaatatagaatcacagactcttacaggtcctagtaagcaaacaactactcactcagcctttttctctttttccttccttctttcctcccttccttccccctgtctctccctccctccttccgttctctttttcccttcccttcccctttctttcctttcctttgtttttttccctttctttccttttccctttcccttttcttttgagtgcctactatatgccaggcactttgaatacaacaatgcaccaaaaaatgaacaaaacacacagttttgtccctcgtgataattttggtctagtgtgtaatacaaatattaaagccatattaaagaagggttatagtctttaaagaaatagtacattattattccttataatactagtttacctttaaatgaatcaacacattatgttggcagcaacaaaattgtacgtttttacttactatctaattgaagaaagtatttaacatatataatgatgagttctctaattttctcatatttaatagatttgtgtgtgtctgtgtgtctgtgcgcgcgttatctgttttatgtctttgttttgttttctttcttttaggagggcacagggatctcccaaatctggtgagtcgaaaagtatctccttgagaactgtgccaggttctgttgacattttgttctggtgagggaaaataaccaatcactttcattacctttagactgtaatgatcaatggcaaatgatccagggtcagttcttgaatgtcagcattatggcaattccttgcctgtgttcagtggcacctagaggcttggcacctaataccaggttagtaagcatttttattgaattgttgatacatttcttatagaccattttttttccagggtatccaattaactgttggttagctagaaacttaacaggtagtttatctttgtatattagagattctaagggatttgtcatcacagtaggttgagaacaactgttgaactggaataattatcagataatcattgactatttaacgtcactgaggctaaaataatatttcctaagttttattgatagaattttatgcctactttacttgatttattcatttagttgtggagaacattatattaaatactgatatttcttgtgaatgtctttgctttccaactttaatgcaaacataaatatccttagcatgaaaatcacacatatgtatatttgatactgtattagtctgttttcatgctgctgataaagacatacccgagactgggtaatttacaaaagaaagaggtttaatggacttacagttccacgttgctggggaggctccacaatcatggtggaagatgaaagtcacatctcacatggcggcagacaagagagcttgtgcagggaaactcctatttttaaaaccattagatctcatgagacttattcattaccatgagagcagcacaggaaagacccacccccatgattcagttatctcccaccaggtctctcccacaacacatgggaattatgagagctacaagatgagatttgagtgggaacacaaagccaaaccatatcagatacttttagtcaaaagaaacatttcagttctatttaatgtgaatagtagtgcatatcaatctcctgcccacattttcaattgaataaaatatgagacatcttatatatatctttttatccatgggatatagacattccttctcttgcacattcttcttaatcagctgtccattatggggctgaaaatatttctttcctgaatccaatcctgtagagtgtaggagaaaggatcgtgagtgttgtgaaatataggcaataaacggggaaatattcaaagttagagaagaaaaaagagaaactgcaaacttcgatattgaaaacccagatggcaaggtcctcattaattacatctagtgctaaaacttcaaaggagtattttgaaccttgtgtgatttagaaattgagcctggtggttttccccgacaccttcagaaatcctagatagctgtgtgctttcataatgtagtttccctgactaaacttgaagacgtggctagctgaccaaggagctatgtttggcaggacttgagacaatgtttatctaaccctgtttgtttaaggaccttcttgggagggtagacctgctcttctgggaacaatcgattcatagctccttcaaagccactccataaatgttctgcttgactagaattccactgttgactctgcaggcttaatcagtattaatgaatttttcagagaaggatgactaattagagatttcttctgtggtttataatcacaacatgccatctttgcaaagaccttttgatcaagactcatttgaccggagatttttcagagatgtagcttctgatgattcaggatgattgaacaggagatttcactttcttctttttcccccaccatgataaataataatttatgttagaatatctcagtgcaaattgccagtaggaactaatattcttatattctaagtattctaagattaaatgtgttcatatatgtgagacatttaaagcagtgccagccatgtaagttgtgtttctatttcaagtaaatattgcaaagcaggcataggatagtgcttttaatgtttataaattatgcaattaaagatgcacagtaacactaccatgaacgttttggtgctgtttatttttaattgggaagaagaagcatgatggaaagcatactgagcacctggagtattggtgctgatgaccattttttctctgtgtgcctttgaacaaatcacttaaacttggagttgtcttttccctctacatgaaatgagcgaatgatgagataatctctaaggtcccttacagctctgacttgagctttcataagatactaagagctctttttttattttgttgttattcttaaattaacttcatgtttgcactgaaatcaagctagaagtcatttgtatgtatttctgcaaactgcattctatagcttgatgcatttgtgagtggctgttttggcactaaatcacacctctgaattttcactctcttatattggatggaacagttatgcaagattaaaatgttcagtcatttaactgaacatgtgtggcagcatttgttcactccatttcatccatccaaaggccactttgatttatttcatttcctatgtcacttagaccttctgtctataaataaatatttaaatcacactttagattttagaaaatgttgagctatttgttacacaacttgtgcatattaactcttctataatacatcttttaacaacatagtttcacatttagaatttctaattacattgtattttaaattatgtcttgatatgtgagtaggacgcttgatggtttgctttgtaaaatgctctaatgtaagagcttattgagaaggaagccagtgatttaataaaactcatttgaaagcctgcatcatttaaaaaatagcaagatacggtttatgaattttaggtaaacgtaacatggtgatttatctatcttgtccaatactttcagtaaacagtatacttgttataaggaacagtatgtcataatttttggtataatctcttagtaaatttcttgatgtctaatagaaatatttaatttcagattaaataatggaagtatggctcttataattgcccgaaacacttctcggccagaatttataaaacacctgaaaagatatgccagtgtaaaaaatcaggtatagtaaattctttttgttacttatttgcaaagctattaatcatgtagaaaaagatgctgcaagaattgacatcgaatcctgcctcataagaaggttttattttcttctgaatatattaatcttctttttcccaatctatttcatccaaattttgaaaagcatccgccaggattaatatagattggccttttttgaatgatgaattagtggttatgtatctgtaaccacaaagataaaataggaaatgtagtgttatattgcaatgtgaaataaattaaggataaaattccatactcaggctgttcttcagaatgaaaagaagtgaaatttgagagtttagccttcttgatattatggcagcagactttctaaagttatgatctttagatcttcctgacatttgtttgcatatctgcattgattgaaatagatctgtagatatgtatttaaaaatatgacagttttatacaaatattcattcaaaatgagaatatgtgaagatatacatttccacttaagtgatttgctttaaagagaaacagtaactattacaagccatattattttggcagctgttttgacctgattattaggaaaatgatccttgaactatgtgaatttctgaaattgtgagtctttgaagtacataggtatggttgtaaaaccctatagtttcacactttttctttttctttctttttttttttttttttgagttagagccttgctgtgtcacccaggctggagtgcagtggcgtgatgtctgctcactgcaacctccacctcccacgttcaagcgattctcctgcctcagcctcccgagtaggtgggattacaggctcacacctccatgcccagctaatttttatatttttggtagagacagggtttcaccatgttggtcaggctggtctcgaaactcctgacctcgtgatgtgtccacctcggcctcccaaagtgctgggattacaggcgtgagccaccacgtccggcccacacattcttaaaggtataaaatggtgcttggatagagttgggagataacagacgggaggaggaggagagtaaacccagccaatgactggcagctgaaccttgcttatgtaccttagccatagcaagtctctccatttttgcctcattatattttaaaactttcttaggccatcttcatgaagtttgatctgtcagtaacattatttgatcctcatgtattgaacaactaactgggctgcttaggaacttaaatcataaaaaattacagtcccactttctttatatgtcaaagtagatcagcaggtataatgtaggttgtgagcctacataacagttttatgtatgtgtttgggtggaatatggagatttattgattttcaaaggaatatatgccctttcacattttaataaatttctaaacattaaaaccaatttttaaaaaacccaaagcactatatattcattgctgtttttaagtcagaaaatagaaacaagaaaatgattttaaagcactcaaaattccatgttcctcaagattagtgtcattaccttggtagaattttttccgaatccttttttattaaataaatgagaagtaaagtaagtattaacctcattcatgtacctctatttgagaacttaaatagtattaacctattaatgtacccctgagaagttctgtatttattttggggaggtgtatgttgcacaaattgtttatggaaggtctcttttgaaattgcctatggggcaagtctctcaggcaatttttgtaaacattcttcttcttcatttttttaaatcaatatacctttcttctgattttaaaagcaatggttaccttacacataaagacagacatacagaaaataataaaaatctgtatcgataggaagacgttttctaagagataatattatgcaggatttatcatattttctcatgtactctacgaggcatatcttgcttttgacacaagaaacagttgcctgtgtgtgattcactggccttaactctgatttatttatcaactttcaaaaattaaaatccatgctattttttttttttttgcaaagaattctaaaatattttgcatagtgtatatagtaagaaagattgattcccagggtgactgctttcaagcaatgttaatttgatttgttaattatccacacaggtgtgtttatttaggctctttccttcatggtgacattaaaaatgtgaatttatataaattttgtaagattatgaaaatcagatctatgtaaaaatcatgtctactgcataattcatagcagtgctggtattcaggaaggaaaatgtggcaattcagtttaaggagagtaacatctgcttctctgaaccatttttaccaggttgaataagcgaatgttactgtataacactgtaaaatagattgaaaccaccatgtgcggagtggctcctgttccttccccatctctgtgtaaaattagatagaggctgaacactacccttcaaagtccttgcagctccatcctattgctttgccccccttctcactgtccacacttttctctttcattgtgaccatttttggtagggagtttaaaaccttaaatgtgagtgcttcccccaggatttctttgcagccctctcatcttctcaggatgccgtctcctggatggcctcattgcccctcacttttgaactgtctgaacatcatgcactcccaagggttctgtcatctcgtcttatctgcaggacctctgtcttcttgtatgctgaagaggttctgaaattcaccggcatctggaggccaacatgtctacagccgaccttatcttttcccctaaagttgttccttctgcgttgctctgtgcgggtcaatggcaccactttctacccatccaggttaccctgaactgttccttcttcctcattcctcactaccagtcccctaacttgttctgttggtctcctcttaaatgtttctaaaatttctccctcaccttaattcaaactttaatcctttcttgcttacagtagcctccttttggccttcaggttctctggtcttgtcttccatacctctttttagagaaacttttttctaagacacacattggatttctctcctgcttaattcttcagtgcctttctcttgttgtcagaataatatggaatatcctcagtctggaacacgtggcctttgtatccaggtccctgcctgtgttgcaaccccacctcttattaccaccctccaccacattcccagtgttttggcattttattcgttggctaaggttgccataacaaataccacagaaaagatggcttaaacaaacagaaatgtatttctttcatggttctggaggctagagctgcaagacaatgtcagcaggtttggtttgtcctgagtcttctctctctggctggcacatggctgctttctcacagcacccacaagtgagtggtctttcctctgttcatccccgatgccttttcctatgtccaaatttcctcttcttataaggacaccagtcgtattggatgagggcctaaagacatcattttagcttaatcgtctctttaaagatcttatctccaaatatagttatgttctgaggtatacagagcgaggatttcaatacaggaatttgagggccaaggggcatgatgttgagcacctaggagtcacactgaattctgtgtagttgcttgaccatggtttgcctctagttttgtaaatgcttcctctctccagactttcttctccaggctaaatcttatatgttctttaaggctcaattcaaatgggaagctttcccaacatccatagcctgtttgcctcctcttgtttcctctgttgaactccacacttgcaccatcatggcactcccctgtatcaaaattgtaactgtttacttctcctccccgtgccccaaacataccctcacacaggatactaagctcttggctcccgaaagtcccacttaacagcgtctgtggcttcacagttaaagcatttgaaggatggctagatcttcattttgtgaggagtgcacatgacaactgctgatttaagataatagacttactggtggtggctgtcaattcttgacattccttggcttacagctgcatccctccagtctctgactctgccatccttggcattcttctctcataaggacatcagtcatattggattaggtcccgccctaatgacttcatcttaagttgattctacctgcaaagaccctatttctaaacaggggacattcacaggtaccaggggttaggacttgaacatagttggggtggtggagggaaatataatttagatcataacaggcagttgtgtgttttaaatgaattatcaactaacatgaatgattatgtagataattctacaaggatgaggcatgtagccaaggctttatacccgaggtaggaggtctaacgcagttactgtcaaacagttttgcttggggccctctaattctgtacctcagtcacaacagctgatgccatcatatcatctactgtttaactgtgtttacagtataaactggaaagttggctggaccttggtatctacatatgtaaaatatgggtgttggggaaaatattagttttctgtcaacttttaaaactgtttcattgaggtttacatgtggaaaaggggaaaaactatgtagatgatgtttaattaggaatgtatctcatgtcatttttctgaaaactgaaatgagtagttatacatttctgctcaagttatttggctatattttcttaattatgtcagaaaatacatagtgctttttcagtatagtttccttaggcaaacaagaaaaaacgcaagttgaagtttaccttgcaccattctatagtggtaagtaaacagtgatcttgcagcttgtgtccattgttaaagtgggaatggggcaggcaaacaccttttaaaatccatatttgattggctttctcttttaaaagaagacatacatcccattttatcttcagaagtttagacttgcgttcttccaaattaaattccaagtgtgaaacttgtactagtttgctttatgtcagctaaactaattgacaagttgataatggattatatgtcttctgtatctacaggccagtattaaagattatctttaattgaaaaatctacagtatcactattttatgtaacttctcacagatatgtactatttgtcataaaacaagatttctaggtgctagatctaaaagaacccaaaaggctttggataagagattccttcttccaaaaaaacttggagatccctgttcatagtctcaaagctattaaaatgtcagcatacatgctgatatttacttgtgagagagggctcagtgaactttgattcgcgttagtagctagagataaaccaagtataatgattatttgtatttatttttagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattaggtaagtctatttatttcaccgcttattgtcaaccagtaaacataaatctaatattacaacgaaagctctcttctctgaactatcaaagcaggcagttggttagtttttaaaaaatcagtaaatcagggaagcataaagagacatgcacaaatttcaataaataaaaagcaactttacatttattcaactgttatgtagacccaaggcattttctttggttatgcgtgtctacattggctttctaatttattgttgtgcataaactacagataatgtctacaacttccattttggatttttaaaaatggatcaagatcttaaatcttttagtggagccatctgaatagtaaagtgttagatttttatccttccatcttagtttcctctcactcataattactgtaacatgttttgttcagtaatttgcttttattaggcctttacagagcattcaacttcccttgggaacaattttacatagcaactggtataaacaggtttaggaacctgcaaacgcattcttggtaggcattgtgacactcagtggttagaagaagcatgcaggggtgcccactagacatgggtgttctagaggcataactgactgttttacagaggtaatggagagcattggacaatcaaggaagtcagttaaggaggttttagagcaattattgttgttgatgatttatcaatcagaccttctcagttttctagattacagctctgttgggaatgctgtgtttgttatcaatttgtatttggcattggcattgtgtaccatacttattaggtgtatgtgaaaaacaacaaaataagttgatgaaataatgtattttctttacagattgcatccaagacttatcagtctttatggaggaagcatggaagaaatgattccaaagtaacatgtaattgtttctaaaagaaatgtacaaactagaattttaatataaagaaatgtggccatgctttaaacctgtggtccccaccctttttgggaccagtttcatggaagacaatttttccgtggatgggggaatggtttcaggatgaactgttccacctcagatcatcaggcattagattctcttgaggaacatggcactctagatccctcacataccagttcaccatatggttcgcacttctatgagaatctaatgctgctgctgatctgacagggggaggaactcagtaatgctccattgctctaacctcctgctgtgtggccaaacggatatcctaatagaaattgatgttactaacaattagcctctagggctttaaaagtcaagatgaaatatcaattcaaattctgtttttagatatcaattcaaattcttttttttacaatgtgtttattggacacacaaaaaaactttgcaaccatcataatacatcaatatttaacctagataattctgaaataatttggattctttcatttttcaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttcttaaagtggtagggttttaaaattcatgatacaagtaacaaagtaagttgataacaaatactattttgaactgggcaaaatctagcccaatatgtaattgtgttccccttgtatctgagaggcctgtgttggacaaccatagtactctgctttcactgtgctcagataacctgaaatatatagttgtttctgagtagttctgagtaggaaagaaccaaatgtaaatttccttagagaccatcctggagaagacagttctaaatcggggcttgatttttcatctatgatcctagatgttctcctgaaagaatgactagcctttttataacgatacaaagttttttaaaaatacataaatgtcataaagtttattcctgtgtatacacactctgggttcaggaggttttgtgcttacatttcactactcaaatgccttcgcaaatctcagaacattcctcaccatcactgcaggcctgtgaacagataactttcatcaattaggatggctggctagtggcagggacttcatataaagaaatctttcccagaattgtttttccacattgccttctaatttgatcactccctataacagatgttcaaaattcggccacagctctcttatgaaggcagagtcagataaaatgatattctgcaattatctagatcataagcataaaataaatattacaaaaatgattgtatttaaagaaattttttaaaatccagaaagtcatttaaaatagaacctcatatagtatgaacaaactataaaaatattttacatttca

SEQ ID NO: 9 - DNA, 145347 bp, Homo sapiens
  mutation 109658: a/t SNP in forward strand
attgctatttgggcaacaatatggctccttcagaactggtcgagaatttctgtggtctttgcttgaccttcaagttgggagtttcaaatcagaggctttgaagtctggaggagttcgcagccattaatccttccggggttgtgctaaaggcgtttctagaaagagatcggaaagacccgttcagcacaggcccattgcatcttctctttgaaaacgcttgtctgaatcaagtatcttatacagacccgagactgaggggagcaagagcgcaggtccggctgtggcgaggtgtccaccaccgtacttgtggtcaatgcctggactagagagccgaggccgtccagggcgggctggccagggaaccagaagcgtccctggactggctgagtgagggtgccctttccagcaacccagtggccatggttaaaaggcagaatacaaccgtcaaagaagtccccagctcccacataagagagcgcaaaggccaatggaaccaaggcctcctcgcgagaactagctcgctttgaggacaagatcctggggatggaggtggggactgacgtagtgagagggtctggaggaacagtcgtagctgaaggtcaggacatgaagaattgcacgtatggtagggatagaatggcaggtacaacttttctgtactgaaggaactgggagaggacgatccggttagggaggttggggaactaatctcaacgctgcgtttacagatgaagccgcttttatatggcgtatatgtttgcttagaggggccgacggagattaggagaagccatcctttggcgccaatgatcaaagcgtctgccaaggagaagaagccaagggatgggcctttcagagagggcaaggagtcatgctgctctggatgccagtgtcaggacaagaaatcgaaaggagcgaggactcttcactgcgtgcctcagtctccccgcttctgcctctttcacctctgtcctacttccggcgcgaaagcaggccactcgctctgatctagacctagttaacattagcttttcccttccttccctcaaatcccctcccccctctatccccgtcccttctgccgcctgaaagggttaatctctcctgcgggtaaaaacaggtccgcggagtctctaactggcgacagatgggccactttcttctggccacaaaggggccggaatggagcgctccgcggcatacaaatgggcaggtcacgtggttccaggctcttggctggaccgggaagaccatatggcgcatgccggggaggaaggaggaggggcgggggtaggggtggagggtgaggggagcggttgtcggaggagggcgggagacgagcaaggcgtggggagaagtggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaaggtaattacagttctttcatttttttgccccagaatagaagcaataactgaagactgatgaacctacatattctgtatgtgtgcgtttgcgagagtgtgtatgtgtattgagaccagcatccccctccataattgcccataagtactcacacataatgagtcgtgtcactcaagtaccccctgcaggctttctaatttaaattttaaaaatttgggtttcttttgtggatagcataggagcttcttggattttttaaaagaatgcacggtaactatgattatctgctagtgctgattttaaagtcccaaaagcaataatgacttcactttctcacttcttacagtaagaaaaaaaaatctatgttatcaatatatattttgtgtgcatgtattttacgcacattgggagtgtcaagctgtgttttcagtgaatgaaagggacatggataccttgagtattcacaccatggaaaataaatcaggttcagagatagtttagttgagaggggggaaagtggagaaagggagagggactcactcctgctacctgttaccgctccagaggcggccaagtccccagcagccactactggagccagaaattcagttgttttactaaaggctttttattttccttactagaagcggcaacttcgcggttgccaatcgctgaccattataattactcaatcttttaaagggaggtttgaggcgaactttgaaaagccccaataaagagcgggcggccctttcaatgggctgtttattagagaggagccttccgcacctgatccccggcgcgtgggagagcgctctgcgccgcgcccccagccctcgccctgcagctagcgcttttgtacaaggtggaaatttagcggtgggccagagatggaaggcaagaaaagaaaggcgagggaggggtggaagaccctgtccacttttgttgccaaatgttacattgatggtgaaacaatttggtggaaactatttttcctcctttctgcatttgcttttcagtatcccgtcgatgtaatcttcttaaaaatcgctgccagtattagtaaattacgcaatggctgttcaacttaaatcgctaagtatctggaagccaggacagaaatggaagtagaatgtgtgattttacagcttttttttttttttatggagttgtgagtaactttgaacacatttggataaacatgaagtcgctgaaatgtacagtcatttccacacacattatcctgtcgggcaaccaccataaacacatttaagttaatcactaggatacaaacacatatgcgtgagtggtgtacacatatacatattcactaccctcccccagtcctgtcctcactcctacgtactagcggggcacacgcacgcgccattataaaacactgcatttaactttttctcagaggcattcattttgtaatgggcaggtacttttcgcaagcatttgtacaggtttagggagtggaagctgaaggcgtatctggcttttgaatatagcgtttttctgcttttctttctgtttgcctctcccttgttgaatgtaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaaaccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtgagagcaattgttgcatttcttcttaaagggattctgtttttatttttggggaaagtagttgcttttttgctgagttaaaaaatactaaacactatatgtagaataaaagaaaagaaaaaagtttaccttggcatatgctcttgtctgtttatcttgcacagggagtcaccagttctatgtagataatgaaaagacctaactgatatttcattatttggaatatgggactggacggcagtacaaacagtgtgtttttttctttgttttaagtggcttagcctttaggttttttatttccatttttaaaaatgattgttacatgttttcttctatttctttttttaaaaggtggattttaataattattaacaagcaagacataaacaagtatcctagcttagtttgtctatacatttaagatgtataaaacattactattttcttggtcttctgttatctgtacatttttctgaactaaacagttttatcttgcaaactagtactgtcccagaaaaatttatacacctttaggaagtaccaaagggaaatgagttaattaatttaaagaatccaagagaagtaacattttataattgttctattaacatcttgtgatgatttccatcatttttccaagaaaaagcataatggattatttgtactgaagaacacactatttgtactgtatttaggaaggtgtaattatttcctccccccaccctttggggcactattctgttgtttcatgaacacaactcactggaaaaacttatggatgattctgtctattgttaagtccacttcaaaaaaaaaaaaacagtttggcatttcttttcctctggatgtattgactgacagtcatgattcctagggaatatcattttggcacttgtgccctggctctactgtggtgctctgattactgtcattagtaactccattgtttctactctgattcgggtgccacattggatgactaccccccttcccaagcttgttcctttaatctccttctcattggtgatttaggggttccagaaagctgacctcatttagcaagctgctccagaaaaatgtgagtaatgtaatggacaggaacaattagccatactaataacattgccaatgaggctgcgtcaagctgtgacagaagcagtaaggaatacttcgacgttaaaaaaatgtttgagagcaatttaaaatatattattttaacatgttttctatcagccttcatcacatgacagaaatacttttaagttagtcccaactttatctaaaatgcagcaatctcattccaagtgaatcagagttgttattttggaatcaagctgttgctttctatatcctggattgttctcactgttcttactttaagagacataatactgatatgatacttgaatactaccagccttccagtgtaggaggtaatgaagtgagcattcagatctgatctaacctattaagtagctcaatttcacctgcaattaaaattagacatcttcatgcaaactaaaatctgttgctgtagtgaagagaagaaataaaagaatgccattttgagaattccagcttccaaaatagcaaacagggaaatctagactgtgttcttttgtaaggtagaaatgaagactaaaagttaggttttttttttttttcttcccattttgccaatacaacttcattctaaaacatagggattctttcagtcagtcaaggagtaactcacatgccaccatcttttattcaaaggcaggcacagatgttccttctgcaggggaggatttaatttatgaaaatgatattgtttatgcatgaatgaactgcatgcactctgcataacacatagcacttccatctgatcagagaaataccacagaaccagtgccaatgtcagaaacatattctacaaatttactcacttaaatgtttaatgaatatttggaaggcattttcaaaccataagaaacattttaaattatcttcttttatgaattcctacccatatttaaaagagactcttacagtttttgtaattggctaatgcttatacccagtttgtaagaaaagaacatattttactaaatgaaaaccaaccaaaaaaaaatgctggcaagtttggcttcactggaaaaaatatttcgtttagttttgctgtttaatgcttgtcatgaataatatttgggattctatctgtttcttcatcttgagccacgactattcctatcaaataagatgcttaggtatacttgtttaatgtgaaaatcctatgaatagttatttctagaaaaagctggtatgtaaaatcagggggaaatttcataaagatgaaattgggctaaatattgtaacatgcataattactattgaataggaacacttcacataacatattttactttatataaccaattgcagctatatagtatgatctatctacttttaatcattaaaacaattatatataaattaaaatgaaagattataatatcaagagtgttctactaattttaggtttataatatgttacagtaaaataccatttgaaataaattttgtgttctaatttatcttaaaatctctctgtttttacatttgaaagtccttacattcttacaaaattaatgcattttctgaaagaagctagcaattactaaaatgatatatggatcattagctaacagtttgaatcaagctgttttagttctataattatacaagaaatttaaagtgaaaatacctattaagcaattaataaaactaggtttcaaaatattggctaattttctcctaatgggaaatgtaaaatagcaaaactgcttcttaaactacacaaaaacctcctcacttctccttttctctctctctaacaccacttatttcctgaaaatcatctaaataaaatatttaattccagggtctgatgaagaataaaagagccaatgcaacatcttgtggaacaccaggactgagaactcttgttgttaccattgcaaagaggcgttctggcgtcagatgcacagtgatttgtatggtggcataatcattggctcctggccaggcattatgtttcagaggacactattgtcaagaaccattcaactagaaatctgcactgtatgcactcaaaagttgagatcatctgccttcctatgacaggaagaattctgtgctggcaattgactcatggactctcttcacatacactaaggcttggtccagtggctctgatggaattaactgtgcagccaaactagtggcattgacaagacagggccacagtctctggggacttcaggagaaattgctaattttaaaatgcagagtattatgttaatgctggattaaatcttcagatacattaaatgtggatttggccatctaagcattattatgttatttgcccagttaatttagaggtagatggatggtgacaataaccatctctacagatccacaattctaagagatggatccaattgtgaaatgatatggagagatagagtaagttcaatctagcatatatgaagtaatttggtaactgacttttcttttaacaagatcaaaagctaacctgctttacactttcatgtctaaggacagccaaccagagagatggcttcacacactagcccactgctaagtgcttttcattcactttcatatttcatcatcaaagcaccctcctgccttatttatagatggggaaacttcaggaagttgagatacctagatatttgcattcctgtcttcctttcttcattcaggtttttctttcattgccacttcctcaaagaagcttttactgattcccatttaaaatagcaactgacttcaactccaccaaaatcactgtattgcccctccctctttccagagcatttgcctatcaaatgttatcttatgtatttacttgtatagcttaattttaaactatctatctctaggtcttctgagcacctgagaaacagagacaaagttgtctcttctgtgtgttgctgttcctctggtgcttagaagacctagaggatcctcaataaatattaactttccaagggaactgaagagcactaatgtgatgctaaagcctgttgccttaaccactatgctataagtcaaatcagttgagaatggagaggaccacaaattattttcagtccagcaagtgttataaacattaattctataaaaagaaaacaattgaaactaatttcttattatattgcatggcaccaaactccccccacttcctttttgaggatcatgagttgtctgtcattgtttctttttattgatatcaattggttaaatataatctggaattggaataaaagaaaaactattataggctttttccagaccatgtatttcaatgcatattattttttcctttctgttcattattctttcagtaattgcacttgttctatttttagtgttatgtaaaattactgtagctcataatttctattttgaagggttcagtgtataaacttagcacatcaatactatctttttagtgttcgcgctcaatggtgtcagttaagagatcaccatcacttttggtgacgtcaatgaaggggtattgcaatgcttaagagaactgttaatccctttccactggtgtcactaacaattgtagtgcttgtttattcatagcaggtacgtgactaagtaatgttaacatcaaagcagaaagaggataatagagtgttctaaaaagaaaattcggtggttgggtgcagtggctcacacctgtaatcccagcacttttgagaggccaatgggggtggatagtttgagcctaggagttcaagaccagtctgggcaatatggtgaaacctcgtgtctacaaaaaatacaaaaactagtggtgcatgatggcatgcatctatagtcccagctactcgggaggctcaggtgggaggatcacctgagcctggggaggtcaaggctgcagtgagacgtgattgtaccactgtactccagcctgggtgacaaagtgagaccctgtctcaaaaaaaaaatgatttgagataacatcacttgtcattgtttgttaactgaataatctttattctagccagtgcctaaatacataataaatgatagtacaaatggatataaattataactaaacctaagtagtgatatttatcacaatatttctttactagaagaatttctttgttaatagaggcaaggctacttgtttagataccttaaaataacataagatttttggataaataaattaatgattctttgattctgactggcatattaaaaatattaagcgaagagatctttgcttcccaggttttattttttgtctaattaactactggtgcatttatattaaaacatattgtcaagggaaaacgtatatatatatatgtgtatatatggtgtgtgtgtgtgtgtgtgtgtgtgtgtgtgcacacatatgctatacttggttgagtagtatccccttcccttgcccacctctctcccaaatttatgtccatccagaacctcaaaatgtggcctcatttgaaatattgtctttccagatttaattaagatataagatgtaaattgatacaagttcatgctggattacggtgggccctaaatccaatcactgatgtcctgataagaagcagacagaacacacagacacacagcatacaggaagaatggcatgtgaaggcaaagacagagactggagtgatgtgtctacaaatcaaggggccccaaggatttggggcccacatcagaagctgggaaagagacaggaattctcagcttctccttctgaatccctaagaaggaatcaaccctgctgacaccttgattttaaacttcttgtctccagaactgtaatataatacatttctgttgtcttaagctacccagttgctggtgatttgttatggcagccctaggaaactgataggtatactaaaatctctaatgaattgatgttaaatatatataagtataggagagttcatttaaattcttctgaaaatgtcttcttaaacttttaatgatacagtatataacaaccagtatacgtagttggtatcgggtttgacatttaaacaagctgacaaaaaacagctgtttaataaacatctgaattatataaaagttttattgtttattattcatgtgaatgacttaaactgacatctacatttagtgaagtgtgaatgggcctagccaataaactatgggtaatttttttaaagtctcatctttgaactcacaaaaaattatcaaatatcagctattatgtattcttcatgtgaagaaaatgtcatatttatttgatttgtggattagcatatatattaatagagcttttgaaagaacaaatgtagcactttcccgatttcatagacactcatttaacacacaagttcatattttaaagtacataattttaaaaaaattctagtccaaatgaatttaagtgccatgacttctaaaaattctgtctctatttttgggttttataggaccttgagccagtactcttctggtgagcttaagaggctaagacttcacctttagttatatggggctttcatctgattatttgtctattttgattgctctaaatacaagttagtgtgtatttcatctgaatgtatttcattataagttttggttttatgtagatctggggatctgtcttgtttttaatcttgattggtctgtttgttttgggatagttggtactttcatttcttatgcttgctttctttttcattttgtgcccacctttagtcaggtgaacatcagtaaggaataaaattttatttttttaagccactgaaaaaatttaaaaaccacatcataactctgcctctgctgactgataaaaatgctaacttattaagacaaaatgttatgcaagaagactttattggaatagagaaacatcctttttatgtaagaaatatcaacagagacatgtgcctttcttgtgacaaatgtggtatgtgtgtggattagaggtctggaatgtggcagcatttcagtacttggaggggagaattagagtagggtagaaagatagacggggagcagaggatgattctcacccagtagaaagcagagtgaagaaagaaaggggaattgttttttgcattatattatttgaactgtggattaagtctttccataagccatccctacgcctctaagtaggttttattaacttaagctggtttgagatgggtttttggtcacacacaagaattgcctgatacaagagaggctttgattttgttgttgcttgctcatttttatacactaagatggagaaaaccctggacatagtgaagacgaaattgaggaaggtgttgggtagagtggagggtagaagacctgtaacataggtacagaattacattaaactggaaggacttatatccagatataggagtcagggtagaaagagagaatgttagcagtaagggtaacagagtagcagaagtttattcttaccaggtcctgttatgtgacagtggaggcatgttgaccttctgactaggggagttaaaggagaacactgaaggtttagaataatgtctctaaggatagaaagagaaagtttcatcaagactcatcaataatagggcagcagggcttagggccaagcaaattcagagaccatgatattatagtagtttgtagtggtcttaatccatctaatttttcagcattttctcaatggccaatacttagcagtggtagtgttttatggcatttggacaacagaagtgaaagcactggtaagagagacgttgaagtgaaacaccatggggctcagaaaagcagagttgatccatctggtacatgggcaaggatggtcctgaacaattctgcagtaagttggaagatagaaaaaatacctaacgaacttgtagatctgggtaaggagatttttggcagaatattgtaaggctaattggcttctcttaactatatgagatagggttttacaagggagagataagcgagcataatttagaagaactatagggggtcccaggcagactctctggctggaaaattattctgatagcaagaaattagccccaaagcaaagatgaaaagtagggtacttccaattaaacatgtcataagggcaagcctcaatcaagagtgtggctagaaggcacagctcacctggacaaaagtgcttctaagcatattaggagcatataccacaataacctgacttggacccaaagttgagagaggccagtctcaaaaaaatttgagggaattgcttttgcataatatgatactttatatacatatctgttacatatcatatatatcatattaaaaagaaaaaaaaccctgtttttccttccgttctttcatataacccttctgacaacaaatgtggagtttttcacacactaagcaattctttagttcttgctggacacttcctggatgtcctacaattcaactcgattctcacacaactgcccagagtcagtgcagacccgcagattaaaggcttagccccaaaagactaccccccactttagatgtcaatcacaagtctcaacttcatttacttctgaaggacgagctatacattggaggaaacccctctttctttcaataatttgctagaatggctcacaaaactctgggaaacatttacttatggttaccaatttattataaaggatataactcagaaacagccaaatggaatagattcatagggtgaaaaatgggggagaggcatggagcacaactctctcagcacctccatgtgttcaccaacccagaagctctcagaactccttcatttagggcttttatggagctttatcaagtaggaatgattcatgaaatactggcattggtgattaacttaacctccagcccctttcccctccctcaacattgggggtgaagctaaaagttccaactctgtaatcacagggtgagcttccctggcaactagtcccctgatccttagggggcttctgaaagtcacctcattatcataaactcaggtgtggttgaaagggatgttttgaataacaaaagatgcgcctttttcctttatctttctgagttgtttcaggagctagggacaaaagactaatactataacaacaacaacaaaaaattcaatttttgcttttatctcttgggaattacaaggattttaggagctctgtccagaagccagtgatgaagatcaaaatacatatttcttattatatcacaattcacacatgtacatgatatccgtaagataagtgaactacataaagtaagctcacaaagtttctgtaggagttttgtccatttacaaacagtttgtaagctaaaagtatctgtgacaagcctcagtcaatttagaagttcatttttccaatgttaaggacatgcctgtgacacagcctcagaaggtcctgatgacatgtgcccaaggtgatcaggctacagcttggctttatacatttagggagacataagacatcaatcgatacatgtaagatgaatattagctcagtccagagaagcaggactactgaaagtggaggcttgcaggtcacaggcagattcaaaggttttctgattgggaattggttgagttattatcttaagacctggaattaataaaagggaatttatcatgcagatgaagctttaggtagcaggcttcagagacattagattgtaaaggtttcttatcagacttaaaagagtctgttctaacagtctttaggtctcagtgttgatgttaatgctggtcagctgtgcctgaattccaaaagggaggagagtataatgaggcatgtctgagtcccttttcccatcatggcatgaactagtttttcaggttaactttggaatgtccttggctgagaggaggggtccattgagatggttgggtggcttggaattttatgtttggtttacaagtttaacattaaaagcctctgtacctccaatgttttatggacaaaaagaaggctgaaaaagctacttggctgtaatcatgggccatttcttgctgaaaagaagaataaaatggaggcagaaccaaaagcccagaggctagagccaagagctgctgagaatgatgaattagggaaccactctcagagagcagatctggatgtgagataggaacattttctttctcagggtctatgaaactggcaacatatgctctcctgaatttcagaattgctatggaccagtgactgtgatatgctttctatatttttcccttttgaatgggtgcatctatcttgattatcctctgtctcattattgtatgttggatttgtgtgggacgataacatgtgtttttagttcctaggttcccagaataagaggagcacactcaaagagcgacatttatgagatactggatttttcacttgatatcataattgggtgagacttgaaagaaagtgaacatattttgcaaatgggagggatgttaaccactgacaaccacacccacagggtccactgtattagcctatctgcaaagacggctgccaaaaattccttctgtccatatatacattcccttttttaatgtgactgtttcacctgccagcaactgaagggctttatttccatttccccttgtgacttgtttgactaacagcaagaagcaaaagtaatgctattccaattctagacctgggccttaagaggcatgacagcttctgcttttactctcttgaaactcaatgtcattttttaaaagctcaggctagactactcatcatgagggaccacatgaaaagagataggcccagctagtttccacccattccagccgctccagatgagatgccagacatgcaaatgaagccatcttggatatttcagccccagctgagcttccagctaaatgtaagtacattcagttgatacctcatagagcggaactactgagctgacttcatccaactcacagaatcataatgaataacaaatcattgttgctttaagtcaatacatttaaagtttttttgttatccagttgtagatgaattatacagcctggggggaaaaaggagatagcacactgttagttgcctcatcaatattcatccccaaattctttttcctttttagtaggtctcacctcccacctggaagctgaaaacacctttcccagtctctctggaagctacagcacaggcatgttgcccaattctaaacaataggacatgataggaggtctgctgggtgggatttttgaaaatatttttttttctggttaagaaaaaagaaatgcccaaggaaaacctacaaatgccccttccattcttgcttttggacattttttgggagagggtatgatgcttagcactcctgcagccatctcggggccaacaatagaatccttgttgctacctggtgatagtgaagtagaaagctacaaagctcttgatttcttttcttttttttttttttttaaattttattattatactttaagttttagggtacatgtgcacattgtgcaggttagttacatatgtatacatgtgctatgctggtgcgctgcacccactaactcgtcgtctagcattaggtatatctcctaatgctatccctcccccctccccccaccccacaacagtccccagagtgtgatgttccccttcctgtgtccatgtgatctcattgttcaattcccacctatgagtgagaatatgcagtgtttggttttttgttcttgtgatagtttactgagaatgatgatttccaatttcatccatgtccctacaagggacatgaactcatcattttttatggctgcatagtattccatgctgtatatgtgccacattttcttaatccagtctatcattgttggacatttgggttggttccaagtctttgctattgtgaatagtgccgcaataaacatacgtgtgcatgcgtctttatagcagcatgatttatagtcctttgggtatatacccagtgatgggatggctgggtcaaatggtatttctacttctagatccctgaggaatcgccacactgacttccacaatggttgaactagttcacagtccaacagtgtaaaagtgttcctatttctccacatcctctccagcacctgttgtttcctcactttttaatgattgccattctaactggtgtgagatggtatctcattgtggttttgatttgcatttctctgatggtcagtggtgatgagcattttttcatgtgttttttgactgcataaatgtcttcttttgagaagtgtctgttcatgtcctttgcccactttttgatggggttgttttttttttcttgtaaatttgtttgagttcattgtagattctggatattagccctttgtcagatgagtaggttgcaaaaattttctcccatgctcgtgggtaggaagaatcaatatcgtgaaaatggccatactgcccaaggtaatttacagattcaatgccatccccatcaagctaccaatgactttcttcacagaattggaaaaaactactttaaaattcatatggaaccaaaaaagagcccgcatcgccaagtcaatcctaagccaaaagaacaaagcttggaggcatcacactacctgacttcaaactatactacaaggcttcagtaaccaaaacagcatggtactggtaccaaaacagagatatagatcaatggaacacagcagagccctcagaaataacgccgcatatctacaactatctgatctttgacaaacctgagaaaaacaagcaatggggaaaggattccctatttaataaatggtgctgggaaaactggttagccatatgtagaaagctgaaactggatcccttccttacaccttatacaaaaatcaattcaagatggattaaagacttaaacgttagacctaaaaccataaaaaccctagaagaaaacctaggcaataccattcaggacataggcatgggcaaggacttcatgtctaaaacacgaaaagcaatggcaacaaaagacaaaattgacaaatgggatctaattaaactaaagagcttctgtacggcaaaagaaactaccatcagagtgaacaggcaacctacaaaagctcttgatttctaatgacatcatatgggatgaaccaacccaggaacagcctgactctggacctcttttaatgtcagaaataaaatcttatttgtaaaccactcttagttgttcaggttgttgacacaggcactgaagtgcctccaaatggtgatgaataatgaggcaaaagtcaaagacagcaagtctagtgtcaaattttttgatgcctatgggtaagaagttcaagaaagtgagctattttctttctttttaaaatttatttttatttttgtgggtatatagatgtatacattagtcagctattttcaatagtgagaagggatgttgccacttagtataatgcctttttcatagctatcatagaaaccatatatacatatagtatagaaaatgaggatagatttctgacttaaactgcctatttcatttgtgtgcctggttacacctaattcaagactctacaatacagcattgctagcaattactgtgagaatatttcaagctccctatttgctggaaatacatttcatttttttgttccaagtttatgaatattagaacctatctaaaaaggagcttttaaaaacttgaggaaaggaaaagggagggcctacttttcttgcctgtgttatttcttgttactgctgattgagatgctagagatcatattgggtgagatgtgtcttagaatacagctgagcaattcacttttaacagtttccatctgagtacaaaaaactggtatgtgcagaaaacttgatattctgacttggcgggattctaggatttgttctatttttttctgtaattgttgtagggacatatggccctgtaccttttgggcagcaggagccagaatagcaggaacattctgacaaaattcccactcagcatgagagggaagcagtccccttgatacactgatgatgtgcccacttagcattacaagtgtttgagaggtggacacaactaaaactcacctcactcaaaatatatattgacacggagaaagtaaatacaatttgctgttattaacctttcttctcaccattgagacatgttaaatatctgaaattaataaaggaattaaatttaaaaagtttacttatcatgcatttaacacatttattgagcatctgttatataaatgcactgtttcaggcacaagagatagagccataaataagcagattaaatcactattctcaactgaggtactaatctgatataagagaggagacagaaataagtaaacattataaatcaactacatacttttacatggtgtaaagtgcaattaagaaaatattattgaatagaggtcaattttggaatggttgggcagggaagaccttctgaggtgacaagaagttggcctgggcaccatggggagctctaccatggtgaaaagtgttccagacagagtagacagcaacagcagaggccctaaatgagaatgcacttggcttatctggagagtagaatgaaggccagtgtggtaggacacatactaataataggagaaaactgatagaaaagagggtttgagcaggtgggcaggaattggacaacatggtgtctcatatgtcataatagaagtttggattttattctacctgcagtgagaagttcttaataaaaaaaaaattctataaactggagtttgagaaagaactatgttgatgatagcataagccctcaatcacttgtcacataaactccaaacttcagcagagactcagggagatcaaagggactaccacaggattacccactggctaaaattcagatccatggcagttggtcctgactggaattagacttccttgtctgttgccctcattgcagtgggtctgaatgtctctgtcggctgtgaatttttctccctctatctgtggcactgagaaggtggcccagacttccagagtctgtctcattggcctattacttggggatttgctgcccttcttctggaagtttgggtatttgttttcagagcatacttaaaggcctcctgaaagcaatgttaacaatagcaggatatattttacagtcttctactcagacttggatttttaagaaccagggatggagactgtgtttccagatctagtcaaatcccttccaaacataaagcaacaaagtgccttttaaactaggacctgtactgtttaatgctctggaaacaaatacccaagcttcagccaaaggagggaaagctatgttcaggaagcttcctgaaagttttttgaaagcaattttcatgcattagtattttacatatatatatatatatatatacacacacacacacacacacatatatataaacatatatatatatacacatgaatcactaatgagacaattgatcttcaggaactaacgtgaaataattggggtatcttggtattattgttatagataaatgttgaagaagttcattctttcagatattaattgagcacttactgtgtactaagaactgtgatagatactggggatttaatggtgaacaagataaattctctgccatcagggggcttatattctaacaaacttaaaatttactgagtgttctctgtatttcagtattgttactaagtacactaacttagtggggaagctagacaataaacaaagaagtatgtaataagaattaatagtaagtgctgtaaagaatactaaagcaggttatggtagagagattaatggcagcgtgaagatgtccatgtttcaatccccagaacctgtgaatatgttaccttacatagcaaaagaggctttgaaaacataattaagggttatctgggcaggcccaatgtaatcataagagtccttatctaagacgggggacaaaggtcaaagacagaggaaaagagacgatttaaggatagaagcaaagaggagagatgttagactgctggctttgaagttggaaaaagtgaacatgagccaaaacaaacaaaacagaacaaaacaaaatccacaggtgacctttagaaaaggggtccccagtctctgggccatggaccagtacctgtctgtggcctgtttggaaccaggctgcccagcaggcggtgagtggtgactggtggacaagcaagttttaccacctgagccctgtctcctgtcaggtcagtggcagcatcagattctcatagcagcctgaatcctactgtgaactgcacatgcaagggatctagtttgtgctccttatgagaatctaatgcctccaaaatgctcaccccttcaaactgcccccatccgtggaaaaactgtcttccacaaaaccagtccctggtgccaaaaaggttggggactgctgctctagaagccagaaaagaggagatatattttcctctagagcctacagaaggaatatataggcctgctggcaccttgattttagtcctgtgaaactgattttggatttctgacctccagaaatgtaaaacaatgcattggttttgtttcaagtcactaaatttgtggtaattagatacagcagcagtaagaaatgaatacacaggtttacaggatggtgaattatggagggtgctcaggaatggcctctttgaggtggtggcctttaaacagaaaaatgagcaaagtgaaagaatgaaccatctggtggggagaaaagcattccagtcagagggaacagcaaaagcgaatgctctgagaagggattattcttctcaatgtgtttgaggactggcaagaaggctttgtgtgaatgagcaaggggaaaaagttagtaggtgatctcggagacatagccagggtccagattataaaggacctctcgccttgctaagcattttgactttattccaagaataatgggaagtcaatggaaggctgtgagcagggttatatgctctcgttattttttaaaggcacaatgtaactccaaaatggaaaattggctctgggctggaggtgccagcacaggggaaaccgaaagcagagagctgggttgggagagcggagactgaagttgtccagctgaggggtgcagaagtgcagactgcaatgacagcaggcagaaaggactatatgttctagacagaatggacaggatttgctggtagattggattgaaggcatgagacaaaggagacatggatgatatcaaggattttgatactacagatttgaaacattctgagagggacaggtttgtgatggaaaatcatgagtctggttttagatatgttttagaagcttattggacagccaagtagagatgtcaggtagggagctggacataatacctaaagttcaggagagtggttggagctggtgacatcatttgcagaaccctggatggtacataaagcacgggacagtgtgtggatagatcctaaagagagccctagggcactccagccctggaagaaggcagcttatcaaaggaaaaagaaagaaagaaggaaacacaatccttattacttccatcttcaggacaattcaaagccagtgtttttgacttcctggcttgagtgaagcttgaaaaatggcaacttgcccctttgcaaagctcctaaggagtagccattggcttggcctgtttgcactggctctgggtgagcttttaaaatgccagtgagctctaattgtgttgattgcctaacagctgtgaatacaagatgctgactccagaactgcaactcattctgcgaagggcaccgtccttttccctctaatgactgctgaacagagccacctgaagcctgcatggggtttagcagcagctgcacttctgctctaagaaatagctcactgcagtcagatcaaactgaagctcttccttgcttttcctcgaagcttgggtacttattgtcggagcattaaacagtaagagtcctagcttaactggtgcacagtgctttatgtttggtagggatttggttaggcctacaaaccgtctgagctaagaaccttgagaaactcctgctatagttagctctttctgtgactctgcagtgtgaccaggaatgaggacagaattaagaatttgctgcctctatgatagaactgtttaggcactagaacactggaactagatctacaaccctatgaatttaatttccttttcaactcccctactccttcttttcaatatgatgataatgatcttgtttaaaaaaaaaaaaagccttctgctttacttcccactctgctcctcttcccagggactcactttcttcttgactgcttccccattacaagtactcagctccctgttttatcaccctgcttagagcagccattatcagccttggctgaacattggaattacctgggaacttttaaaaatccggaagtctgggtctcgcctccagagattccagcttagttgtcttgagcgtggcctggacatttgggttttcaaaagttccctatgtaactttaatgtgcaaccacaattgagaatcactagcctccagactctctgtgttatcaaaattaatgagcagctgattttagaaatctcagttatcaggagaaaagggtgaacccccccagggctcttctccttttccaggtgacacttctttatggcagtgcgtgaaagtgaagccctgctgcttgtaatctccctcaagggagtgcaagatccaggcaaagacaagactgcagaggcgctaccttgggggaaagtaggaccctaaatacttacacctggaggcacttacctttaatactgaatttgtcagatgcaaatttgtctatgcaaaccagggccttatctctagcttcccctcaggggttttgggaagtgcgctactactctgaaacagggttgtaaagcgtcacctgtgctctccagggaaccctctggaaaggaggtggaaaaacagaggcttccacccttgcaactctaagtgtgttccttggccagtgggatccatcacctagtattttcttagatatgtggtatctgggggccagtcccacacctatgcaataagaatctccatttgaacaagatgcccaagcgattatatgcaagtttaagattgaggagggctggtttaactcgagggtaacgaaaagtacgaaatcgtactttacaggagaagctaggcggagggagccacttattcttcctcttgcagctgggtctttttgtggtgagtggcgaagcggcgaggctggcaggccagggtgctggactgggtcaggcgcggccccgcctccctcctgggtccctgccctgcgcgccgttgctgtggcagcgctggacgcggctagagctggggctgccgcgccctccacctccttctccaaaggcctccccggacccctggctcgggcccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgagtgcccggccccaagcgtcttcgcctccctccgcgcttcctccctctccccggcccaaggcctacacccacgagcttttgctccaccctccccttttctcgcctcccctccccgtgctcgcctcactgcccggacaggttaccgagtccccaagtcgccgcctcctccttcccaactgggaactcacgcctctcgccccatcccagaacccccagggattctttcgctacctagccttttcccgcctccgagaccttccccgggcaaacgtcacaagcagcttttgctcagagtctcagcagaaaatcttgagccccaaaggggaggtaatttacaaatgtgagaaggtcaactactcctcccctccaagttgaaaaagttttaatccattaactttgatggtacattgaaactataaacatctcacagattatgcctacacaagagttctgaatccaactctcattttgctgacttgaaaatgtaactccagagctttgggagtgtttctgggtttttttctgcccctcaccttccttgccattgtctagaattaagacttcttcaggctcggtctagaaacttttgatttttaatattgaccctagattattggatcacagttttgcgatgcttagttacgtcaagcggtttgcttaacgtttgccttttattgacttaaaattttagttacctaaaaaagttataatgctgtagtttacaacaaatacttcgagtctattttcacgtcttagtcaaatagccttatagacttaacagatattttataaagaccattttgcaagtcttataagtagactttcatatagtcttatttctaagtccaaactcgagaaatactccccattgttgaattagcttagatgtgagcggtgaaagacagatgaaatgggggaggaactacatcaaggttactctacttgcgaggagatgacttgggggagatggaatttggtattcaacctcttttagctaaatacaaatttatgaaattaaaaaaattgccttcccctgttggaaaacaagacacagtgtggtatttatgttacagaatagactcactgtcttaaagtcttgctcaaaagtctaacaaaatgaaaccaactagccagggattcagcactggttgcgattgtgaattctgcctgtgctgcatgtgccatgctcgctcgcttcacgaaaacagtctttgaccttaaagtgttttcaggtgttttaaaaaccaaggtgtagtattttcttgaaccttttaagttaaaagctagggatatagctatggaattatttgtaagtctttcaggcaattcgagttatgcaatatagaagtttataattacagtttggattagcccaaagagccagtttaacctacagtgcagctgaaatgctatagaattaaaatgagacattgtgcaatgagaggtcatacaaaccaatgttgcagtatttgtgtacaaaaaaagcaaacaatgacatgagaaaagaaatgctgttttatattgagtggtgattaaggtaaaataggtttaattagtgcacccctggcagtagagtttaaaatacatcttgacagatttgtaactttaaaggttgcaagtactgattctttgtttaattatgccctaaaaccatttggtggtcttttccttcatacaggtgtaccctttttctttgtaattaatacctggtattcaaaccactttgggcctctaaaattgggggcacagaagcctagagccttagtaagtacttctgtttatggaagaaaccaagagatgttttatttaggtaaaatatagccaggcgtggtgtgtccctgtaatcccagctacttgggaggctgaggcaggtgaattgcttgaacctgggagttggaggttgctgtgagcggagatcacaccactgcactccagcctgggcaacaagagtgaatctccatctcaaaaagcacaacaaacaaacaaaaacaaacactgggaaataagaaggagatattaagagatgatatatttaaatgttagaaatgctctgttgttgaataagcttagatgtgagtggtaaaagattaaatggaagagggagctacatcaaagttactgtacttgggaggacatgatatggtaggatgtggtggggggagagcatgtccattgctggttggcaagtgactggctgcctcagaaaaggatgagggtgggtaggggagatcactggagattattagaacatacgtatgttttcaagattgcttagtttttaaacctcatagtactttgttttcactgatgaaataaaatactatgtgatctttttctaattttccatcttgagtaataagcaaagacattaatgtattttatgaaggctctgactgccaaaattgggacaaattgatggtcttgttggcagggtaaatgagcataaccgtagtaattgtagttctttttattgggttcagggatgacctggaataatggatgtgttattacccttccctgtagaagtgaggctttcgaaaagaggctataagtcaatttgggaggcacaaagtatcagcgctttttggggattttttttttttttaagtagagaaatattttaaatgtgtgatataaagttatgcatgtgcttcttaagcacattaactcaaccagatccaacagctggtctaataactttttaattgtttaaaaaaatttaattgacacattgtaattgtatatatttatgagatactatttgatgttttgatatttacgttgtacaattatccaatcaaagtagttagttatccttcacctcacactttcattatttccttgtgggttagaacattcaaaagactctcttctagttattttgtaatatatagtattttactgttaaccatagtcaccatactatgcaacaaaacaccagaatttattcttcctacctagttgtaactttgtgtcttttgactaacctctctccatccttccttctcccctccccttcccagtctctggtaactattctaatctctgccttatctatatcaaccttttataatagaaaaagattctacatgtgagtgacatgtggtatttgtctttctgtgtctgggttacttctcttaacacgatgtcctccaggcttagcattcacaattgacaggactttattttttaatggctgactagtattccattatgtttctgtatcacattttctttattcatccattgttgtacgcttaggttgattccatatcttggccattgtgaatagtgctgcagtaaatatgggattgcagatctcttcaacatactcattttatttcctttggatgcatacctggtagtgggattgctggatcatatgatacttctatttttaattgttttaggaacttccatgctgttttccatattgactgtactagtttacaatcataccaccggtgtgtaagtgttcccttttctccatatctgtgtcagtacttattttcttttgtctttttggcaatagccattctaactggagtgaggtgtatctaattgtggttttgatttgcatttccctgatgattagtgatgtcaagtatcttttaaatgcacctgttgatcatttatatgtcttcttttgagacctatcaattaaagtcgtttgcccatttaaaaaatcaagttggccaggcacagtggctcacgcctgtaatcccagcactttgggaggccgaggcgggcagatcacgaggtcagaagatcgagaccatcctagccaacatgatgaaaccccgtctgtactaaaaatacaaaaattagccgggtgtggtggcacatgcctgtagtcacagctacttgggaggctgaggcaggagaattgcttgaacccaggaggtggagattgcagtgagccgagatagtgccactgcactccagcctggtaacagagtgagacttcatctcaaaaaaaaaaaaaagtcattattattttatctgttgaattaattttcttatatattttggattttatccctttgtcgcatgtatagattgcaaatatttttctcccattctgcagctgttttcactttgttaatagttttcttcaaggtgcaaagttttttagtttgatgtaatcttattttgtctatgcttttgaggtcttattttaaaaatccttgctcaggtcagtgtcgagaataatttcccttttttcttgtaatttcatagttttcaagttttacattttaaatctttaatctatttttatttttgtatatggtgagagggaggggtttaatctcattcttctgcatgtgaatatctgattttcctagtaccatttgttgaagagactgtctttttcccagtgcatgttcttgacatcttaaaaattcagttggctgttgtaggtgcaaaaatttatttctgggctttccattttatttcatgggtctgtctggttttatgctagtaccatgctgtgttgatatagttttatcgtatatttcgaagtcaggtagtatgatacttccagttttgttctttttgctcagggttgctttggctatttggggttttttttgtggttctgcatgaattttcagattgtaacatttctgtaaagaatggtgttggtattctgatagcaattgcattaaatccatagatcactttgggtagtatggccattttaacaatataattatttcaatccatgaacatgtactatcttcccatttattgatgtgggaagataatttctttcatcaaagttttatacttttcagtgtagagattctttcacttccttggttgtttatttctaggtatctttttttttaaaaaagtactataaatggaattgttttcttgatttttcacatagtacaatattagtgtatagaaatgctactgatttttatatgttgattttgtgtcttgcaactttactgaattctaacagttcttttgtggagcattttgggttttctatctataagatcatatcttctgcaaacagggacagtttgacatgcttctttctaatttggatgctcgttacttctttctcttgcccagtttatctggctagaactttcagtagtatgttgaatagaaattgtgtaagtggccatcctttccttgttattgatcttagaattgatctcgttattggtcttttcccattcagtatgatgttagctgtggatttgtcatatgtggcctttgtgttgaagtacaaactttccatacctaatttgttgggtttttaatcatgaaattatgccacattttgtcaaaggcttttaatgcatctattaaaatgatcatacagtttttgtctttgttaatgtgtatcacatttactgctttgtgtatgttaaaccattcttgcatgcctctgatcccagtgatgaatcgcacttgaatgtagcaagttatctttctaatgtgctgttggatttggtttgctaatatcttgagaatttttgcacctatgttcatcagggatattgtactatagtttcctgtgttgtattgttatctgattttggaattagggtgatgcttgactcatgaaatgagtttggaagtattccctttgcttcagttttctgaaatattttgagaggaattgatattggtttgttaaatgtttggttgagttcagcagtgaagccattcgtttctgggcctttctttgatgaaagactttattactgattcaatttcctcacttattattggtctggtcagattttatgtcttcctaacttaatcttgataggttgtatgtgtcggggacttcgttttttctatgttatcaaatttgatgaaacttgttgaaaaccaactctaaattttgttcatcttttgaaattatttttagtctctatttcatttatttctcctctgagttgaattacttccttacttctaccaactttgggattagtttgttctgttcttttttttctttctttctttttttttgagatggagtttcgctcttgttgcccaggctggagtgcaatggtgtgatctcggctcaccgcaacctctgcctcctgggttcaagcaattctactgcctcagccttcctgagtagctgggattataggcatgtgccaccacacctagctaattttgtatttttagtagagacggggtttctccatgttggtcaggctggtctcgaactcccgacctcaggtgttctgcctgccgtggcctcccaaagtgctgggattacaggcatgagccacaatgcctggccgattagtttgttcttaattttgtagtgccttgaggttcatcattaggctgtttgtcagaaatctgttgtcttttttgatatgggcatttaatactataaacttacctcttaaaactgcttgtgctatgtttcgtaggttttgttatggtatattttcattctcacttgtctcaagaaaaattttaatttcctttttaatttcttcactgacccattggttgtttaggagcattttgtctccatgatttgtgaagttgtcagtttttctcattgttgatttctagtttatttcttttctttctccttccttctttccttccttccttccttccttccttccttccttccttccttccttccttcctccctccctccctccctccctccctccctcccttctgtattgctttgtctcccaggcccaagtgcagaggcacgatcttggcttactgcaatctctgcctcctgggctcaagcaatcctctcacctcagcctcccaagtagctgggactacaggtgtgtgtcactgtgcctacaggtgtgtgtcactgtgcctggttaaatttgttttttgtttttgtttgttttgttttgtatgtttagtagagatggctttcgccgttttgccatgttgcccaggctgttctcaaattgctgggctcaagcaacctgcccaccttggcttcccaaagtgctgggattacagccatgagccactgcacctggcctgatttctagtattataacgctgtggtcagtaaagatacttgatattatcttaatcttttaaaatttgttaagacttgttttgtggcctaacatgtgatctctcctcaagaatgttccatgtgcatttgagaagaatgtgtatctgcagctgttggacggaatgttctgtaagtgtctgctaggtgcatttggtctatggttcagcttaagtccaatatttcttgatctctctgtgtgtgtttgtgtatgtatgtctagataatttattcattattgaaagtgggctgttaaagtctcttactattattgtattggagtttatctctttaggttgaatatttgctgtatgtatctgggtacttaggtattaggtacatgtatgtttataattgttatatcctgttgttgaattgatccctttatcatattatgaccttctttgtctctttttacagtttttgacttaaagtctattttgtctgatatgagtattgctactcctgctcacttttggattctgattgcatggaatatctttttccatttcttcactttcagtctgtctttaacggtgaggtaagcctcttttaggcagcatgtagctgagttttttttccagtcctgcagctactttatatcttttcattagataatttatttacattcaaggtttttattgataagaacttatttctcccattttgttacttgttttctggttgtcttgtagattctcagttcttctttctctcttgtttacctctgtggtttggtcattttctgtggtcctaagctttgttttccttctatctcttgtttatgtatctgttgtaattgctttctttgtgggtaccatggggctaacataaaaagtcttgtagttataataaactattttaagctgatagcaagttaactttggtcacataaaaatactctagacttttttcctccgccatccctaatttatatttttgttgcctttatttctttagtatgtgttccctagccattgtagctgttgttgtttttgaccagttgtactttaaaccttcatctagaggatcgacaggtttacatagtaacatgatatcactggggaattctgagttggatttatacatttacctctattggtgaggtttatattctcacatgtgttcatgatagttatcattttttcatttacagctgtagcactcctgtaaacattgcttgtaaggctggtgtaggagtgaattccctcagcttttgtttgtctgggaaggcctttattctcctccaggatagttttgctggatatagtatcttttgtccttggccgagactcgtttttttttgttcttttagcatcttgaataaattatccctttctctcctggcatacatcagtaatttaatgttactgatgagaaatctactgatagtctaattaggattcccttacatgtaacttgatgcttttctcttgcagattttagaattctctgtcttcaacttttgacagtttgactataatgtgccacagagagaatctttttgggtttaatctaattgggaatctttgtggttccttcatctggatgtctatatctcccccaatatttgggaagtttttagctattatttcattaaataggttttctgtgcctttcttcaacttttctccatctgccagttctataatgcaaaaatttctttgcttagttttttttaaactttgggttatttcacaaaacctattttcagattttgaaattctttcttctgcttgatctggtctattcttgaagctctcgattgtgtcttttattcactgcattcttcagatttctgtgttttaaatgatagatcttgttttaatttctcattttataactttcctgatttcattgggttgtttgtattctcttgtagcctgctgaatttttttaagatcattatttttaattttgtttcaggcattttataaacacccttttctttggggtctgttactagagactcactgtgttcctttggcagtgtcgtgtgtccttgctttttcatgtttcttgtgacatctgcacatctagtggaatagtcacattttccagttgtatgcagtagctttcacagggagagacttttcctgtagatgggtcctagagtgttggttgggtatggtacattggctttggtttggggtggattcagtaccatggtctctgtgtagtttcgtcagctgtaatcttcacagcaatgtctgatttcctcagtggcctaggctgcaggagtttttgatggtggtatagttttgctagggacaggcatgtcatgctagttgtcaggctggacacttgcaggctcggagggctgacaagctgtcttttgggctccccagggaagagaaagtatgattttccagcttttcttctatgtttatttaaaactttgttgtctggctcacagtgttctttatctaaagtctagccagtggtggtggtcatattgcaatcattattacagcttcagactttctagaccttttccattttagtgaccttcagccttcattcgcttccattcatgaccacagaatagatgtagtcatctctattgaaggcaaacccatcccatctcttcagcttcatctagaaatttgtttcatctgttacactttctttctttggtttttagccttcattctctaccagctctttcacttaagcagagatatgttcaagactctcccattctaacagttccctgccttgatcctacaagcttttctctttagctgctaccttgctttttatttttatttttttctcacttgctctgataatctcctagaaaaattggcttactctgaccatctccattagttcacctcttaattattcttcaaccatctgagacctggctttgttctttctctactgaaactcttcaggcagagattagcagaagtcttctaattgctcaatgaagtggaaattttcagtccttattttctgtatttctccttcatttgactttgacttaactctcttggtttttgtaataccaccagcacctagtttatcagtctctcatgggaacttcattctatctgcctgccaaatggtggagtcccaaggactgtggtctgatctgctgttcctcattacatgctttctggtcagtattgcacactgtggttctcatctaccatcatctacctccagaagtgccatatatttagtaagtttacaagaaaagcaactttccttgctccgtagactaactctgatcttttgttccctatcatggttatggaactcactaattattcagcatcagctgtcagaatgtttaactttgctatttaggtttgtgtaagttatgggacaataactaggataactagaattagcttgtagcttatgtgggttagataatacaattgcatatgtaagtagtgaatattttggcttaataagtgaaggagtatttaggaagctatctggaatgttatctaagtcaggattctgaaggtaactctagcctcactgtcccttactcactatttctaaacacccaccaatcctgcctactttatttacttggtatttctccaatctgccatccttctctgtccgaccaatcactaccctagctcaggccttcaaagtctctcacttgacctactccttcacctcctttgaacctgtgcacaaatgttagcttcttagtaaggctttctctggtcacctgtataaaattcccatctgctacatacttcctggttccctgtattgccttatattcctcagtggcatttatctccttgtatactatataatttctgatctctgtcctttctattaccaccccacttcaagatggcaaggatttgtctgttatattagtgactgtcctaataggaaaaaaaatggcacatttatattagagtaacttgagaagaatttttaaaagtcagtatttataaagctgtagatatagagatagtgaagtactcttgggactagtaatcattgggcaggtgataccatttttaagcccaaaagggcatagtgaaagagcaggtgcctgaacctggattcagagagactatgtagaggaggccactaggcaggagctgtggcctttgcctcagcttggctgattacctcactaatcctcactaatcctaaattacccaagttccttcttttctggcccatttcacagtccaaagccaactttaagccagagggcaaggggagcacttgatgcagtccatgcagtatggcctcccagtgaacagggcaggtggaggatagaaactaaatctagatggaggagagggaagatattcagaatatgttttttctttactgtcagcaccttgaagagtgcctggcatatagataatatttattgaatgaatgaatttgttactggtttactggcctcatgaactttagttttgcctattctattataacttggtgactacattcctatatacttgataccaactcctcattaactacaaaggcagtattcccctctccccctttttaaacatcaaaactcttttttaaaaaaaattcttaaatgaatcgccagtatataacacataaaagtatgggtgccttgattggagtggtgggtaaatgatcctgagtctgtctgtttgggttccctctttgcctagcaggaatgtgactgtcttgtttaaagcccactgaagtagaaaacaggatgagagacacactcttcaacatggcataagatttccatgcttggctcctgcctatctctgcatcctcatttctcagtagtttcctcatattttaccatcctgtaattgaaagaattacaaaactagttctctacacaagctttcttgctgttccagctgctgggaattagcttcctttgtgcttttttttatttgaatgattcatgtttacattcattaaaattaatgaagattcattacagttgttttctctttaggcataattggatctcctatactgagacattgaatgcaactttgattgtttttttcccccattatatgttaagctccttgaggttcttttcaactttgcgttattccaggatttctatcgtaagagttaaggttcatccacttctctgatgtgaggttcatggcaggaaggttccatgttgctcagctgcagagtagaaaatactgagcagggcttaaatagattaggatgctgccattataatataaactgtgtttacgaaagagcatcatcaattcagaaaatatctttttcattgactacagtggtgcctgatgatctttctattacaatcttaaattatggtcattttaattatagaatcatacatgggtttatttatgttaaaataaggtaattatcaagctagctgtgacctatgagaaaaatcctgaagaaatgatgaagggatcaggtgactgtttttgaagtcaagtgtgaaaggtcagaccactctgggtcatgggaccctgccaaggcagagcaggtcaagtgctgtgcccagtggggccaacccccagtatggtgccagggactgggtgtgagaagtcaaaaattaagaatacacctcagaaaggggacatggacagatgccacagacttatttgcgtatttcatgatttagcccttagcttgtgctgatactggatcagatattttcagagttcagtattttcaaaagcatcgctgatcacctgttggcattgttttacatctcaaccaaggaaaaacttttgggacatctgtttaacaaggggtaagcttttatttgaaatgttcgattaaagcagaagagtcaggcatttttttgtgcctccccaaagaaagatttgtttactgtcctgtgtgaataaatataatgtcattatttcccgtaaaggaaaagctgatggggagagtaagtaatgggtaagattaggcaatgttaagctcatatattagtatgtttaagagtgatcaatttagggatctctgtgacagagatgccaaatgctcacagtgctatctcatgttggaaacatgtgtctcctccacttttcctcagtcctctgaaatgacggccctttagggattgacagatactatacagatttctgtgctgatatgtgatttgtctaaaacaaaagtttcacaaaacaattcttaccattgccatttaagagtcactctgatatgctctgtttccattgcaaacaaatgctcattatgatttgtgaaattaacttcacaatttcctaatggataacaccttgaagtatgaaaagcactacaggatcttttatagcttccctcctccagctctctataatctgctcccatctgtggtgtaggaaagatttcagcagtggccgctgaaggccctaagatcttgtctcaacagatagcaaggtgcataacagactttggacaggttgtttaacatgtctgagttactgtttattcactggcaaaatgaagggcttatattatattgtctctaagtactatcagttctgaccacctatgaactttcattttaaagaaaatacctatttctatggcctttaggcattagggaattttgtcaaattaaataaatctcagtaaggtttgatggtcaatggggcccactgtctggtgtgtgtggaggggtgttgtattttacatcaggaacttcagagccctcatgaatttctaattagaggaaccacctgggaaatataagtcaaagccctttgctcgccttactcagctttagggcacagtgactagaggtgggcaatcgctttggtgtaggtattgtcattggaaaggaagaaaccattttctggaggaaaagaattggttgaggctagctttaagcagctatttcatgatggacaaaaggactagctcatccattcttcattcgtttctctgtatcctctatcaaatttctgagtaaagattttatacaatgcttgattagcattcaaatagtatgtttcaaagattttaaaaaaaataaaactaggcctttgaatcataattatggcttataactctatttttcatatacttactatctcaagttacaaatttcatgttatgtttttttcaaaagagtattcctgccacaactcagagctcagctgaattagagcagtgactagaaaatctgagaaggctgagcttcaaaataaggtctggaaagtgtttcttattgttacaagagagtcaaaatgattttcttgagctttaagtttatgtaagtatttacttgacacttagcagtttaaaagataatgtgcaaaaatatgaaaatgagaaaaaacaatttcaaaacaagagttggtgattacgtgagacttagtagagcaaagtatattctaagtattaatctgtctaagctgtttgggaacagatgtacgtgaaatggataccgggtgttctgttgtgtacaccccaagtgagacatctgttggtagactgtgtggtcagaaataatggaagcaggggttaaaccccaatatgacctattactcatgtgaattattgaaggactaattactcagtaaaacatgatgctttgattcatcagtctacacgttaagaaaaaagcctctttagaaaaaaatttagttctgtttctaagctgtcaaatttgaggaaatttttaagatgtatgcaaagactcaaatttccatagtaactgcaaatactatctgcttataaagttttaaaatgttttgacaggtctactaatttatcataaaaatagcctcaaaagttttagctttttgttagggtaggttgggtctcacagaaaacaaatgtagagtgaattttctaaagcagggctgtccagttagacttcctgaaatgatgggagtgcactatatctgaagtgttcaatacagttaccaccagctacatgtggctattgaacagaaacatggctagtgtgactgagaaactgaatttttaattatatttaatttttattaatttgaattcaataactgcatgtagcaagtggcaactgcattgtacaacacagctctgacacatggagagttgaaaatgtttgtttactttcttcccaagttttcattttagtctttgtttctacatagaaaggaagatatagcttttgaaaaatgaacctgaatgtagaactgatatggttatgcaatttgagctgcctatttaaagataaagcaactgagtttagagatttcaaagtggcagagtcctttaacatatttcgtgggctggccacggtagctcatacctgtaatcctagtactttgggaggctgagatgggaggattgcttgagcccaggagttcgaggccagcctgggcaacatagcaagaccccatctcagggaaaaaaatatgtgtatatatatgtatatatatatatatatatatatatatatatatatatatatatgcatacacatatatacatatatacacacatatattaacatattttgtgtgtacaaaaaatatttttattatgtgtagattagttggttactagtaaagttgaagtcttgtctatagaaatcattgtatttttcatggtcattgtgatacattgtttgaactgaaatttggcaaattcaatctgtttcttactacaagaatagtacatagatttgaaatggtaactctcttagtctgtgtactctgaccctgtgaacgtctggagactaatgttattcctaaatatgctatgtccacatggcagcatctgaaggcaaacactttttaaaactgatctacttttgtggacccttcctctctctctttcctgcatcccggatggggccctctggggctggaactggcacagaactattcccctaggagtgggttcattgaagccaagggacacacaaattgagaatcagatagactggaccaaggtcattaaaccagagagggcaatccagatggggttgtccaaagtaggaagttctgaagtgaattgcagaaatccaaacatggcaaagctaaaggaatagagaaccagggcaatggatatagagaacagagcaattgggtatgcaggaagatgctattgcctagactggatgtttttgtaccctctgtaatttgagaaaatggaccgtccttgttgaaatggtcagggatgtagtagataaattcattgcagttgtgtaatctcagcactagaatactgatcataaccatatcacttgttatcccacctagcctgccacttgattgggttattagattacatttcagacattgacaagtctacaagcatcattaaaatcctaaacacagacttctgaccgtattcctacccaagttttagaagcactatgccaatgacgggggtagtatatgctgagcaggtgagttttgattgtgtgtgtctacatgtgtacgtgggtgtggtgagcaacaggaaggaactctcagccatgactctaaatgctcttgtgttggccaaaattggtataagctaggaggagaaacacaaaggagagagaggcatgaagttgaaggacattaaaccatttgcaaacttttggcatgcaaaccagaatatgaggaaacttagtgtaatgggtgactgaattcagaggtagacaggcaatcaggaaggtataggcaccaaaaatagttaccattggtgagcgtttttgtttttgtcattggcatggtgttatgaacttatgttaagcctaagggtaagtctaaaataatgtaccagctggcatcagggaattcccatgtacattcctagattttcattagaaacagtgttctggaaactaccactgctgctacacagcagtgcccagtgcttgactgaaaatagtgaacacttagatttgtttactctgccaggttctgtgctaagtatcttatcttgtttaaccttagcaaagaaactatgtagtctagatagaatttttatccctagggcccagaggtgttaaataacttgcccaaggtcataccagtaatttcagttgctggggttcaaagctaggcagtctgactccagagcctgcactgtccccatttggttatgttgcttccccagttaagcaagcaagagtctatctgacatctgagttggtggtagtaaagcatcatggtctgaaccaaaataataaaaacctttgaaacaacattatctgacttctttcaggcttttaagacagttccatcatcaacagcttattccatttctctggccacttccagtttctgaacaaatgaagaaaatgggagtgataaattggagtttttaacaagtttttttaaatctaattttttttatggaaaccaccaaacatacccaaatgtaggaataattatgtaataagtcctcatgttcaaccctaagaggggtgaagctctatgtgacccattactgagtttaaacagttttcaatttatggccagtcttatttcatctatactctacccacatcccttcttcccctggaatgattgaagtaattcctaggcatcatataatttcatctgtaagcatctcagcatgtatctctaggagataaagattttctaaaaaatcatattactactcttcaaatttaaaataatctttatagttttacatatccagttagtgtccagattttcctgatattttctctattttttaaatatgtcaaccttgaaatgaggtccatattatagctgatggctatgccttttaaattttctcatccacagattcttcttccttttttttcctttcaatttatgttttgaacaaactagtttggcctatagtttctcatgggcaagaataaccttcagactgggatggccatcactctgatacccgtaaaggggatgaggcaggttggggaagggagagcctcagaccatgatcagatgtcacaagatttttgcttacctagggtgaggacttgggaaaaagattgcccattaggagtcctgccttgggcaaaagtggccaaacttcagctgtgctgtcacaggctgtgggctgccttggaaatgtaggacctcaactcctctgaagttgaggtggagcttgagggtacgaatccctggtggccattataatgactacactcattgggatggcatggcaagttcatcctcaaagatggatcctagcatccaccatgaccaatgaggtttttttattgttatgatcactataaactcaaggatttaaacctattaaatgtttttcaattcacagcaatgattatttttactgatcttcaaattgtcacattttggatttttagaccaatgggagccccttcatcttgacttctgagttcttttgacattcactcagctgtctgatagcttccctgctttctggaatggcaagatattccaggttcatcttgaacatttcatgcttgagatatggaatcaagctcatcatcagagggtcctggttccttttactggatagtggtattagagacctcaatttgagaactaagcaacatcattgctaaaacttcccctatgtgtaccttgttacttaggtttttcaaagaacagagctagaaaatatgttgggtttttttgttttgtttttaaagaaaaaatgtatcataggattatgctgatacttccaattcaagtgcaggcctaagcttttcacattgtctcttttctcctacccttaaagtcctgattcctaactataacaacatcattactcatttgctttatcctgcattatgtagacacaatagagtaacaacaccaatgctgccaatcaaaagtataattactgaaacccacttaagatagtcctgcaatttttttttttgttcatagagtgtacactactagggaggtgtagtcaaattactatgttttaaagacacttggaataattcatatctgtgaagttatacccccaacttatttgttttttgtattattgtttcattttgcttttgatgtttaggcatttcttttttaaaaatcaattttataattacgtgaaatacttatatggttccaaaatcaaatctactaaacaaactatattctaggaagtatagcttttatgtttcccttctatgcttttccttccttcctgtaggtaggaaagcttatttgttcctcaaagctctgggttgttcttttattttatataaataaacatgtgcatatattcttttcattacccccacagtacccaccgtcttaaacacatgtacaatatatgtgtttttctaccttgatttctttcttacttagcaatatgcccagaagttcactctgtagcgctttacatcagcatcaaaatccattatgtactatcgtttattgacctctctgttggagaaatttggattgtttctagtcatttttgttatcgcaaatagtggtttaataaaaaactttactttccgttttttgtttttcaatgtgcttttaggatagatgcctagaagtgagattgttgagtcaaagaataaatgtgttaataattttgctcaatattaccaaattctttcaaaagggttgtgcaattttgctttttaaaatcattattgtataagggcatgtatttcctgaaaatttctccagaagagtttattgccaaactttaaaaaaacagcctgatacataataaatgatatctcagcatagtttaaatttgcatttttcttgttaaatcattcatgtttttactgtagtcctcctaacatttagggagcaccaattatggggtctctagaaggttccaggattctgtaatcaatttgacatgatttctgtcttcagatattcacaatcttcaggaagatatattgacaaaagaataactacatgatctattttgtgtgcaacttagtacttacagagcattataaatgcacatggaaaaataggtaaaggagaaaatcattctctgttgggcgggctgagggggaagtcaggaaaagctacagagaggttcgagggtaaactttaatgtgggccttgaagtatgatttggagttagcaagacagacaaaggagcaaggaaaccattctagaaaaagaaaattttgaaaaatctccagaaaaggatgctttggcctatttggaaaataacattgtcttatttatgggggagatgacagtgctttgtttttagtcagtagtttatacaggactttgaatagcatgcaaggaagttggcgtctcaacctgaaaattgaggaaggtgtgacaaaggctgggcattaggtgagatcaagtatttctgtttttttttttggtaaattaggtagcaggatagattataaatgggctccacactgaggagcccagtgtgatggctgatccagcagatcagggggcagtggctgcaaagctgggagaatggcaaggtaagcctggatgcaagggatattgtcaaagacaaaatttgggggatgtgaggcttaaaagggaaataaataatggtgatggtgagatttctagcttgggcagtgggatagatagtagacgctgcgcaaattcgtttttaaatcagcagaatgagaagcatcttatttgaaatatattctaccaaatcttagcatcaaatgtgctagtgactagcaaaatatgtaaacagaagggaagtagcttgaaaagtacacaaactggagaaattgctcctgaaggactgtaagttgaacccttttaagcctaagatctgtatttcctatgagccctaggctctttccttgtgtatcctgtttcttattagagtagaggctacttaaaaataatcatagtttaaagcgctctattttcagaaaacattattcattagatgttagtaaataatgtaatctttatacattcataatatttctgcattattggagtgtaaaaagtcagtgaaatagtcatttgtaaagatgtcagtttttatctgtggaaaatagctgttcataccattttaagcttaaaagttcttcatttacttcttaaaatatccatgttggtattattttgtctaatacaagtaattaatatttaccccaaattaagcttttaagtttactaaatgttacaaacataattcaaagcactgtttagtgtccatctgtgcaggaaaaataagatcaatacaattgagcagctgttagcatgtattggtttccttatattttaagtatgttttcatgttttgaaggtgtaaagggatgacagtatgttttgttgtggttttcatcatacagataaaaacttattacagttgaaatcttggtgaacataatacattttaaaatttccattcctcacccatttatctagatatttagacacagtaaaataaataacatggatacatttttgtcatgtgatttatgttttttaaaaagtagaaataaatttctctaaaagttatttttattttttaaatttagcatttttcatatttgaggaaaaaacaatatgtcttggtaccctagcttctgaactaataacacacctgtcattttacaggttattttaatgtttttcattgggatcaaacctactctggaaatatctcatgggtgagctttatttttatgaaatgttcttggcacttgaagacctttgtaggtacatgccagactcatcttacatccagttcttctgcatggaaaatatgtgcattgaaattctaagtgccttttcaaatttgaccttcttagagaataatatgagtcccaacaattaggaaaactatggaatgccttttggcctttacttttcaaagattttcagtcagtaatgtttaattagcattcattgtgtacattgtccttttttgtgtgatatggctagttccaaaggaatattctagaagatctcagccttctgctattgaaggtgataatacactactaagttatgtgttgctttacattaaaataatgttgcagcagttacttattgcttaactagcgggtataggacatcaggttgaaataactgattttgaagtgaagagttcttgtttatatcttaaactaaccaagtatgttcattaactttgagaataacaatgatctttttcattattcttgagtagactggataaatcagaaaacccatgttagaggtccctgtaaaaacttcagtcttatttggtaagtccctttataagagtttcaataaaatcaggtaaatttaaactctgaaaattctacgtactgtctatcatgttcaatttactgttaaccagtactatgcactggaaaaaatttttttcaccttaatgagaccactggtcattactgctgctactgatgctcttttgtctgcacatactgttgcaacataatgtgttgtgcatttgatacggatattatcatattgccataaggagctgctattattttagacaccaactgattccatgatagtgtcagatttctttaacatatgcttatgtttttgtacaaatgaccccaagaaacatctgctagttttgtggtggtatctactgtttcttttttagaatttgacctgtcagtcactttttaacgtgaatctacaatatttgagttgtattcctttctcgtttttatgctattgatattaacaaaattgagtcagttttatggcataattcagagagaaaccgaagctgtctatggatgttattttaaaaatacctttttcatgatgattgtgcctttaaatttttgtcattgattgacactttaaaattgaaaagtgcccttttaatggatcctttaggttccaaaatcttaagttgaaaatttctgtctattggtcctgaaagtactctctgaatttgataagtatgtagtagttgtggtgtatccttggtcagtttatatcctgtgctaattgctaatcttacttagtttctttgatgcgtgtgtgaagacaggcaaagaaaaaggaagtggaatttctacaaaactgtgaaatctttactttatggagactagagaaatttctaagtaaaagaagacactcattctattgtagttaggatcccttcttttacttgcttttcatgatcttgactgaaaagcaacaattgagatttccattgcccgacgctttctcttctgcttttctttttgtttctcttgcatttttaaagacagctatttattcaaaaacaatatgaacttttatttattggacttaaacctggaacatcaacaaaacaaagaacaaacaaaactacctttccaaatttattttattagaggatgctatcaatacaattttgtattatgttcacacttgataccaaacctaaacccaagaaagtgtgtcctgtgttacagcctatccctctgtttaagataataactagaacaatttacttttattttctactcatctgctttctgtgtatcagctgttgtcctccctcagcctcgaagcatgtcatcatttccatctccgtgctcattcagtcatccttgctgctcttagtcccctttttgtcccttgggtgacttatgtcattaggacaaccttctgtccccacttggctgaaactgagctgaggcccttgccagttgcattaggtgtggcacctttcatggctcagtttgggcctctgtgatatctgtgtgccttctactccaaactccattctgccagaggtggcagggtgactggaagctttagtttcagtgacaaaacccaagcgtggctatgctgagtgtctaagtagctttcatttaggcctgaaataggagagtcaggcgcctctgtgtcccctgagaaagagagatttccctcagctctctgggcccagcactcaaccatttaagtcagctggttagtataatttccctaaattgtggtttagtttccctatgagtaggactggagtaggaccaagtaaggaaagtccctagtgacctttctgcctcctgaggagcaggccatttactttgagttgtagcttcccatctgtctgtccccactaccctatccaaggccctggaggagccacaggatgagggaggagattcatggaaaagcgccttcaggtactgggtatgtctggagtaacatttaaagtttaaaagactctttaacaattttcctctgatacttactactgcctatacttgtttggttttagtacagtaagttttgcctatcgtgggggtgaagaaaatagaaatattcccattaactttgtatggtgcttggtatgacaccctgaacaggtgcacccgtaattgtttacttgatgttctttttaataagtcaattatatcatcggaaattgaagaatagcaaagttaatttgtttaatcattctatgggaactcttgcatgctcgttcactagaggaacattgcgtttctcccttaaaggacaaggctttgttttgtttttaataagacacactctttataattaaaacaaaatcccagtgttaagggatttctgttttaaataattggatttctttcctttgttcctctaatccctctatatgagaaaaaaatctaatggtgtcttaggataaatatttttagattaaaaagttctcttaaccactgaaatttaataatacttctcaaagtttatggatgatatagaatgtaatgtaaggttgagaattttagatttggcaaaggcaaagatacaaaaactagtgaaaaacaacaaactggaaacacttttaaaatactgatgtatttatctttgcaataaattattcagaaatataaataaactcactatttacatagttttatttaaatttgtcctcaaaatactaaatttagtactatatattttcttctttcagataaatgctttcctgaaaatggtattttaatatctacagatggtttagtttaacaatggttggggtaaaaatgacatagggaaaagcaaaatgtgacagcccagcttggttacctttagagaaactcagaataaactctattcccatttccttctctttcccctttccatactcgagagcccttttctgagactcttaagtcatgtttgggccttggagaggataaatagcagggtgggtggtaaaaggggagagtgctttgcttgaggcaaagttttcctccatatgggaccttcctcaagccctcccttcaaaccctttaaatgagagcatgagctcctaggacagaggtcatgtggaaagcagcattagcatgaaggggggtgctgtggaggggtgtaaggtgcaaaaagcagcattagcatgggggaaggtggggtggaggggtgtaaagggaatgagatgtgaagtggttaaagggccatttttctagttggcctctgggctttgatgaaccttttccagtgtgcctgtttctccacttagccctgggctaatcttgactcttaactttccaggtgtgtatctatgctgatttctcctgggtttggaagctctgagaagctctggttctagttcaatcacaagacttttaaagaaccagaaaaataaaacaattttttaaaaagtaatgaagaaaagacttttaaagaaccagtgaaaacctgggagtaaaaatatagaagacttgagaaatttcatctttacctttcaagtgggcagcatgagaaattcttgtaaatggtgctttcaaatcttacacaaggttctcagttacctttatttgtactccctagactgtattgcatcccttgctatgttgactaattcccacctaaaataattcaatggcctcccaatataatctggcattctaattaataagctaagaaattatttggtttttcactcattggcgttaaatattcttcagtgcccacatttggaaatattggaacacagaaatgaaaaaagatacaatcagtttctctgcttgccatgttttccttgatatggcaatacgacaacaggtcaccctttgaagaaaattcagagatgctaaagtagaaattaaaactgaagataagtcaaggcaggatagtataggagtctgctacagctgccatagcaaaatactacagcctgggaggcttgaacagaaatttatcttctcacagttcttgaggctagaagtccaaaatcaaggtgccattggggttggtttctgaagagggttctcttcctggctttcaggtggccaccttcatacagcatcctcacgtggccttttctttttgcctgcatggatagagatctctggtgtcttccttgtaagaacaccagtcctattggattaggaccctatgctatgacctcatttaacctaattaccctatttaaggccctgtctctaaatacagtcacactgggggttagggcttaaacatattttaggggaacacaagtcagtccataacacgtgatttgctatagttttcctttacctaaatcttttccaaccttgagagtggattttggccaggtgtggtggctcacacctgtaatcccagcactttgggaggccagggaaggtagattgcttaagcccagaagttcaagatcagcctgggaaacatggcaaaaccccgactctgggggggcagggggagtgggggaattagctgggcttggtggcgttcacctctagtcccacctactcaagagggtgaggctgaggctggaggattgctacagcccaggaggcagaggtcacagtgagcagagatcacaccacttcacttcagccctgggttacagagtgagaacttgtctcaaagaaaaaaaaaagtgggttttattcttccccttaaattcctattaatagtgaggtgaggcttcttgtgttttttttttttttttccaagacaatggttaatgtgtgattacttaaaaatgatatataacactaagaaataaagaattgttaagtgagaaggaacatattaaaatggcttggaaagatgggtaattttttacattttaagtaggttttctcaactctaactctgtggaacttggtcaatctaatcagtctaaatatagcacaaataataatagttatatggacaggagaaatagtagccctcaaagatagtgaaatacatctgaatatcactaacaatgtcatgaatttgcttgttctaaagttttctgaaagtatgaattcataactgagtttttttttttttgcctatgactactaatgtttgaggagagagtagtgtcagaaccacccccccatttattacatgtttatttcatattttggtactgaaatcagtgtttattttgtgtcttcctgataaatcttgccaataagtaattaccttccatactgaaaagttcttaggattaccaggttgctgggggcaaccttaaaaggccatgcagaacattgacttaggtggctattaccctgctttattcaggtctgagcatttactttcctactacaatcagaatactgacctacatttaaaagtgcaacactgccctgttatctaaatccactgtgttcctgagaggaaataccagaaaagagggcaccaatattatttttctgctgttcttgatcataagtgattacctttttttttggttaggcattctgcttctgaaagataactgaggttgaagttaatagaactaagattcttatataaaatcataggaaagataattttcaggattattgaatcatattgaaaaatgatataattgtgttaaaagataaggactaaaatgagttaattcaatttggaaatagttaaattagaatttgcttctgtttttgatgaatactgctttttgaaaaatcttctgagtatttaagcttttactactctagtcattctctctaaagtagacatagaagcgtgttcttatcttgatttggtaaggctctgaaaatgcaaagcaacagatgttgtacccagcataattatatgtatcctggaaacacatctttattgagtgggatttgttcttggggaaacaaaaatttggcaaacaaaggacattaacttgctgatctcagcagtaattacttgggttagattataataatcttgtgtaggtggtaactgcatgcatatattacaaaatctaattctaaaatacgtacattaaaaggaaaatgaacttgcgcaaactttagatcatgtatccccttgaagagcagaaaagatctcaatttcattatttgaaagttgtttgaacagctttttggaagaggtttccaggattccaaatcctaatatgtgtattgatactgaggctttggactaatctttgggggttactgccttttttatgcccactgaaaatagagcatttcaaacaaatgaactgatctctgatctttaagcatgccagtaactctttggaacaaatccatagttatttttaccaatgactgtattaaaacagtactttctgtattatctcttccattccaaggccattttaaaacaccctctttctcttctcccaataggtaaagtacgacagagctccttaggactgggttatggagaattatctggaggtcaatttgagaaccactgtgcaaaccatttcttaaataagtagctacaaggttgtccttacaaaaatttctgaagttgatggtgttgcgttttggagtctgaagcttaaataagagtttgtcagtggtcatggtctaaatagctgattactaccaaggtcatctaatttttttttaacacaaaaaaatgttctgagcacaaatgaaaccttcaggacaagacatttatgttttgagaatgttcttaaatgattcctgtcgtgtatcttattttacatatcttaatgatcagcatgtattttttgttgttgatgatgattttataaatgtgctatcacctagtttctaattcctaacagctccttcatcagtagaatattgctgtagcacagttttgccatctgttaagaaaagatggtgactaataagagtggcacatttcagggctggtgtgctatcgcaacatctagtgttttagtactgaggacagtgatgtatgcagtgttccttacagccatggggtgtgggaatgttttcctcttcggcaaagtctgtgtatttctatagctgaactctcaggatccagaggaaaaccacaagatgatgaaaccagatgattgtcatcaaatttctattccccactacatgattattagttttcgtcaaaagaaatactcatcctatcctgggttggaattggtaaagaattttgcattgtgactaggacacctaaaagtttttaggatgagtacaaatggaatttgatagatttccccaaaatgtttgggaaaagatttattcctccctaggaacagcaagagtagcagcatcacatgaggcaactcctggtaattttttcttcttgctcttatttcaatgatatcttttcattcttttctgtatctctcaatttctatgtttctcctcttaatgtatcctgtaaatttcttagtagaacctttttactaatgagggtttcctagtttgctttaggaggcactcaggatgcccccttttgtaaggcagtaaattgaaaataagaacttggtgaaggtccacgtgacggttagtttccattctccattgtaccaaactgctacagggaaagaaccatatttaatcaacctcaaatcctcaatatttaggtcagaaaacacttggcatagaagagacactcaaattttgcagctaaatagattattgatagaaaatatgtttcttgcctctacaagcaatatgaaaccaatacaatctctaaatatcttcagactactaggggcaaatactgtattataagaataattcttcagaaaggaaaatccagctactctcatatcacctctctatgttgaaagctagggaagataaactggcttccagccagtgagagtccatgtggacctagtgctggctggagatccctaatccaaaggcaagagccagatactggttgtctgctgaaaatcagaagatgacctctctggtagtaaggccagtgactcatccctgcatcttttatcctcttctgatttgtataaggatctctcctttttccccagtacccactctcaagaattgctttcctttttaacatgatcataccaaaatgtatctaacagtaccttgatttcctttctgaggaatttagggagcatatttactttgtcagactcattagaggtttggcttcttggtcgggttcttaaatggacaacttgtttgggtgatttggcagagaataggagaagccagtcccctctgatagagcaaacctggggagctgtggttgacccacctgctaactgtcctgtacaattaggcatgtggcatcagtgggtgactgaccagagccaccatctcaatggcggctgttctttccttcctgtgccttctcagatctcttttttgttcttgttactccactatattggtttttcttgagtttttttcaagcaaatatcattattcacttctactgcagttcctctgttgttcgctttttctcttagtcttcattgttttccattttgaacattcagagatccatcaaaaaaagtaaaataacaggaagggagaggtaaacaccagtcaaatgaagtattataatagtgtattactatactctttaaagtaattgaagggtggttttttggggtcagaatatctgttagaatttggaatttgccactcttgagactggggcaagctatttaaactctaagcttatctgtccttcctcacaatctgtaaaatgggatcataataatggcacccagtttatggtgtagtgagcattcactgacacaattaatctaaacttatttgcactacatagaacagaatttttgtctattaaacaatatagcgttttaggcatgaaagaaactttagattaaattaaatatcatttttcttaccacagggtaagtttctgttttgtttgcccctgtttctctaactcctagaatagtttccagcacatagagattaaacaaatattcgttgaatgaatgaatgcatctattctaatcctcttgttttaggaatgacccgtcaggctcaaaagtgaaagcatttccctcaagattggtgacagagttggggactaaatctaaggctttctcttcctacaccagtgtcctttctgagaacacgatgccattttctcaatatttgtttatttatatggtaaattggtaggaagctgtgtggtactataagaggataaactttgataatgaggtatacttgctatcaaattctaacattctcatttaaaacatggcataccatttgtcttctacattttcatatgtaaagtgaggtgatttctaccttatagaactattgtgaggattaactgaactaatctttgtagagcacctggtcccatttattttttttttttgctcaccccaccccccaactttctagctagataacttatacattcactctgtttttcattccttcttgaatctcctgtggccagacttgacccctgtcactctacagcttactcgtcaaggtcagtcctcatctgacttgacctactaagagtctgacaagtagtcacactatgctccttgatacagctttcttcacctaccttcttggatgtcattcttttggttctcctcctaccccattgggctgctttttcccagtctccattcttgggtattctcattttcccatgtctgtcctctgacttcttattgtctctgtttctgttttctctggttggaccttctctagtttctggcttcaaatactatctaaatgctcatgtctttcaaatttgtaactctagtctagacctctcctctgaattccagttttataaatcttctacttaaatattagaggtctaataaacttctcaaacttatgttctacaacaaactccacattttctcctgcagcctctaaatatgtacctcctatagattttcccatttcagtaagtgggaacttcattattctgattgtccaaaccaaaaacacttggagacttgctacattccaccctttgtctttcattctacatccaacctatcaacaaatcctgttgcctcttccttggaaatatatccacgcttgagcagcatcattgtcaccacttggtgttatacactctcatttctcacctggagtattgtatttctcatctggagtagtgtctgtccaacgatgtcccccatcagtctgttctccatgtagcaatttcgtttttgtttgttttaagattgggtcttactttcgccttggctggaatgcactggtgatcatagctcgctgtagcctttaattcctgggctcaagtgatcctcctgccttagcttctccagtagctaggactacaggcacacaaccacacttgactaatttttttttttttttaacttttactagagatggggtctccctttgctgcccagtctagtcttgaactcctggcctgaagtaatccttctgtgccagcctcccaaagtgttgggattataggcatgagccaccatgtctggcccagatgttaattttaaagtgtacattagagcacatcgttcttctgcatgttcagcataaaatccaatgtccttaatgtagtctatattaccctacatgggctacttgtgcctgatccctctactcttatgtcttatccctctcctgctttctcactagcaccagccacatcttaccgttccttgaacacaccaagtatgcatttgccacaggaccttgatgcttactgttccctttgcccagaaacccttggaaccagctatgtgttaaaattcagatatttactgattttagagagctaaaatggggtatatataatatattacataacactcacagctggtttgtggtagcatttcataattaaataatatttctgaatgaaacattaagaatgcccatgctaagagggatgagtaaagactcaactctcattgtcagttcagctgcagaatgaggtcagctcaagatttgctgccaaatgacttaagaaaaaaatgtttttggagctttggggatttcagaattgcagatgagagattctagacccgtacctacacagcatgctcccttattttgttccaatctttgttcaacgattatttattgggtagtcaaggaagatctctgtctaaaaggcttctctgtgtggaacaagactggcatgtggaaggtttccaattaacgatattgaaagagtgaagctcaaatcatttttcactcaaatacatactatttagaagacagtggccagtttaagaataatcattattggaaacaaagtactatttgattagggatagttaacacaaacacttattagtattagggatatgtgaaatacttaatggatgagtcatgtgctgacataaaacccattatccattttagttcctggtagcctaactggttgaactctgttttattgatctattattgatttggcctgtaacttcaagttacattttaatgtaatttcatccttttctgatcaccttgtgtcttcaagcatttttaagcagttgatagatagttgaaagatattatcactatttcaatctaaaagatattatcactattttaatctacttaaaatttttactacattcattttaagtatgacttatggaacgaatcgaaaatacaagatagtgaaaaacttgtgaggatcacctgaaattttagcattcactttccttacatagaggaacttagtctctctaaagaattatgagtaataaagtatcataatgatatttgtcttagttttggttaagtgtactccacaggagaaagttaggcatgagcaggaattattgtagtcccacattctcaaacagttctccagtaagaaagattttatgtgtttccagaaatcattttcctcctcttcagagctttgggaccataattgtatttaaattgctaatctgttttaaggaatcataataaattgtttaacatttatattcaatcaactttgtaatttgtataaatttttcagggtgacatttgaacaatttttaagaaaatgggaaatacagaagtattcttagttttaatatattttaaaaagatgacatgtgatctactgactgaaatccttcaatcatttttgtttttctccccaagattagatagaatggatgtgattttatttttaatttgcattatggagagtacttttggggggttttatgaaaaagacttcatttattttgttagtggtacttcagttgcataagaaaatgttcttttaaatatagtggtcatttgtgtgcagccttcaagttagcaaacatgcctttgagtagtcactatttttgaaggtctttatatctgattgcaatggcttatattcaatagtcctcctactaaatgaaataaaaatggatgcctcttctgccacagaggcacaggtggacatgttggtagcaagccccatgcggtgtgacacatggcacagcccaacatgggggcaaagagcatgcggcttgagctaggagtcactttatggctactttagtgtagatttgtgtttttctgtggaacagccattattgaagacatttatatagtatgatgtttgtttttcattaaatgctgattgtgatttcttaaaaatagttaagacttgattagcagaacctatttagaagccagagttcccctgcttcacctcttgctatctatataaatgatatttttgactctgtcctttataatgttggcaccctgtgcatattagatgtaatcagggctgaaaggaaacttgaatccatctggaagcaataaacttttctaaaagactgcacagtgttatttaatcctgtgacttcttactgtgagtgaaattaaggtttgatgcagttgtgtcacatcgtattgatatcaaatttatctttctaaaaaaaaactgacagtattacagcacagaggagaagatggcttgctgtaatcctgtaagctattttacattgattacatgctacataatgtacctaagtatataaaatacttgatctagaatgtttatgttttctccaaaattttctcatcaggtaatactttctcaacttcacctttagttttggcttcttatcatagtactaactatgcggtagtaattgtgttatgatgaaaggcatggagaagaaattataattttaaaactattataaagtggagacacacttgtataattaccatctatgtagactgccaaggtataaacatttagcttattttagtatcagactctttgaatcaatttaaggctttttcaataaaattggcttcctctaatttctactccaaaatggttaaaattttgttttacttcaaatacgttgtagggtatcatatttcatgtgactaggagcctaaactatatcagctgactggcataatttgtgaattatatgtgtgtttattaaaatttaaagtttttattaagacttacaattttattaagacttaatttttttccttacattttgagtaagtccaactgaaaataacttagagacttaggaaatttgactacattttataagtaatttccttgtaatttttctttcttgtggaaacaattcttactgatttacttaactcttttttcaatggcaaaaatgaaaaccaaatatatttgtcaactatattcttttaattgtggaaatgaaaggttcatatcccccatttgcctagcatattaaaaataaacatgacctttgtcttgaatgttgttaacttggattttaaaaatcaaaccaattataagctatattaaaattgcttatcaccttccctttgtcttcagtaagtctgggcctaaaaatactcatcatatgaataaataaagttttacaaatactttttagaacatcttgaattatatgtgtgtttgaagcttacttttggatgttcggtcaacaaggcttctgacagtttctttttatcttccctctattccctgccactgtgcaccccaaagtgatccctgaccacagtggtcccattgctggcatcaggaaggtagactgaggagttcaggtatcctagaggctgttaggtgaatctcttctacctctttcctggtcctaggaccactggacacttcaagtaaaaataacaattactttaatctctcaggtaaagtttcttctcccttccagcaacacagatctgcctgtgccgagttcaaatactctgaactttcaacagttgttctgaatacttttttgtcatcttatgatcaaatattgagagcattgaggggataactgaatgggcatggtataaaagtcagacttttagtgtttctaagtagcagaaccctttggacaatttagagggctgtgcgatatcctcaccgtgactgctgggaagtaatgggatctgacctgcagaggtactaccttggctgacaataatgacaaaagtgagagcaaagtacatatgactatccttgaggtcctcaggaaaaaaagagtattagtgagttgaactgtatgtaagggtctttaccaataaggaagcccatgcccagacataatccttacaccctggcaatagaaaccatcattgtggtttacatctcatcctgttcctacagtccagcaagttcaggccacaaaaggtttaagcactttttcctttgttctcatagcaacagttgcccatggaggttcagttacactaatattaacattttaatatacacaaagaagtgcctcgaatgtagtaggtattcaaacttgttaaatgaaagaagtaaactttcagacttaccttgaactactacagttttattctttctctaacctctcccactactaccatcttaaaaccaccatttaattagtattttataacaagttattaaaggctttcaaagacctttgaaccttcaccctctggtaagttaataacttctgatatgcgattaaatgtcaactgagtagtagtgggccctaagagctcagagggactgagaaatgaaggttattgtttagaagagtggctcaatgtgcttcgacagttggttaatatttgaaaagactagagtcaagaaagccttccatgtgctaggaaatgaaggagcaaaggtccagaggtggaaatgtatacagtgtgattaagggattttctgattgatagtaaatacagtcaataaaaaacttttattggaagcctagcctgtgtttgaagcattaagctaggtgctgggatacagagattagagatgaagataatgatgaagatattgttgaagtgaattgctgagaagctggagaaagggccaattaccataatctgaggctcaggaggaattggtgcaaagatcatctggtatgatatatatgaactgtatatacaaactgatctgtgtagctgaactgataatgccaaaaaaaaaaagactaggtttttgattaagatgaatccattaaggtcatgttttctgttggtgccattcttggagacctcccccaaccctatacatttataaatgtttttcctgagggactgagatggaagtggacatataaaaggaaaggtctgggcaaatacataagtaggtagtaaaatcaaggaacaaatgatctcaacaaaattgcccttcttgaaatgaatgaaaatgatgaaagccaatcacattgcatgatgaacttggggtatagaatatgaaatatttaaaattgctttatttcatgatgtttcagatgtagtaggaacttgttgcatagatggtgtaaaaacaatctagtaataaaatcttaggtatttaatacaaggtgaagaaagatgcaatgcataaatcatgccattttaggcttaattttcataaggctatgcctgtctttataagactatataccaggagttctcaagctttttggtcttggaacccttttatactcttaaatcgttgaaaaccacaaagaccatttatttaagttataaccattgatatttgttgtattagaaattaaatagacattaaaaatatttactatttaaaaataaccaaaaagatgggcatggtggcccacacctgtaatctcaacactatgcgaggccgaggcgggtggatcacttgaggtcaggagttcgagaccagccaacatggtgaaaccctgtctctactaaaatacaaaaattagccaggtgtggtggtgggcgcctgtaatcccagctactcaggaggctgaggcacgagaatcacttgaacccagggagatggaggttgccgtgagccgagattgcgccactggactctagcctgggcaacagagtgagactctgtctcaaaaaaataaaaaaaataaaaataaaaataacagtaagttcattgcatattaacataaataacatatttgtattaaaaataactattttccaaaacaatcaaaaaagcagtaccactcttctattttaaattttttcaaatctcccttttctaaaaaaaaaaaaaaaatattgtgtaagtttaaggggtacaagtgcaattttgttgcacggatatattgcttagtggtgaagtctgagaatttagtgtatcttcacccaaataacatacgttgcacccattaaataatttttcaacacccacccccttctcactctcttgagtctcctttgtctatcattccacactctgttcctatgtacacattatttagtacccacttaaagtgagaacatgtggtatttgactttctgagttttttcaactctggcttaatagaagacagctgaaatctcagaatgcttcttcatccagtctgttgtgaatatgttgctttgattcaagtatctaaggaaaatacagttttacacagatgtgcagctgaaaaggaaacatcttttaatatgttcagataattgtggatattgtcctttgatactatagcaaaacttatcaagtgctaatttcttaaaggctggttataatttgaaatctgaaaacatatctatttaattgtagtttgctatttgaaaatttattggtctgtcttgtactttgaatggatattttgcccacgtatgattttataacatcctgtattggccttttggaaaatttggtttactattatacagtttctaaatgttgataatttttattataatatattttaaaaagtctaatgtcactgccagtctcatcagaaaattctttgagattagaaagctgttaagatcatcatcacacttacaagttttacaaaattttaattttactcaaaactttatattttatcattgacaaagctctcagttgctttgcttagtgactgactcactttgttcattttccagaaagtgtttaccaaatgctgctgcctcaataccagagtctgtattgtcagttgatctttcaagtaaaaagtggtgttctatgaaaaacagctagttcagctgcgactgaaatgatataagtgtttctcctggagcaaaccaccacttcgatttgtagcagaaatgctgtatgtatactttccattgttattactcataacatttttaaaaatatactcaagggtggagatttttttaaaaataagtgttattgcttcatcaagaacagttaaatgaaactggattttttaaactgagtttgagttaatgaagaatgcagcaattattagtaaaatttggtgctccaccttgattcatactgacactccaggagttttacccactatttcttttgtacctttagtgcaaatgttaatatggtaggaatggtaaatgacatctttagtattattataaaaatcgtttttaccctgtatactctttgagactacacattgagaattgctgatgaaggtgttttaatttatcataagcactgaaaagatttacttaattcaccaatttctcctgaatatttgtttatataaaacaagactatgtgtatacacctacctttttattaatggtagagatctaggaaaattaatttctaagaactagccaggatatttggaatgtgaataaatcatatatccagaaaaaagctttagaagattgtctatgattgaaagtcaaacagctctcatttctattatactgttctttttcaaagaatttaccaattttatgtggtatttatgattaaacatacaccatgtaatttaacatttttaatgtcacttttacatcataggtattaaagattagcatttttattgtctgtattttaaagctcaaagaataacatttaggctgggtgcggtggctcacacctgtaatcccaacactttgggaggccgaggcaggcggatcacgaggtcaggagattgagaccgtcctggctaacacagtgaaacaccgtctctactaaaaatacaaaaattagccgggcatggtggcgagcgcctgtggtcctagctacttgggaggctgaagcaagagaatggtgtgaacctgggaggcggagcttgcagtgagccaagatcgcaccactgcacttcagcctgggtgacagagtgagactctgtcttaaaaaaaaaaaaaaaaaaaaaaaaatttagatttttgactgtttcattgattcatcttagacttcacatgaaaatatctgtatatcctcaaatgcttacattcttaagaagtatctcagccatttacacatgatagaaacaactaaatggaaaaaaattgcagttggaaattcactattttttatttgatccgataacaatgtgacatttgcgattggactgtaattttctgtctttctctctgaaaataagttcaaaaatttccctctaattcttttactagataagaagcctacttcgttgtaactcttgatatatgtatgtatttaggaacttaagcttttctgctaataaatgttatgtcataattcttgaggatagtattatattgtgatgggttttcagtaaactacaggagcagccctatttgtttaaaccctagtttaacctgattattaacaattaaattgtgttttcttctaacaattaaagtgtgtttaaatttattggtcccttgcttcacagatttatctcagtatgtggtgtattcaaacagaattttgtatttttaattaggggattagataaccaattctgaagagccaaaaaaattgttagacatcacattgcttaaccatctaatataccataagtgtgtgtatacactatgttgtgggagccatctatcaggcaggcctgtttttcaggcagtattttaaaaagtggacatgtgcagaaactgtgagcacaattagcgccaagcagataaatccagctctaatcctgtttacggtctacatcagacagatgtgccaagattgatttagacaagcccgaggcttacagtaatatttttaaaagtgccattcgctgttctatttttgttaaacctttgctaaatattcttaagtcttgttggttttgctcttcttattaaccaccgtaagtaacctactttaagcaggtcccgctttgctctcatggtgacaaggtaacctgccaggagaggttatctttattccctgtaattaagttgacttttccccccaaaaaaatacaacaataggaagtgggtgctgaattaaataaatagcatgatacccagtagatgtatacttaagttccttgcaagaacagatggtccccagtatctctgtaagtaatgtgagaggacagttaatgttctgaaacaactagctataaccagtatgatactaatgaaccagtagatttcaaataataaaccacatgccgccaagcaaaattatatgtcattcataaggatttaattatcataacttgcaaaaaagtgtcaatagatgatttctatatttttatctactgatatcaaatatcaatttatgaatagagtttcacttcatattttttaccaataaaggtatgttttaacattaaggtagaattaaagttatatttaaaatacatgccccaaagtatgtggtgatttttttttaactcctcttttactatactgtctgtatgtattgggctgtatatggaaatgtagcttttacatacaattaggaaaacaattgcttttatttctagcagaaacttgtactataacagaagtggctagcatgggaatcagagtagttatcttgtagatgacaactgaagcagacataaaagatgtaatattttttcagcactcaaaaatttataagtaaaattttataaacaaaaagcagtatttttgtgattcatatggaaaataaaatgagtctgagtcattcttaaggtgataccgtaaaggtgtatagataagaagtccatttttaaatatacccaagacaacagttttttctctcagtatggtttgttttcccttttttctctttaattatgtttcccataagtatttgtatattctaagaatgtccaaaaaataaatgttttgcagtgggggttgaaaagaaagaaagacctttttagatttcagctgatcttatcagatgatctctagaaccttgaaccttcaaccttcactgaagttagctggagggcttttcacctggaaacctgagaaacctcagaagccttctgctttagctctctctcaagtctaggaagccagtggcctgcgaccccacagagccagctggtccactcctcatataagaacttcggtaacaatacaaagacatagcaaagcaccatctaatctgataactcattaaacaatatttagatggctcaagactttaaataaaaacattttaagcttgtttatagaatactaacaagttttattcccaaagactatattcagagtgagaaaacaattttccttaaaactaatattatatacatgttcatatatgttaggaactagttatatgcaaaatcaagtgactcttgtgattagaactggtcacatttattcatgtagcataaatggttaatattgccaaaatgagtaatagatcagattttctatgtgagatattgacacctgagagatttacagtgtttcactgttgtgaaaaatggagtgctgaagaacatttgtctattgttatacatttgtaaaagaattcacaaattactaatttcaaataagaactaaatatttcttctaagcctatagtttttctttttaatttcttctaagcctacagtttttctttttaatttcttcttgtaacattggcaaaaagaccattcgtgtgaaaacctcagattttgatctgtacacaaatgcaggagtagagattggaagcttgagctggaaaagcaggaaatactgctcagagccttacaaggattttcagaattttcactgttgggtcctcctggttgctgcagtctaacctcgcatctccttgaaggcagccccagtttctgatgaaatactcttcagttaatttatacatatgctgtcttgctgttttcctaaggactgcaggcagaactgtggttcacctactgttttaaatttggctagatttaaaaacagatgatctcacttatatgtggaatccaaaaaagtcaaacttatagaagcagagagtacaattgcggttgtcaagagctgggggaggggaagcaaggggatgatggttaaaggtataaaatttcagttagacagaatgaataagttctggatctattgtatagcattgtgactatggctaataatgtatacttgaaaattgctaatacctgaaaatcactaagagactacgtcttaaatgttcttacaacacaccaaaaaaaggtgtgaggtaatgaatatgttacttagcttgattttaatcatttcacattgtaaacgtgtatggtactgatcttgtacctcatttcattttccatatgaatcagaaaaatactgctttttctttataatatcttatacagcatagatacaatttttagtggtcaattatattgtaatatatacataaatatatatgattttcattggtcaattatactgtaataaaacagcaaaaaataaagttgtaattaaaaaataatttggaagaaaaaattagcaagtggttggagattgaggaagatgggaccaataagtcctccaaggagagtcatacattagttttttttaaaagtccattattaatcttataatatttaatatgtttaatttcttgacacttattaatccaattaagtatgagaacactgtggataaatctaaaaaccttaaagttgagtaaaataaaccagatacaaagaagcacatactttatggttacatttatatgaagttctagaaaaggcaaaacttagctatagtaaaaaaatcatggtcctgagggaataactagagagtggtatgagggagctttctataatagtgggaaaattctgtatctttattgggatagtggttatgtgagtgcatatacttaaaaaaactcatggaattatgcccttacaaatctgtaatttttgttggtaatttataccttaataaaaaacaaaacagatgacagggttagtgattgtttccttgaagaaggtctttacatgggtctgttgttaacgagttgtagtaaaaatcatccaaaatgcttggattcaaatcttagatctgttcctaccagatgtgtgaccacagacaagttacttacattccgtcttcagtttcttctcttttaggaaaaagcatctagtttttgttgtagagattaaattagataatacaaatgaagtacagagaacagcgtttggtgtgtaacacatgttcattattagctacccttattttttagagaatggaaatttttaaatttaaactaatcaaactattttaggataagcaagtgaaacaatctttttttcaatcgatcacagaaatattttcactgaagacaaattagacatttatataagcaaactacagtgtcattaccattcaaattttcatatgcatattcatgcttacatgcatatgaaagcattacacatatgtattctataaatatatacaaaacagtaatggaaatgtgctgtactattttgaacatctttctagtcagcccggcattttatttacttttgagacagggtctcactctgttgcccaggcttgagtgcagtagtgtgatctcagctcactggaggctggaggtcctgggctaaaggaatcctcctacctcagcctcctgagtagctgggaccacaggaaagcaccaccatgcccagcttatttggtttattttgtttgtttgtttattttttatttttttgtagagatgaggtctcactatgttgcccaggctggtctcaaactcctgggctcaagttatcctcctgcctcagcctcccaaaacactgcaatcacaggcattagccactacactgacctctacattttaatagctgagtagccttctgttatatgaatatacttttttttaacaaaaccaatactccattattgtacatttaggttgtttccaagtttcactcaaataatgcttgggtaagtaagtatttttatttattattattatttttttgagatggagtttcactctgttgcccaggctgaagtgcaatggtgtgatcttggctcactgcaacctccgcctcctgggttcaagcgattctcctgcctccacctcctgagtagctggggttacaggtgcacaccatcatgcctggctcatttttgtatttttagtagagatgggatttcagcatgttggtcaggctggtctcaaactcctgaccctgtgatccgcccacctcagcctcccaaagtgctgggattacaggccgtgagccaccacgtctggcctggataagtattattttagctaaattgtgcatatttattcccttagagtaaattcctggaagtaaattgctggatcaaaaccaggtatattttaaagaattttccttttctacattaaaaataattataattctgattacaagaaaggaaaattatggagcttcataagaaaaaattagtctcatatttcatacctcatattgcatatttaataggtaaccagtgttaaatttgttgtgtgttttccactgggatttctttttatctcctttaataaaagcaggatcagatccctcagattactttgtaacttgcttttattctactttttcatacctcttagcatgaatgtctttccagaccagaatacagagatttcacttactcatttatgagctgcagaagatgactatgatttattcaaccattctcctattgaagagcatgaatattgcttcagatacttttgttattataaatattagtgcaattaacattttaaagtcttttgatacatattcccaacttgttctccagcaattaccatttttgcattcccaccagcactggggctacttccctttagttgcaccatcatttagcattatttttgatcttgtgccaatctaaaaggcaaaaagtggtatcttgttgttttaatttgcatttctttgattactaattagattgaactttttcatttgttcattggtcaatttgcatttcttcttttgtgaaatgcctgcttgggtcttttatgtactttaccattaaagtgtttttcttgattaaatagattatgtaactgtcatatgttgcaaatatttctgtccatttggcctttgcttatgactttttatgagtctttaggacttttgaggtctttattaggtattcaataattttaatgttaaatatattgatgtctgtcttcctttgtgtcttacggcttttctatttaaggttacgtaaatttctaatatacaaatattggtgtatattatgaaatagggccctatttttctttacaaaagattagtcagttctaaatcatcctttgctatttctagcggcgcttagatgccaccattatcacatcagtgaatttttaaatgtgtaattgtttcctgatctattcatttctctattcctagatacttctattgtaatagctttaccaaatatatctgatagggtgtgtactccccctcattacttcatttatttatttatttatttagagacagagtttcagtcacccaggctggagtgcagtggcatgaacttggctcactgcaacctccgcctcctgggttcaagggattctcctgcctcaacctcttgagtagctgggattacaggtgtgtgccactacacctggcaaatttttttttttttttttttttttagtagagacagggtttcaccatggtggccaggctggtctcgaacttctgatctcaggtgatctgcccttctcggcctcccaaagtgctgggattacaggtgtgagccactgtgcctggccccctcattgcttttaaaacattttcttactgtaatatatttattccaagagaattttcaaatattttatgagattccttgtccattccttacatcaaaaaataccacggagattttgattgaagttctattataagtagttacttggggtggggggaggggggagggatagcattgggagatatacctaatgctagatgacgagttagtgggtgcagcacaccagcgtggcacatgtatacatatgtaactcagctgcacaatgtgcacatgtaccctgaaacttaaagtataataataaaagaaaataaagagaatactggcatggaaaatatgtaatcttggaacttgttgtatctccacttattcaatcctttgtctctcagtagattttgaatggctctttatcccacacgagtctagaatcattttgctaagtttattcctagatataatatgctaattgatatgggaattttttttatctccattataccttcttcttgggtgtagacatatttgtagccagcttcctcactgcatattttttattaggcctaatggcattaagtttattattttggattttacaaaaaaaattatgataacatctttaaatagttagtttcaactcctcctttccccttaaatccatcaattactgtcttttatttcactttccttatgtactgactagaatgcctagaataattgaatgctatgagtaataataggtattcttgccctgtttttggaaatccttctggatttcagtaagtgtgatgttggcttttggtttagtatctttaaatttgcaatttacaagatattttacattggaatagtcattgagttgttaagtaaagcacaaacatgttaaattcagactgaagtacaggacttcaatgaaaagttaaaagagtttatttcatcactttcattttttctttccctcagtggctgtttgtcccctccccccaccccgctccatcccccagcttccttcctttgtgctcttattgttctaggtttgactacataaaaagagactctcaatttatatgtgatacaagaccataactaatattataaaattagtctagaagaagttatttgcaacctatataataagggactaatttcaagattatttgaaggactttaaagattggtaagaaaaaaatagacaaccgtttagaataaggcaaagcatgtgtagaggcaactcttaaaaaaaaaaaagtgagctgggtgtgatgatgcacacctgtggtcccagttactagggaggctgaggcaggaggatcacttgagcccaggagttcagggctgtagtgcaccacagtcacacctgtgaataaccactccattctagactgggcaaacataagaagactctgtgtcttaaagaaaaagaaatgaaaagatattcagtttcattaattgtttgactagctgatttttggaaaatacccacaaatataaccaagcctacaagttattttaaggtgggtaagagatacatcttatctatatgcattcacctatgtgaagcggacacccagtaacacccccgtgtggaagacaagcttccttaaacttcacaggacagtatttcccatgtagtccatcatagggtgaggatttttcaggacctttggtaagcctgcttgctttcattcttgagggtagaggaagggtgcaagacttccctggtctctcccaagcattttggggaccctggccataagcctacttgctcaacaggtgcaaatgactggtaatatgctgaccagatgcaagtgtaccaccaatgatttgctgtgactgagtttggtttcctttgcatatactatccagctttttgtttctaatatattcttccttaagggaaccaggacttcttggggaatccagatgagcttgaaacactgtttttataagagaagggctgttttcaaaaacatctatagttcgtaacaaaggagttagattgaagggactctcactgttcagtctgtgacaagcatgagtgttaaaatggagacaagaattttagttaattgtaatgttgaatttgtaaaaggctataacttcataatatgatcaaggggaacaagcaatctaaaatgtgttaaagtagcattttcaaagtgcggtccagggactctcagggttggtgaggtcacaactgtttttataatattgctaagaatgtatatcactctccttctctccaaggatacggtggagttttccagaagctatgggatatgtggcgatagccttgccctaatggagtgtgtgctttgtgctttgcatttttgtcctttaaaaatgcttggttttaattttgaatacaataattatagatagatataacctacataaaccaaagttatttgcggccctcagtctttaagggtgcacagtggggcctgagactaaagagtttgggaattgatgttctagagaaaagtcagtcttactgatgagggttaatcaattagtatttactgaccgggacaggacaaaccattcattttataaagacacacagagcatttcactaaaatacttttactctgattaagtggtgattttagtaatagtaatgattgtttgattttctgatacctgaaggaaaaagagcctgttgaattgatactttgagggtgttgagttttaggtcactgggtgactgtagaaatggaccaggagaagaactgaaacttgagccttctaagaaatagaagaccaaaaaatgtttagtgttaccctatcccatgaccacaataattgagaaaaaggcctttccgttccctcttccctaccctcccccttctcccctaccctctcctcccccctcccctccccctcctctcccctaccctctcctcccccctcccctccccctcgtctcccctaccctctcctctcccctaccctcccctccccctcctctcccctcccctctcctcccccctcccctccccctcctctcccctcccctccccctcctctcccctcccctccccctcctctccctccccctcttctccctccccctcctctccctaacccctcccaacctttcccctccttctctgtccccctccccctccctccctgtcttcctcccaccccccactccctgtcttcctccttgtcttccatcctcccttccttcctttccttcctgtctttcttttcctttctttcctttttcttctttccttcctgtcttccctcctctccgtctgtctccttctccttgtccccttctctctgtcttgcctttcctttccttctgtctttttctttctttctctttctttttcactcttcctttttttaatttcccttttacttgccttctctctttcattccttccatgctttcttttttttagtggtatgtatactttgtgagcaatcagactatagcttgcagaatagttgggagaggccaaaaatgcccctgagaatgcaagcaaggaacttcttagtgagcatatgaacatcctcactccaatcggaggataacattgttcatacttcaaggactaaaaagctgagagagggtctctgctttctgttacttttagcactcgagtcatttctgcatgtatttctactgattactttttctcctattttggttcatatgttttctgcttctttgcttgtctagtgattttggattagatgagtgacattgtgaattttactgtgcaggatggctgaattttttttctattcctgtaaatatttttttggcattgttctaggatgtagttaagttacctggaaaaagtgacatccttttgagaggcttgcttttaagttttgttaggtggaatcacagcagtctttagccagctcactaaggaccaatactcttctaaatacttaccataatgtcatatgaatttccatgtttttccacttcagctggtaggaacacctgtgtcatctctaagcattgtactgttaattcttctagtagttcttatctggctttgtacatctgctgatcaatactttcagctaaagtctcaaggggacctctgcaaatctacagtgttcactgttcagctttctcttctgtagtaaattgcacagtgaactctagtccccttagccttcctgaacccccagttctccttaactcagggagatcaccaggccccaccaggattcctgtatctgccctgtgacctggagattctctgcaggcaataggttggggcggtcgtagggtccactttgttttcctcctcttcggcttcactgtcctgtgttacctgatgtccaatgtctgaaaactactgtttcacgtatcttgtgtgcttttgtagttttaggtgaaaggtaaaactagtttcttattattccacattggccaaagcagaagttttggaagtctttttttaaggtctaaaacacttctactttgagagtcaattgaaatggtcttttccacaataattattttctgacctatggtttaaagataagtcatgaaaattttatgccactatttttttttaagtctgattatggttaaattcagggggctatttcctcctagattgacagagtttataatgtttcctactcacaataattgtacttctgcttcctctttgcatgtgttactttaatgggaatgtatatttccttttcgttaaggctgccttcaacaatttgtcataaagtcacttctgttagtgaattctattttttctgttactttactctatccttagtaccaaagagctccttatgtgacaccaatttattactaaaatgtcgctttgtttatgttcttggaattcttcatacattgactatcctcagatgtcgaatgttgtaggcctgtgtggcagggactctcttccatttattctatttttaatctaattcttgacaaaataaacccaatttttcttttcttcccctttccatctcacgtagggactggcataaagggcaatccataaaattacaaatgatgaatttttttggttttaactattattcatacatttaagatatggtcacaatttttatttcttactagtaattcattttattttttaacttttaggttctggggtacacgtgcaggtttgttatataggtacatttgtgtcatgggggtttgttgtacagattatttcatcacccaggtattaagcccagtacccattagttatttttcttgatcctctccctttgctcactttctaccctctggtaagccccagtgtctgttgttcctttctatgaaacacaatggttttaattggaaaatttatttttttttcaggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggtaagtactcctcatgggaaattttaatcagcccagtttccttgatatacatgattaatctagacatgttttgagtaaaaacaactttagtgatgttgagatagtttccttctgttcctagtttttgtcgtgagaaagtgttgaaatttgctaaatactttttctacattaattgagataatcatatttttccctacatcctgttaatgtggtatcttatattaattgattttcatatgtttaacatccttgcattccaggaataactccccaatggccatggtgtataatcttttaaagatgctattgaatttggtttgttaatattttgttgagtatgtttgcatcaatattcataaaacatattgttctgtagtttttctgtactgtttgtctgactttggcatcagggtaatactggcctcatagaatgagttaggaagtaactcttgaatgactattttcatgaagaagcttcaataatctgaaataaaatacttaaataatttagttcacctgagagttgtttttagaagcgtatttatttttctattaatgtcttttttgaactatataagaatgtattctccttccactcacacattgatggcaagtgtgtatttgtactctgtggcctgaaaataagatttttttgaataatcttaagaggccatgctttatactctggtaattgagaattacctatttcacagtagctttttctaaaggttaatttccagagaaaagagaacatgtttattaggatatatctcttaatgaattcagtgtatctgaaatttctaaatgacattttcatattttgcatactaaataaaattcataagtacaaatataatgcaattcataagtacaaatataatgcaatttggatttctagaagttatctagttaaaatatgatcttaggatttattttttttgtcttagatttatgaatcttgcttgtttttctgttaattcatttcttcttgtttgctgcatcagtcagatcagagtagaggcagcttgtatagttgatggcacagtttagggttagatggcacaggatagaaatgggtgctagacaaagagcagtcacagaggcatgttagaaatttccagttccagcatcattgatgaagaaaaccatgaggacccaagttgatcaaaggcagccagccaataaagctatgctcatgcgagatgagctgaagtgacattacattaaaattggaagaccctcttactaagtggctccatgcttccctgctagcccctttgggacttccaagaagacttggttatttcaagaagacaagaacccacagaggctgtagtttagtttatctctctggaaacatagagaatatgtataattaaataaaagcactttaatagtgaatcctttacagtgttatttgaaatttatgtcaagtgatttaaaaagtaaaaatgaaaattaataatttcagtggaagtaaattgattaacatgaccaggaatacataaaacttgcatggtcttgtctataaaataaggatatgtcatttaattaggagagtcaaagctcattcttgcgcttaaggtctgaggaactcttctcccatggggcttatgaagggctacactgaggcaacttcctcaatatatctcagccataaaaccaagagaaagtaagaagcagaggacatcacaacaaagctcaattcagtaaaagcaattttataggagtagagggacttgtcaaaaacaaaaacaacaacaaaaaacaatgtccaaatatttattcagcttaatgagtgatgtttttgtttgatctagggttaaaatctagacaaattacagagatgaataaactacatatcctttagtctaccatcctctgaaaatgttactttttgaaactttgattttgataagagctggaggcactcagggagtcattctctggcatggtctttgagtacagagtgattttgctgattaaaagcaaatagattgacttttaaaatcaactcatacaaacaaactgttaaaatcctctaatgagagtgaagaaacctaaccaagactgactgatacattactgctccatctctgcaccaaagtggactcagggaggcctgtaggagatgccaactccttatcctactccccacaaagacagttcttggctatcttcatcagacacaaatgaatggttgaggctccaaagctctctaccaattcttgtgttacactggcacttttaaaaaattttgtttattttttatttttaaatggagtctcactctgtcaccctggctggagtacagtggcgtgatcttggctcactgcaccctttgcctcccgggtttgagcaattctccctgcctcagcctcccgagtagctgggattacaggcacccgccactacgcctggctaatttttgtattacttagtagagatggggtttcgccatgttggccaggctggtcttgaactcctgagctcaggcaatctgcccaccttggcctcccaaagtgctgggattacaggtgttagccaccgcacctggctggcacttctcttaaaactaatatctcaagaagttttttctttaagaatcttctttcaattgcaggtccatgtagttctggtattcattaaagtgcctatcccaggggttttggtatgttgtgtttcaattttcatgtttcaatttttttgatttatgcattaattttgttttttcagaattcaggtgcaggttgtttagtttccatgtatttgtgtcgttttgagaattcctcttgttcttcatttctaattttatttcattgtgacctcagaagacacttgcattgattttgattttttttatcttattgagatgtgacttacgactatgtggtcaattttagagaatgttccatgtacagatgtgaaaaatgtatattttgtgttgttgggtggaatattctgcagatgtctgtcaggtccatttggtcaagagtctgatttaagtccagtgtatacctttgttagttttctgccatggtgatctgtctggtgctgtgagtggggtgttgaagtcccccactattattgtatagctttttttccccataggtctagtagtatttgttttatgaacctgggtgctccaacattgagtgcatatttatttaggatagttaaatcttctggttgaattgaaccctttatataatgccctcctttgtctctttttgatgttgttggtttaatgtctgtttcttctcatacaagtatagcaacatctgttcttttttaattttctatttgcatgctagatctttctccatcccttcactttgagcccatggttgtcattacatgtgagatgggtctcttgaattcagcagaaggttaggtcatttaaaaaatctaatttgccactttatgtcctttaagtggagcatttaggccatttatgttctaagttaatattgatatttgaggttttgttcctatacatttgatatttgtgtattgttaagtagttgctttctagtttgaattgtgtaattgctctataagatctctgagccttgtacttttgtgtgcttatatggtagcaagtattgttcttttgtttccatgtttagaactccttggagtatttcttgtatggcaggtgtggtggtaacaaattcccttagtgttttcttgcctgggaaagactttatttctccttcatttatgaagcttaatttggcagattatgaaattcttggctggcattttcttttttctttaaggaggctaaaagtaggcccctgatctcttcttgcttgtaaggtttctgctgagaagtcctctattagtctgattggatttcctttataggtaatttggcccttttctctagatgcctttcatattttttctttggtgttgaccttgcatagtctgatggactatattccttggggatggtcatcttgtatcttgcaggtgttttctgaatttcttgtatctggatgttaacctctctggcaagattagggaaattttcctgaattattgcctcaaatatgttttccaatttgcttacttcttcctcttctccatcaagaatgccagtaagtcataggtttggttgctttacataatcccatatttatcaaaggctttgttcatttttcagattctttatgtttgtctaactgggttaatttgaaaaggtggtcttcaagctctgaaatcttgtcttctgcttggtgtagtctgttgttaaaacttccaagtgttgttttgttttgttttgttttgttttgagatggagtctcactctgttgcctaggctggagtgcagtggcatgatcttgactcactgcaacctctgcctcctgggttcaagcgattctcctgcctcaccttctggagtagctgggattacgggcgagtgccaccacccccgactaatttttgtattttttagtagagacaaggttttgccatgttggctgagctggtctcgaactcctgaactcaggtgatttacccatcttggcctcccaaagtgctgtgattacaggtgtgagccaccatgcctggcctgcttccaagtgtattttgatgttccctttagtgaatttttcaattccaaaagttctatttggttttatcttaatatggctatctcatgtttcatatcctgcattgtgtttctggtttatttgaaatggattttaaatttctcttggctctcactgagtttccttgcaatacatattttgtttttttagtctgtcatttcaaagttttcaacttggttaggatccattgctatagagctagtgcaattctttggaggtatgaagacactctttttgtagtgttggagttcttgggcagattccttcttatctgagggagctgttgattcttatttttgaatttcctattggttgggcgggacttaaactttttttttttttccccttgagggtatgactatggtgtatgttgtgtgtgatcattcaactttgtttctgggtgctttcagggggccaaggctctttatggattccttgggcgtggtagctttcttaaatgctgcttattgtagcaatgtattggatttgtgagctgacactctatctcatgtggggctgagggtgcagaagtctcaggaagcttattttgtggagtagtgctaagcctttctggtagtgggctttttatttgatagtacagttcaggctgcaatccagtagatggcacttaaaaaataagaaccagcttgccctcagttaggctgatgtccagtagaagcacctgtcctgacaggggagtgacaggaagagattctgttggtgtgtgccgaggcctttggggtcgctggttggggggagatagggggaggtgcactagctcctcatgcaggaatgtgatctgcttttctatcataccccatcagagggctcatgaccttcagttcataaagattttttccttgggttcccagccatagtctgtctgtaggttatgcatatgcccctctgaaggcaaccaccaaaatggtcttggggcagagcctcttcccccagtctagggcagacaactccatgacttgtatgtcctccattgctgggacactgctgctctgtgtagggatggggagttgggccccaccctttatgtaagcctaagtggcattctcactttcagcaggggtggagccatcttgaaaaccatgaaaaactctttcttcgagtacctgtgctggcccccagtgggaagaaccactgctgcgtcttcaacagcgtgtggggtgggagggtattgccacagatgaccccctctccatatccgttccttgacatggtgttgccccctttagcgattggcactgtgcccacctttcctttgtcccaaaggggttttggcaagttgtgtccctctcccttataggtggcctacactaggggggttagatctctagaggttccatagctccctgggaacttgctggccccctgggcttttcaaagtcagaacaggttatgaggtatgtttgctggggatctggtgctacagagactcaagggtagagaatccctgggcagagcagaggcccaccactggtgcacaagcaatatggtgaccaccatctcagtttgtgtctgaggggagtatgggaacccctgcaggagctggccacccagttctctatccctgggaaattcctaaattaccaccaataacattgccctgggtcacaagggtggggccttgaattctttgggggttgatctctgccagactctagctacttttcctttctgcaccccagcttcttcccatgggcactccaaaaggtcctggctctctttccccagttttccattagaaacttgtccatttgacagtaactttgatcttctttctaagaagagctggcatccaaggtctgtggtcagctatgttggaaaaaagaaggagaaaaaaactagtttgtattaaattctgaaagactagtggcactggttaagtctttaaaggattgttaacaaaagaaaatctttttaaaccaaactcctaattttatcagaattgtaactgaaaatataaatgtatgaaaacataggtattatgtaaaatttgctcaataaaagaataggaaaaactactatttatcttggactgatagcatgttagtttgagatttgaaccctttctactctagtaagtagtggtgggaaaaattcactgtaggagtctgcagacataacaaactatcattagactgccaagacctccacataataaagcaagcagagaatgtcaaataagtatgtgaaaaatgatcaaaaaagagaaattgaaaatataaatagggtgctattaaaaaaggatagcatttatgttatgacatatgtacacatgaatatcactttttagaatttcatccttcttaggacttattcctgagtccgaggattgagaggttctgataaaataagtctcagtgggttccaggcatgggctttctttaaaagtctctccagggattctaatgtgttgccaggaccaagtaccatggacagccaagatctcatcagcacagtttgattgaatgaacttatgtagaaccctgaatgccacacttaaccaaagaaacctttccagggattaattataggtgacagaacatgctatattcttattaaatattattaaaagttaagcaatacccattcctgattcatgtaaaattctcacttattttccaagagttttactgtatgactggtttatgggatgcttggaaaaggttgacagacatggcaaaggttcctgcagtgtttctctttgtccatcaacagccctagctcataacctctaccctttcagctaaaagcaattagctcttcagaagtgattcattctatttatacttgggataagtaacatcaggcagtcttccctagggcttctcacgggccctggtggcatttttattctaagagagggttatatttttacatgtaattggtcataattatactaaaaacaagtaattggtgtcttatacaagaaaattatatttctgctttagtcattgacagagtatcctgagaataagagttaagaagtatattcattgtcatcttatttctgatatatttcaaattcttttgctaggaagaagcccttttgactgtgctttgtgtaacaaaacttcttcggagaaacaatttagataaactttgtcagatcttatgtgattatattcaaaatgctaattgaagattctctaaacattttcagtaaaatgttgaattgttttcatgctgttaaataagttaacatgtcttcctttactaaagtcattattataaaaatgtaaatcctaatgataatagctgatgtttattaagcatttagtaggttccattttttgatagcaacttttatgaattatctcattaaatcttcataataatagcatcaagaactacaaatatgttttcatgtaagaagggaaataaaattatgagttttgctgtgaggtttgaagaatgaaaacaatgcatgacttagaaaatagtataattaagtgaattttattatcattatcatctcttagtttataaatgaaaaaactaaggcttacataatgtaaaaatcagttaacaaggttaaacaaccggtagatggtagaggaggagctgggaataaatctgtacatgtctgaatctggagcaggaacccttaactgatgtgtcattctagcaggtcatcagttactctacaatacctattaagtatactttatttactgtgtttagatttatagtagatttagactctactgtaaaaacaaggacttcatacacctgctagaaagtatccatatcatcttgtttgaaagttgtcccgctctagtgttcttttctaatcatgatgattcagaactccaaactcttgaagcagggcaacccgtagggtcagcattcataatttctcaatacttaaaaaagtttcctcatgactgttgctattattgagatttctcaaatgtcttggcctgaattgggtgtgcactatgaaaaaaaaaatggcagacatttctttttgttaaaggaattttaaaaacacatataaacacactgatttgtgacagattaccaggctttatgtttagcagggtttcctaagcaaaacacaaattctgtaaatctacagaattagataaaacattgactcaatccttagatgagagtataatggattatcacttaataacttctgtcactgaaaataaatgatgtaaaaagtaataaagttctactctcacagtatgaataaataggaaatacataatactttaaattaggcaacaaatcattaagcccccagcattcattagactatcattaatgataataaaattgtgtggtatttatacagatattatatgtaactccaggaattttgttataattgtgtatgaatatatttgttgtttgaggcaggtagatggatatttgcagcagctatgtgctgaagcattctggtaatagttttcaaatcaaccatttttttctccttgtcgatcatctttaaagcaaaagcaccgttttttactatattttttgaaaaaaatacattaggtgtaaaattatatattttgaagaagttcactttctgtttttactagtttcacacctttgttattttttcagtggaaggagcagagataggcaaaggcgaagcctgtgtgtgtggtcaggttcctgggcccttcatagcatctgatgccaagctgtgttctcttttgtgtcattgccttcccacttgctaattacgtgacagagctagggacttccctctgtctagaatgccccccatctcttgtttgcctagtgaaatctggtttgaagttcaaggtctgatacaaaccaggtgatcctctgcaaaactaactgtacctgagcaaaccaggcacttactcttttatatgttcctggcactgctgatactctgatagaaaacatcatcacttaatgctaactgtgggctcacaaaggggatacttctactgtaagaagactgtaactcttcttagcacagagattagtaagtacttgaaacagagtttcacatataataagtgttcaataaattttattttttatttctaacacttggcacactgcatagctcagtaaatgttggtgaagtgaactgagtattctccttatctattatgtggtaggcattattctagttgcttctgttataaaccaactcatttaatccttatcacagcacttttattgtggtcaatattttttaatcctcacagatggctaaggaatcagcactctgagagattggttgacttgctttgggtaaggtgcttataaagtggtagaacaagattcctatccaggccttctgattcaaaaatacattctttttttttttttttttagtagtgttttctggaaaggcagggtataactgactatgctgtgtatttgggactaagtatattattgtcaagtatattaaaaatgtcgcaacactggaaaggagtccatcaatgggctatgcaggttgagggatttgtagatgagaaactgataaatttggttagcaaggaaagccatcaagctgtgaaccctttatattggcaaaagagagggtcctttgaaatctaagggaacagaactttcctgttctccaagtttggagcagaataggtaagctctaggcagtctaatgcccaacttttaccagtggtgttttagttttttttttttttccaaaaggaaatgatggaattctttatatacttctgaattgtctatcttttcaaaaataaaaattttcattttgcagtacatacagaatcaaaagactttcaagtcctaactccacaaatgtttattttgaagctctttaaactgtttaccacggatattagtaaatctgtcagaaatgaggtgacttacttatccttgtcccaccagatatgtgggaaggatgatcacgctagatagcatggatgggtcctctatttatctctttttacttgaatggaaaacacatcattcagattaatcaattagtcattgtgactgatagaatttttatatggataatctgggtttggtccctagctttaccacttacttggggtctttatgtcttctatggtctcctatctgtaaagggaagttgataatgccaatctagctaggttactgagatgcttaaatgtgtaatgtatgcaaagcagcaggtactcaataaagggtaactcttactattattgtatagctctccaggtatgtattgagcttctatagaatccatagccccaaactctttagccctttgagaccaagattaagcattgtctttccagaggagagggtgagagagattgccattatactaatagaattcatcattatcaccgtcatcatcatcatcatgatttcttggtgtgtcatggaatgtactgtgtttcacattaccaacagatgttaattttcacaacatccctgagacaagaaactatgattacattttacagataaggtcatgcagctataaagttgtgaaattgggattcaaactcaggcagtctgtccccacagtccatgttcttaacccaccatgctctcctgacacttgaaaagttaggaggcgtactccatagcctgtaatgttgctgcagagagaatctaattttaaatccagtgaagcatattagttgctgtctttgatatgccattcagattgtgctatccttatgatgcctaccttggttgtatatgtaactgggcgtcaaatatataaatactcaaaaagtgataggtgccaataaaatattttatagttaatacttatgtaatctgtgttctctgtgtttgagggctggttctaaaatactgctctatatttgacttctggttaaaacaataaactttgctcatattagttatatagttgataccattctcatgttgctaacatgtctgtaagtaacagttgaaattgatctggcaattttagagctgtcagacccaggagatgagagaaacatttaaaatgtttataacattaaatcagctgagtcaagagagagaaagagaaagatgattcagatttcttgtactggtggatgtaagtgcttggaactgaaataaaggagaaggtgtagggagggagaaagataaagaagtcttccctttatacaagttgaaattgagttttctttgagatatagaggtgaagacattttaagaaacttcttaaaactctctaatgtggcttttcaacctgtttccatcaatttggcacatctcacttttcggcacaacagaatattctaggtttatctcacaccttccttgccccagcccaggaatcagccatttctctaagaaactcttgtttattttggtggggaacagtattgggaaaccaacatctgggagctaaatatactcctagtggttaggaggtcataccttgtagactcttgtagctgacggagttaggacatatttattagaaatcataagtttatattgatcttgctaggatctatccaatcctacaagattcttccctgtgtctctcctttgtatttgtgtatcctttcttccatattaagaactgtggctcccaacaacaaggcatgtgcccatttgcccaatcgtatgatgtataaaaactactttgagaaaagtggcagccaaaccactaagaaaaataaacttgctgaaatgagttcaagatttattggcagctctttttttggcccctagactgaaagtatatatttcaagtattgtgttcaaaaattatttgggttagctttttccacctttcataatagtaatattatttacttgaaatacagttggctttgtttctatattcagtttttttctctctatcttcattaatttcattatatatatttaatatgtaggacattaacatgtttccaaaagaagaaaacactccttcctgtatcatttccacctcatctctcttaccccttataggtaaccaattgcactggtttctagtttatcttacttatattcctatttgaaaagttacctcatatatgtatgttttttaaatttttatacttttttacacagaaagtaacgttcagtatgtactttgccactttccttttaaacttaacagcgtatactggaaatcactccatatcgtgtcacagagagcttccttatattttttaatagctgtataagacttcattgtgttgtctgtaccatattttattcacttccccatgtgtggacattttgactgtttctagtatctgcaattactaataatgctgcagtaaactttgtgcatatcgtaccttggtaaatttctagacatagatttctgggttaaaggttaagcacatgtgtagttttgttagatattgataaattcctttccatggggtttatatcatttttaaaatatttaccagcaacgtataacagcgtccattacttcaaagcctcaccaacagattgtatgttttaagtacttttatgttttagaatttttccaatgcgataggtaaacaatggtatatcaatatagttttaatacattaaagttcagcatcttttcaagttcggctagtctcagggctattcttaatatcttgtgaattatcttcatattattttcccatattccataatacttttggttttttttcctcctcaattctgacaagttctttatatttcaggaatattagccattttatttgatatgttacaaatatttttctcccaatatataacttttctcttataacgatttttttttcatgaaaagtttttaattaaaaccttttatgggcccaggtgcagtggctcacacctgtaattccagcactttggaaggctgaggtgggcagctcatttaaggccaggagttccagaccagcctgaccaacacagtgaaaccctgtctctactaaaaatagaagaacattagctgggcttggtggcacatgcttgtgatcccagctactcaggaggctgaggcatgagaatcacttgaacccagcaggtggaggttgcagtgagtcaagatcgtgccactgcactccagagtgggcaacagagtgagactctgtctcaaaattaaataaatatataaacaaaaccattatgggccaggtgcagtggctcattcctgtaatctcagcactatgggaggtcaaggtggttgaatcatttgcgccaaggaactggacagaccagcctgggcaacatgggaaaaacctctctctaccaaaaaagaaaaaaaaaaaaattagctgggtgtggtagcatgcaccagtagtcccagttactcgggctggtcacatgagcctggggaggtcaaggctgcagtgagcagtgattgtgccattgcactccagcctaggcaacagagtgagaccatttctctaaatacatacatacatacataccttttgtggagttaaatttacacactttttctttattggctctggcttttgcattgtagtaagactttctttacactcaacttatagataaattcacccatgttttcttctagtacttgcatagttgaattttagatctctagtccatttggagtttattttttgtatggtagaaggtattgatcctattttttcccaaatagttgttacccagttgtcccaaaacaagttattgaaaagtccatctttgtcccagatagactggaacaaaatgaattaaagacttaaatatgaagatttttacttgtgtatcctttcttcctagaaagaaaacataggcgtaaagcttcatgacgttgaatacttcatgccattggtctggcaataatattactattatgaaaggtggaaaaagctaacccaagtaacttttgaacacagtacttgaaatatatactttcagtctaggggccaaaaaaagagctgccaataaatcttgaactcatttcagcaagtttacttttcttagtggtttggctgccacttttctgaaagtagtttttatacatcatacaattgggcaaatgggcagatgccttgttgttgggagccacagttcttaatatggtagaaaggatacaccaatagaaatatttatatttaagtctggcaatcatttttaagatgtgaacttgaacaggcaacaaaagcaaaaataggtacgttggattacatcaaacccaaaagctcttcacagcaaagggaacagtcagttgagtgaagagacaacctatggaatgggagaaaatatttctaagccacacatctgacagagggttaatatccaaggtatataaagaactgcaacaactcaatagcaagaaaacaaataacatgaataaaaaatgagcaaaggatctgaatagacatttctcgaaagaagacataccaatggacaacatgaaaaaatactcagcatcactaacaatcagggaaatgcaaattaaaaccacagtgagatatcgcctcacacttgttagaatggctgttatcagaaagataaaagataagtattggtggggtgtggagaaaaaggaactctagcccactgttagtgacagtgtaaattagtatagctgtgatggaaaagagaatggaggttcctcaaacagtttaaagtagaactaccatatgatccagcaattccacgactgggaatatatccaaaggaaatcagtatattgaagagaactgtattttagtgattattgcagcattgttcccaatagccaagataagggatcaatctgagtatctatcaatggacaagtgataaagaaaatatggtgtgtatacacaatgggataccattcagcctttgaagagaaggaaatcctgtcatttgccacaacgtggttgaacctggaggacattagctgagtgtaataagccagccaccaaaagaaaaataccacatgatctttcctatatgtggaattttaaaagttgaactcaaggaagtagaatagaatggtagtgaccaggggtatgcgataggctgagggatcaaggagatgttggtcacgggatacaggatttcagttagataggaggaagaagttcaagaggtctattgtataccatggtgagtatagttaattataaagtatacttgaaaattgttaagagtagattttctgttcataccacaaaatgataagtatgtgagataatgcatatgtaaattggctcaatttagccatttcacaatgtatatatatttcaaaacaacatgatgtacatgataaatatacagtttatttttaattaaaaattttaaactctctaattggtcttcaacatatagtacacaagtcttttcacgactctttataatggaacatatgttcttggaatgctaaaaattattttttttggaggccctgcaaataactaaaaatttatcttaaaagccacacctaattacttacatatgatccagaaaggatactttgaaaaagctttttaattgataaaatcattaaggtaaaacatattcataaaagtgttctctaataattttataattttctagttcatgaaggattaaatatacaactatcatttgaattggattttttatgaggttaattgtatttaaatgctaattattttaactaattttgtggttgacttctatgtagagtagggaaaaagaatttcctaaagccagttacgtatatctctttttagtctggatttttaattaggaaaagtgatatagttaaataggtctactctatagcatcttctaaaatgagtaaaaattcattatatcaggataaaaaatgataaagatatatggatgacacatttggctgaatttttcttcttcgctgttctcttgctctctatttaaatagtcttagctcttttatcatttaaattctgaagtattgaggtgattattccggcagcaggtgattctgctaattactgttcagtcagttttagctattagaaacagagatatgtttacattgctgggctgcatgtaaatttagaagttacatggctttgtttttactttgacttacggcattaaaattattttcatctgtgtatgtaaagatctgcatctataagcttttgtggataataaggtgaaattgatgcattttaatataaattgccaatataaaatatctctaactcagacctctactggaaagttgtcaaatcttatgtaggaaaggcttttaccatcactgttacacattaactgggcatagtttaatattaatagctcctgagacttgtggttaactgaggtttctatttcctgtgtttgggttttatctttgcaacaacttggttgcttttctgtgtaaaatagtggtgaatatacacaagagtatgacaaggttctgggctcttaactttgatgaacaccatgccatttccatcatgctgcactcaaaacagcacagatgtgagtctgggagtggcgtccctgccgctctcatgagcctttgtttggagaacaccctgattaacccccacccttcacggttcattgactcactgatagatcaagtttaaactagtatatattagcacatttgttaccaacagaggaacagttggccattctgttttacattgctggttcattgcaaactggcgtgctaaaaaggtctgtactctagagtatgaattgggaagttaccaaaggactgagaaccaagtcagttgcatattaatgttgaattatacctatattttaatcttggattgtctacttgggggatgcttacactgttgtcaagttatgaataagtgataattaccactttgaaattcatctttttttttcaaggagtttaggggatttaggtgtctcaatatagctttcatattaaacagtttgtcataattggatgagagcagagcaaggtcatgactacctgatgccttgtgttggagcattttaaaaatgttttccagagagttatttgtacctaatgactttacataagtccttacattatactttatttctaggtcacctaaaaatgttaattgtttagtcaagagggttaggatgtgtgtctgttttctcatgaaaaaaattaagctgttccctttttatcaattttcttgcaatctaaaggcttttttttcttaccttcctaacctagtgactaaggtcatcttattgttacagttcctttcatgggagataggtttactgcatcatttggcagtttcatagggtgaattttgtcttggcttcatctttccttactggttgtcatcccctgggccacctgcttttttgcattttcctttctcttgtgagatgatgaagctctgtgccccgatggggatgagagacagcactctgagttcaagtctaggataaggcaatgggcttgcttttcaaaacaaactagtgtcatacgggctgctgctttcaggtccactgtctgattttatcactgatgacttgtttctggaaggcaaactgatttaagttctgagcaaaagggtcggtgtttattttcaatgctactattaatttagagttttaatttagaaaagattttttaccagttctcaaatatgatttttctattgactttaagtttgtagatataaggagtagacatgagatagagactgaattgcttttttgtttttaaaacttggcagtaataaggggttgcttgttttttcatgctaaatattttttctaagggatctagatacctatcagaaaacttaactttgataactctggttctttattaagtatttttgtcttattttaggaattaatagaaatagttgtaattttagacttcctttataaaataccaatttaaagagaagctttttgcttaaatgattgttttgcagtgttgtgcttttgttttctttaatgcagttgaaatcgcagctttataacttattttttaatttggggtttttaaaagaatattagttatttatttatatttattgggcacctactgtgtgccagacactattctaggaactagtaaacatagcagagagcagaatcatgaagttcttgacctcaaggagcttaaatcctagtggtagagggggaattcaaaaaaatcaaataaatgtatttctattatgtcaagtgatggtatgtactaccaggcaatcagatgaaaatatttcctcttctatacacagtgggcaaggaaggcttcattgactgtggagttttagaagaaagctgaaagtaatggggaaagagagccatatcgatatatgaaggaaaacatggtccaagcagaggaaacgaaaagtgcaaagaattgagcaagaaagtcatgttcaagtggagtcagcaggggaaagagtaggtcacaaatgcggctgagggtgggtcatgaagggccttacaagctttgtatgagtttttacttttattctgaaaaaaacaaaaacaaaaacaaaaaaaaccggggagctatttggggattttaatagaaaagtaacataatttccttttaaaatggatatgtggccactaagtggagagagtggtgtatatatgagtggatggaataattgatacaggcaagcaggagacaggttaaatgaaaaatggattaatccaggcaaaagatggtgacttaaattaagctgggagtgggagagatggtgagacatgcttagactttggattcatttttccagatagaactggctgacagagacatgtcatttaccaacatagacatggcagattttttttttcttttctgagacaaggtcttgctctgttgtccaggctggagtgcaatggtgtgaccatagctcatggaagcctcagactcttgatatcaagtgatcctcccacctcaacctccctagtagttgagattacaggcatatgccactgtatccagccaactttttttttttctgtagagacaatatctctctgtgttgcctagggtagcctttaactcctggcctcaagcattcctcctacctcagcctctcaaagtgctgggattataggagtgagccaccatgcctggccaatatggcggttattaagaggataagtcaaagattacatgaatattctgttatgaaaagtgtcaaacatatagaaaatataaacagtattccagtgggcacccatatttttatcaccttgattctacagatcttaacatttttctgtatctgcttcaaacattttattctgccaatgtgttctaaagtaaattgttgatattgtgatagttctctccaaaatgctgcagtgtgtagctctaaaaatagatatttttcagataaccaaatatcattaacctgccaaatcaatgaatgataattgcttattaacatttaatacttggtccatagtcaaattctccatattttccataatgtcttttatagttaacttttaccaactagtgtctgatcaagaatcattcatttaactaattacatttaaactgtaacattacaacatgttttttcgtatgttttattctctctgacattgacttatggaagagactagattatttgtcctgtagacattttatcatacataagagttactaggagagctctgattactagtccccactctcagaaattttgattcagttgctctttccagtgagctgctggtgatgctggactttcattctgaagaccatactttgagcactactgctgtaccactatccgatggcttctttgtgatatcgtttaacttgttgttctgttgcctgtatttcctctaaactgaattttcaatctaaaggcttactgagattcatgtttgatactttgggcaagaatacttcataagttctagtgcttaatgttaggtagcacttaattctgactatttcactattcatgaggctaagctaaggaggtgacagcctgatccttctattgtaatgtttcatgtgaaactactagataatttgttgagttggggggtgggtagggaagagatatctagttttcaataaatatttcacctaatggttttaacacacattgatcatccttgcctgaactaattatttaattagggatggcaacatggagactttctaattcaatctttttttttttttctaaatgaatggccttgtttttatttttaaatggatgttacttcgcaactggggttatttgattacccagaaatatagcgcatattaaaaaggtaggataaatgcttagttaactaattaagcaatttttaattaccagttttcacagtaaggcactaaagtttctgacttgagcaaagataaagtggaaagataaagtggtcgtttagtgagatgggcaagactgtggataggtagactaggtttggtgggaaagtcagaatatcagttttgaatatgttaagtttgagatgtctattagaaacatatgttgacgaggccaggtgcaatggctcatgcctgtaatctcagtactttaggaggctgaggtgggcggatcacctgaagtcaggagttcaagacgagcctggccaacatgtgaaaccctgtgtttactaaaaatacaaaaattagctgggcttggtggcatgcacctgtaatcccagtaatcccagctacttgggaggctgaggcgggagaatcacttgaacccagggggcggaggttggagtgagccaagatcccgccagccactgcacttcagcctgggtgacagagcgagactccatctcaaaaaaaaaaaacatatatatatatatatatatgttgacaatatttcagttgaataaaataaaatattctagctattttaggtagaaaggcattttataccgatactactactaaagggtaagaagatatgactgtagtacattaaatatgctgatggcctacaactgttgctgtgttgctttttcctcttcaccacacatatgcagcctcatgaaacattttccatgaccagcacactgaaggaaataaaaggaacctagtttagagatggttctgcatgatacaacaaaaatgagctgctaaagcattacaatcccactcaagagtattcccccatcaaatagtggggctggtattttaatcagttgatactaattgtcaaggtgtgatggccaagggattgatgtttatcagtgtatggacagtggttcagagtttggtgaattagtcgagttgaaagagaaagattggtgacaaagatgtatgaggtggaaagtatactttcacagaataagaacagaaaatgagatttatgtttttttgtaaacgttcaacaaagaaaattcattcagaggaggaaataggtaggcaagatgccctattctacagatgttagtcagcatcactgcaaagcaacctcagggcttatgcagtggacacttaaaatagcactggtgcagggatgggagaaataaatggatttaataagcactgctgcttaccaaggttgattgaattgccactattgccaagtgttctacctgcaaacagatcaaccttgagccctggatatggcaccatgtcccagagcaaccagccagccacctggtggcaggttgattgcattggatttgctccattatggaaggtcagtggtttgtcactgctgcgatgaatgcttactgtacgtttggatttgcattccctgcccaccatgtttctgtcagcaataacatggccttattaaagccttattcaataatatgacatcctatataatattgcttttgatcaggagactcattcacatcaaaataagtgaggcaattggctgtcaactacaggattcactggtcttaccatgttcctgttgtagcatattgtattctacctggaagatgaaaccttgtgacattaaagtagtttttagttccataaacataatacaggggtctatgaatcaagaagtggaggtagaagtgttgtcttttacttcacatctaatcacatgttcaaaatattttttcatcttgcctctgcaactttgaactttgctgacacactgaggttttagtgtgaggaaacaatactttcacatgggaacatgatagtcgttcaattgaactggacatttagaataacctggccacattactgaactgtataactgaaacaacaaatgaaaaaaatgaagatgctacgctggcaaagatgattaattttgattattgggagaaatagtattgctactgttaggaggaagactatatgtctagaaactaggaggaaacctgggttgcctccttgtagcagggtaaaatgagtgagtaccttgtctaagaaagggaacatgaccaaactgaacccagaagacataggaaatctaaacagatcaattaacaccaaagaaacgggcattttttggtacttctaaaaaagtaccagactgatattttcacagagatgttcgttatacccttaaggaacaggaacagaaaacttctatactatttaaactattttagaggatagaaaaggaaagaaaactccagattttatttatagaacttgcatgaaattgataccaaattctgacaatgcaagttcaaaaaggaaaactagagatcagtgttacttatgtcaaacagctcttaatagaatagatggatatggttatcaacatgataaatatgtttatcacattttaaagcctacatggagaaacatttgaggttttcttattctagaactgacaggaatgtcctttattatgagcactattagtcaaatttttctggtggaactaatgtaagtagactgctgaagaaaatgaatggtatgaacattggaaaggggaaattaaatgattattatttacagataaaataattgttaagctggaaaatccaagtgaataaagggaaggcctacaattaagcagttaaggaaagggctaggtatagaaatcaatagttttgatatatgcaggctatagccagttaggagatcagttaggggaaaaacacgttgacagcagcaacgaaaagctgataaacctagaattgttcaccacttatcttaaaatgtttaacatggtactgagggacacaggagattatttatgtggaaaaacataccatgtttctatacagaaaaattgaacatcacaaaagtattatttgatcttaagataatttatatttaatgcaatctcagtgaaataccaggagaatgtttttaagctagacaaacttatttcaaagatcatatgtaaaaataagcaaaaatagatgtgaaaaattctttaaagtaatgagagaccagtcttattgactattaagtcattataaaactataatgtttaaaagatggtactgacatatgaatagatcagtggatctcagatgggcagtgcagaaagagatccaaacacatacaaaaatttagtacctctaaaggtggcatttaaaatctgtggggaaagatggattttccaatgaataatgttgggataggtagatagccatctggaaaaaatgaaagtcaaatcccaactttttaccttttatcaaaatgaacttcagatacaattgaaaatataaaattgagaccataaaagtattagaagaaaaatgcagtttttaagtctcaaaaggggactcttaaatatcatacaaagcccagaggccataaaagagatgattgataaattcaaatataggtccgtgtaagcgaaaactttcagtatggagaaaacataagttattaaggcaaatgacacactaggaaaagcatttgtaactcataacaagcctagttttcttactgtgtaaagtactgccataattgacaaagaaaatatgaagaattggcaagtgacatacatagaaagttcatggaaaaaataactcttaaacatttacaaaattttacaacctctcatgaaaagagaaatggaaattgaaattagagtcacatacagtatttcacttttcatttgtcaaagatcaaaaagtttgaacatactgtgggtttatgtttataaggatgtaagaaaacaggcaatctaaattccttgtagagtgtaaattggtagtaataagagaaaaatttactgaatactttgtgccaggtgcttttctaagcactttacatttaattatctcaattaacttatccagaaagtaccattatttctgtattacacgtgaggaatttgaagaaaagttagacaagtaattcaaagtcacacagttaataaatgacagagtgaagatttgagaccatttcctttttctcaagtgtccacttttggtcgcaactctgctgtttctgtagtgagtgatttaacactatatgataaaaccttaagagtacgtactctttgatccagtgattctacttccagaagtttgtccattttgcatcaaatagatggagaatagcattcattgcattgttatttgcagtaaaggaagattggaaacaacctgaacatttatcctcaaggactcatccatacaaaagaattgaagtaaattcatccagatgaatatgaggcagctttagatagagtgagatggcatcctatgtagtgatatggagtcatctttaaaatacagtaaaaggaaaaagcaagatacagaatagcatgtagggaagctgctgtctatgtgaaaagctgtagaatatacgtgcatttttgtatatgcatagaatattcctagacaaggacaaacatggtggttcatacctgtaatcctagcactttgggagactgaggcaggtgattcacttgactccaagttcaggatgagcctggccaacatggcaaaaccccatctctagaaaaaatataaaaattagctgggtctggtggtgtatgcctgtggtcccagctacttgggaggctgaggcaagaggattgcttgagcctgggaggcaaaggttgtagtgagccaagatcatgccactgcactccagcttgggtgacagagcaagacaccattcatctctctatctcttttctctctctctctttctctgtctacacacatacacatacccccccacacacatatatatacacacatatatgtgtgtgtgtatatatatgtgtgtatatatatacgtgtgtgtatatatatgcgtgtatatagatacatttctagaaggattctcaaagtgatatcagtgattgttgtgcaagaaggaaactagatatcagtgaatgcgctaaataaggtgattttgaattctgtagcatgtgtatgatttacctatagagaaagcagtctagcatgagcgtgggtttctcaaatatagaatgtttgcagtgaggtcacttggtgaaaagtatagccatgtcagacagatgtaggttcagattccaggacttccaggactgctgaaagggaaaggggctttggatctccttcagctccaggcagcattgctcctttcccagctttgacattagctggagggaagacaagttcttagagctctatgtgcttgggacaagaccccttccccctactgccttactcgccaaccataactgctgcaaacaattcttacctcttccaccccatgtcactgcctaaaacccttcatcacctggcctcccatgcctctaagtctctgtacatcccctagcctgatactgtccccaaccctcctcaactccagacaccattttactctaccctctggaattgtccattattagcaaaatctcctttattttcaacctcctttctaagtatttcccccacattcttgttgtaatagagacacagctttcccaggactgtatagctttccttgcagtcctctaaagtggtaactggtttctctgccatacatttcataccactggtcctggagatattgtcaatatcttaatgtcttccttccatctcacttaaattttgagaccataattcctttttcctctcttaaaagttctcagtgttgaagctcaatccattagatacctctagctggcactactagttgcagtcctgtgcagactactgagtcattttctttactccctgaagacttaaactctatcttactctcactctctctgacattactcctattaaaatgttatgtttctttagctattctttcagtttttggtctcctctccttcaacgaggatgatttctagaatgttggttctcaaaatgtggcccctttgcagacatcgtcagcacctgggaacctgttataaatatgaatctgcagaccacaccccagactactaagcccaaaattctgggggctggagcccagaatctatgttttaagaagcacgtcaggtaattctgatgaatatgccagttccttagatcttgttattgtcattactgacaactttctctgagaccacaatttgaatctaccaatttttcactagtactcacccatcttaagtccttactttccccttaccagccagacatttgaatattccttgactcttctctttcacatactatatccaaagagtcaacaaatgctgtcagctataccttcaaaatacatgtagaatctaacttttaacctccactgcagtcacttcagtccaagcacaaccatttcccacctggagtattgcaactgttcttgtttggtggcccttggccctactttatctactttccgcaaagcagccagagtgtttctttcaacacctaaggttatatggcttcattgattgaaattcaccgtgcttcacctctttctctacaaaagccaaagtccttgtaaatgcctgtaaggctcgagggtgatctgaccttccctggcctgtcgtgtttcggtaaaagtaagctgagtctttcatagttaaaggacagcaatattgtcctgcatgatattttaaaaacccaatcaagaatcacacattgcatttaattttcatgcctttagtctccattaaaagtgtgccctttgtattaataattggagtgatgagggacagagtttaagaatatataaatattttgtccccaactgactgtcactggatggctttggcacccattggtgattcttacctgaatcagtaattattgtgatgactgaaaatagtgatttttctcactgtataattcttctatatttattaattaccttaatattatcctatagaacagaatgttcccttctcatcttttgtttgtttagtgtcagtattactcatgaagttgggtgtttagaaaattcaatgttgtataatactgttattattcaatattgtattttctcagtttgagtcttccatctgcgtcctttcatgtaaatagtataaagatcagtaatagaggaacatagagtaaagtgtgagcagagaagccttactctgagacaaacttcagagaggtgaactctgttgctgattaagaaaggcttcactgaggaagtgttgtttgaagtgagctttgaaaagtcataaaattttgacaaaagtggggatggggtggagcttaaaggaaaaactgtctgaacaaaggaaggcccggcagactaggaatttggcaataatacagtggttttggaccttgatgaggaagttgaaatggaacataaaaaccctctgcatttagctccatttatttgctcaggcagctctcactgcctaaaattttcacccctgctgttttgctcaggggtgggatgaggggtaatgagggaggaaattttagggggtgaaaacagcacaagccaaaaaccctgctcagatactcccttctcttgaagccttttccagatccctaataagaattaaccaccctctctcacacactctgttgtactttgtccttctctgttaaccagcctctgtgttttgtgctgtctgtatttgtggatacatcttcctcctttaaagcacgaatcatatcttaatcccttggcccttcttcccagtacttagcacaagtgctcaatacatgtttctttaacgcgtgtaacagaggaaggcgaggagagtgagtgggattgggagcaggaggattctgaatgtcattttaaggggtttgggctcgctcttcaggcagcaatgagccatagccgcctttgaactgtgcagcactgaccagagctgtgatgccaaaggatgcagtggaaggggaggacagccagcatgcctgggcatggtccccaagtcagaggacatcagtgggagaagggagaaggcatggaagcaagtggctaccatcttatgaatctgagcactcattcaaaggtggcaaggaaaaaggaaggcattgagcacggttttgaggtttccagcctgggtgattggaggctgatgcaggcttcttaccaaaaagggccctaggcagtttcaccaggaatgtttaaggagtttatcatgaccctatctcttcctcgtctaaaactctccctaaaatcaaaacagtatgtcctgttgaaatactttattgtatcaaatataatgagaagtaaaatattctctctacttgatgtatgaaacactgacttcttgtagtggacaattttcacttgtctttttagtaatggtttttattaaaaatagatgttaataactgcttgtttaatctttaaacgtggccctctgagagcagcttaccgtaaaagaaacggttgtcagctttctttttgctcctcagtccctcctgccccttcctaacaacagaaaatttgctttgcacctgctccaactgggttcgaagagataagcatcttgcaagcccagaaaattgtagtatcaaatctcagccccaactgtgaggcagcactatcattgaatccctgctgagaggcgttgctttcccaattcccaaaagagttctttctcccctggccccttttcaggcttgaactctgaccgaaaccctctttttaactcccagcatgcactgcacttggtactgacactgacccatccctgcttcctctgttctgcactggactcatcagtaggtcaggcgttggtagccctggggtcactggggtgcccaattccaataatgagcacatttagctaaggagaggaaatgtacccttctatttgttacagtccattgctttttttccagaaacaaatgctaaaagaacatttgatatattgtggtttggtaaatacacatagcactgcctaatattcacaaagttgcctcttttttttgcatcttccttcataaattaaatatattgttctaactcatgatttattttaagagggatatacctatttcacagctaggaaaatgttttcaaataaagttatattcagaatactcttgcaagaatttcaaataaaaatagcaaatactatttaaatgcatataacattctaacagacttgtgtgtcattttaaagggaaagaaaaaaaatgatgacaaggactttacaactttgtctttaaaatttcttcttaggctttccaaacagaccgaagtcattaaaaatactccttaacccccaaagtcacaaaaaagaagctacccaggtttattatgagaaggttgaacctctgttgaagcttgcaggaataaaaactgatgtaacaagtaagtaattttcagaatataatttcaccatctacaaaaacatacaaaagcaaaataatctgaatttgtccttaatgcaaacttgggaaactacttgtaatatctatagcatttttacgtcttcataacctactgcagccagctcgagggttataatttaattatttttgttatttttattagaatattaatattttctctttagaattttttcagatattttttcagacttaaacaattgttagatataattacaaaggaagctgtatacttgtttacatcttcatggagatgtttgctacttacacgttaattttgcagttaggcaagaaattgattttttgctcacttatatagttgatgtctttccatggaattcttccttgggttgttttcgttctgactctgacccctggtggttaggtcaaaactaagcactgaactgctggttttattaatagatgaatttagagatgctagaagcttaaatttgttgtctaaactaagaaatgtacttaggtttgtgccaaggaaaatagaaacttgttaatgctaaacttaatagatgattagtaatatcctttttgatttttttaatttggtagtcacatttctttgtttctttgagacttattttcgtatggtggggaactgagtagaagagtcgatgctatggagaatcgcaaccttcctagctttatttctatgtggcttcgctaacagtggaaatttgcaataaattttaattgatgaaaagtattataaaataagcctactcaggggacaagcccagagtgcaattggaacttcctagtcccagttatagattcctagggaagggattcacagtgatgtggctttactcagctgtaaacaaaggagataagtttcaagatgttaataatatcattgaaacctacacctagtgatctgatggattgaggtagaagaaagttcaaaaaaaaaaaaaaagcaagttttgtaggaaggtcagcccccatgaaatgtgcctataactatagaggttcgagagaaactaccatgaaaaactcaagaggaatttttgaattaaaataaagttatagtgaagaagttaacctttatgtttgtgaccttcggcttatttagaggtgatttacaagtaaaagagaaaattcagatttatgttttctttctactgaagatttccaaagattggctgaaggaaaagtttgagatttgtattagggtgagacaattaaaagttgaataaacatattggcatactcaatgactattttgttcattgcttttacatgtgaatactacaaagcagcttaacatggatattgctatatagcattcacttcaggaatctcattgtatgcttgctctgtgttcaacatwgtgcaggatgcgagatgaataagctatcatacttggatgactttctacattattagagattcaaaaaaatgcttaaaaccattataactggggtatacataaaagaactttgatgtctcagaggtgatattttgatcggaagattcaagaaaagcatttgaactaggcagtttttaagaggcagacaaaaaatgagggaaggaagtcaggctaacaggcatgtactgtaaaagttgggagggggggcggagagagagagtgtgtgtatgtgagagagtccatgtgtgttacacccatacatctggagagtttgtgccataactttgctctactttcctcagtttttacattatctgaaatcttactctatcatcataaaatagctgccagtgaatttcatcctttcttattaatatccagtgggatggggagaggtgtgcatatgtgtgcaagagagacccaacatgctttaatcctgaagatgaattaaaatttccttttttaagtttgggcacagatactgtattagcgcagtcaatctggaataatcatttatttaaccatcaagactcttcccaggggctgaggacagatccccttttcctgatgactgaaatgcctcagctgaatctggattctgttagggagaagaaagggcaaaatgacttctaggaaggctctcaacaatgtatactacaggaggtataattccaggttatggatggatccttaagctgcactcagcagtttactcatcgtgtattgatccacagttggtgtaaatttttttttatcatactgttgcaatctggtttggcaaagatgactccaccagcagaattaaaattaaaaaggaagagagaaaaagagattggagacaagaaaactgatatacaaggcctgaactaaggcagaggaaatcatctaaatgtgctttccttcttaattgtattggagacaaaactattatgttctaggatttttttctctaaatttgtaaatattactaagtaccatatttaaacataaaacaatagaatattccgtaaagcaaatttagaatttacttacatttgtgcagaatggctaattattagctgcctaacactcctcctacaggcaaatttataaaattacatcatttgcttataaaaccattttagtatgcatattggctcaatatttatgaaaaatatttcttgaataaacctgtgaatatttgaaaagttttagtcttcctgcctatcttacagtgttatttttgtagttgaaataatatatttgaaactttgtatattatactacagaaaggtggtcataatactgttagtttcagtttcaaaaattatgtcatagtaagatcgaattcgtactttatttgaaagtatatggaagagtaaagcagaaagaggacatatcttctgcatgtccagtgggacattgttttaatgtatccttgtgtgaatgggtgagtccaaatggaattggaattacaaaataaaccctatatgatgagttaattaggaaatagtgctatataaatatgaagtataatatgaagaattacagctagatatatacactataaggtactgtaattttttcataaatttattttaaaaatggatcttaccacattaataaaaacacacttctttcattttgggttgtgctgaaatcctaactacttctgaatatagatcagcatcttttgaaatatttgtgctaaagttgcatccccactctgctaccaccaccaaggtagtatcttatctaatagcatcagaaaaacttccgggagaacctggaaagaattattttttcctaattacctattcgtacacaaatcaaagaagagtatgaacgataagcccatgctggcatatgatatcatttctcttgcttctgaaacaaagcaagttttagagattgtaccattaaaggtgtgacagatattttgaggatcagagatccataggataattcatagtacaatagagtgaaaaagttaaggcagcagagaaatcagactgaaaagaactttcgaggccatatggttcaatttttctccttgtgggtggagcacaggtgtgtggcactcaactttggcttggccacctacactagaggcagagtacgttgttactggacaatactgtttgacattcttatgaatgttcagagttactgtacctttgggcagattagaaaaggcacctcctctgtgctgacttacaaaaaggtgccctttcttccagactaattcatcctttgcttataaaaccatttcagtatgcatattggctcaatatttatgaaaaaaatatttcatactttcaaaatattcatatttcaaaaatattcagcccaaggtcactagattcagcctaaagtcatttgttagattgcaaatccgtcattcccgttagccaagtacctttgtgctaggcataaactgtacaaaatgagaacttgtcagctgacattcgcctctttgtaatttttatgtactagagttaatgttatctcttgtagtaatatgaaataaatgtgccccatctattgtataggagtcattgagatatttgaagagagatatcctgtctgcccctcatctcttgttcacgataggtacttccatcgccttcagttactttttgcattaacagagctgctagaccttatcatggtcattatcattatcatactcaaagacatttatctgaaggaaaccttgatctctgccagctcagggctcttgggagtgcctagtcaccagataattttacctcctgggcagagttgtcaagaaagtggtgtttgttatcattttccccttctttctcctaaaatcacgcttctaacatggctgttaacaagcctcttcatagtgtttctctggttgtttatggctctacttgaagccttccatttcttggaaatgcctcttgcctttctaaatctcacccagcagaaagctaggccatctaatgaaactgtgtcacaaaagattccagtagcctgaggcatcactccttccaattttacctgcattttaatacaaaatctgaaaagtaaatgttcatgcatcatatctagctagagagaaagataattctgtgtaaaagattctttttgttacctcttaaataattgtgggtgtatatggccagtcctgttcccagcattcagatgtgagttaggaagttggaactttatacctggggacgatgaagactcactaatggggtatatacaaaaaagtgatatgattaaatatgtatctgaaaatggttattctggctagagtgggggagaggtttgagggagacaagataaaaggctattgtagtacaggtggagtatcccttatctgaaaggcttgggaccagaactgttacagatttaggatgtttttagcttttggaatatttgcattatacttaaccacttcagcatctctctaatttgaaaatcatggacacaggaaggggaatatcacactctggggacagttgtggggtggtgggaggggggagggatagcatcgggagatatacctaatgctagatgacgagttagtgggtgcagcgcaccagcatggcacatgtatacatatgtaactaacctgcacaatgtgcacatgtaccctaaaacttaaaagtataataaaaaaaaattaaaaaaaaaaaaaaagaaaatactccaatgagcatttactttgaacgccatgtcattgctccaaaatttttagatgttgaagcgttttggattttagatattctggttacagatacttaacttgtctacacatgaaagatatttagtgatcagatcaatcagctaatttagggaattagctgggagaaatggaggaatgctatggcataatttaaagacagaaacaactggccttggccatggagtggttctggagagtggaggaaagggacactctagaaagaagtcattttcctgtcttggggtagatgatggaacacaaaaagaacaatatatttgagagagaatatatttgaaggtatacataatggattctgttttgagcttactaactttaaagtacctacaggacaggaaagaaaatgacatttcagtatcatatcccacactagaattttatcaccaaaccaagaaatgtttccttatgtccaaatcaaatctcacctgattttatttcaggtgattttctcatcaacattgaatatcaaccttaagactttcttgtcttcctgaggaagttgcatttgcaccaaagaggggagggggaaattcccagcagtgagaattgtgttcaaagacctgtaaactgtgaaggcttcacatctcctatttagaaagagcacaggttggcaatctcataggaaaaggcaaatagatgaaagaagaggctgggttacattttttgaaattacatttatctagcaatcctttctttgtttgtttgtagggggatgatttgaatctggctgtcactgattccagggcccacaatagcctgtctaaatacatatttggtcctttctactatatttaaatagtaatccagatcactctttatccttttgcctaacattgttttgtataaccacctattacttcatattataattcattatttcattagcatatattgtctatctccagaatgcaaattcctgaggccaaagactaattcattttgttcattttgctaatatattttatagatgtagatagtcaggttcttttcattttgtttctttgttctagatctttgattttattggacttttgcaatgttacttaaaaaattgctattttcaggcaggttgcattagtgtataatcaaattccacccacaatatcaaaaaaagactattacaaattaaaaaaataaaaatagcattcaataataacacagttctaaagctcattattggatctgaaaaactttaccaatgtaagctttggtataaaagtaaggcttggtgaactgattcttagcataaatattttttcatgatattcttatttttaatgtgtatatgtaagatgttttattttgcattttaaggttgtaagtacttgctgtagttataaatgaatgatcagcacacatcttctttgataacctttcaactttattaatattaatgtttcatatgtagttttattatggctttcttctgattggaatttaatatagagaggttttattcatgtgagtgttaatggcattttgaataagctatgggagaattacaatgtaacactgctggatacagaatgattcttttagacaccaagactaataatttttaacaatatcgaaaaacattgtaggaaaagcttgaaccatgctggcaccagggacagacaagcatgaaagattaatgtaatcttgcatataatgacacacattcttacacaaaaaatccatctgcaatgtcatgtcagtcagcagaaatctttgatgggtggatacagctgggctgtctcttctggcagagctgccctggaaaatgctaaatgtggttgtgatgcttggtgccatctgcagtgtgcccgtttatcctgtcttcactggcatttacgatactgcatagggcatcagtgactgtggagacagcgatacagagtgacagattcatttcctcggagggtctgagctctggtgggcctgtgtgccaccctccttcttgggtctgggtctcttataattggtgttggctttactttgtattttcacatccaactcttcctctttttagtctaacagttccagtacacattcttctggtttgtaaatcttacactaaccttttgactaatttattcatgtaaggttgccaaaccgatttaagattgactgttcaatgccagctaatatgccttatttccaaaatactgctcctcctaagcctctgatttaaaggacatgtgtcttatttagggaatactaaacaggcaccaggacaaattgggtaaccactatgcgtgggatattcccaaatgactttatgtagttgaaacaaatatatgaccttctcttacataaagctataaaacatcaggccagtaacacttagtcctcttgcccatgattaaaatataaatattcaagaataaatgctgttttatgacttgaccatatgtttatcatattattttgccagaacaagttaaaaagtgtgatcattgtttaaaactgtcactttgtgtatgtgtgtgtgtttttttaatagtaatggaatatgaagggcacgctctgtcactgcttaaggaatgtgaactccagggatttgatgggtaggttatattattaatcaatatatgttatatcatttatgtattaaatgccttcactagttttagctacatatttggaacctaacatttaaaaatatttgtagtgtatgtactttggctctatcttgttcatatctatgtaataataattaatgataatatgacatggtcatctatctctcaggatctggcataggaaagcaaaaagaggaatctaattattaaaatactgggaaatgacagtgtactactctatacttactaatgtgcatacatttgcatctataattatttgcttttaccatatatctagagaagcactaatggaagatgttatactggtcacatggcataactatatgatgatcttcttttgcaaattaattgataggtttaatagctacccattggttaacttgtctgtgatagattgagggaagatattttataaatacaagtaaataaatacattatttccagaaacaataagaaataattttaattatctcataatgtagtgactacaatttaggtatgttattcacagtgggcatcggaaaccattgttcgcaatacattggagtgtacagagattgttcactggcatgcaaacgttagaaccaaggcaagtgatataaatttcattgccattttttaaaattaggtgaaccaatttgctaaagtgttggactgatgtgtaagactaaaacatattatattcctttagggaagttctttttacgtgagtagatatttgagaatttaaaaagttgacaagtgtgtgaattatttgtgttacatggtgatgggcagggggcaaagacccataaggtcaggaaagggagttaggtctgtactttcaccaaagtgaaaggcattaaccttcccaaagactgatttgaatgtgctggggagggaagtgatgcaatcaaaatggagtattggcagggctgtttttcagaaatgcttatttatttatttattttttggatgaggagaaaacaatagctgttgagaaagaaaatgtggtaagtaaaacatgatttttccaaaaggaatctaattgagggaagtaaatctagatagcaatattatataaacattgggaatcaaaaatatggggtaggagattacttcagaactttatacttagaggtagacaaaaacattaataggcttcatttagaaaattgtcttacaagtatacaatttaagaaaagtccttgtgggaatcatgcataccaactacctatttgaatatgctgcatagtccctcactagacctcatgagtacatgaaggtagctgcattgcaaatgagtacctgcttcaaaacttgattaaagaatgagaataaagatatcacagatattaaacttgttcttacacagcagcattacagaatgttctgctgaatgcagtatctatcaatatgttttactggtatttgtactgggtaaagggatgaaaagaactttgcagaatgaagaaagacgattgctgaagtgtagtacaataatatttttctctttacctgaacatatttaatccttatttatttttcatggcaggtgttgttatttttcagtgtagagctaaaagatgtatagatttttcagttattatattttataaaccaaatagtttggcctaaccattatatgaattgagttatgtaagtgtttctaaactctatggcatgctgatttatttcagacttacaataatttcaaatttctactgaaagtcatcttccgtgttctaagactctttaaatcaggggtccccaactccgagactgcagatgaatatcagtcagtggccttttaggaactgggaggcacagtaggaggtgagtggcaggagagggatcatttccgcctgagctccacctcctgtcaggtcagcagcagcattagattctcacaggagtgcgaaccctattgtgaactgggcacgcgagggatataactggtcatgcgagggatctaggttgcgtgctcttgatgagaatctaatgcttgatgatctgaggtggaacagtttcatcctgaaaccatccgtctcccaccccaccctgcagtccatggaaaaattatcttcccacaaaaaagtccttggtaccaaaaaggttggggaccactttaaatagcttatttatttttgtggggtcagttttcccagtagaagctgatatggtagttggagtaattatcttaataaactggcaattttaagtcactgtacttagaattacatagagagatatatgaggagaataatagaaacatagtttcttcaggtacttcaaaggaacaattctcttgcaagtaaaattgtttgaaaatggaatattctacattggtgagttttctattcctgaacctgttctaaagagtggctaaaggaaaattttgggggaaatttatagaaaaggtgcagagatgagagaaggttaaccccaaaatgctatggcattttgatgagagacagactcaaatttctttaagaactttggcctgaagcacctccgtctgacactagtggaactattaatagggagtgattaggaaatcacctaacagtttggtttctagatacaggctgaagaagttaagagccaagaaagattctatgtatagtatttagtaaagcaaaacaatttggtaagtaatgtttaagaaatgctatttcctaagattttggagttgtatttattttttttaatgaattacatatgtttctatgagacatcttgtgacatttctaaacccaacagaaacagtgtatcagcacttatgacagctagttctccactgcagtgtgtcctaggaaacactctaagatccactgttaaaccttatgagagcttcagattctatattgctccctattttactgggcatgagtaggaagttttaggaaggaaaataaaagaatatcagctgcatagacttgaagcagtaacacttgcatttataagtgtgagtatagttttaaaaatctatagattttatgcaattgtaaatatatgaattcctcgctattaatatttgtttcagaatttttaaaaaaattgttgagttacttttcttttgttcatttcaccattaattagacccataatgttgtagacattatttggattatattgacattttatcagattgaacatatctgtattacttagtaaggtaaaaagcaaaaacaaaaacaaacttttccagaaagaaaaaaaactgtgaatcaaaactacaacaatatattgaacatttcatagatgatgggttcatagataagtataaaaacattcattaaaaaaatctttatcactctttgaaaaaggatatattatcacccagtgtttcttttctagacagaataattctgtttggagccatggcaaggagtttacttattttaaaaacaagatttgtcacatgcaaaggattagttactctaaggtttatgttttagagtgacacaagtgtgattaactcactataaatgattgaatactttgctttttgcctttcttgtatatttagactcttgtgatatttttgtaagaagctgttgatgaaaaaaaccaaactgtaaaatatttaaagaggtttattttgagccaaatatgagtgctcatggcctatgataaccccaggggggtcctgagaacatgtgcccacagtagttgggttacaacttggttttatacattttggggatacagaagttatagccaaagacataaatcgataaatgtagggtattcattggtttggcccagagaggcgggatatcatggagctggtgggaaggggagctcacagatgaattcaatgattttctgattgtcagttggttgataagctttgctgaaagattagaagtcagcagaaagaaatgcttgagttaagataaatggggtggtgtaggctgggtgcagtggcttagcagtggctcacacctgtaatcccagctctttagaaggctgaagaggggagatcacctgaggtcaggagtttgagatcagcctggccaacatggcaaaaccccatctctagtaaaaatgcaaaaattagccgggtgtgatggtgtgtgcctgtagtctcagctacttgggaggctgaagcaggagaatcacttgaacccaggagggagaggttgcagtgagctgagatcacaccattgttctccagcctgggcaacagagcgagactctgtctcaaaaataaaataaaataaaataaaaaattataaaaataaagataaatgaagttgtggaagcacaggttcttgttatgtagatgaagcctccagatatcaggcttcagagagaatagatggtcaatatctcttatcagaccttaaaaggtatcaaactcttagttaaatctctcctggatcaggaaaagacctggaaagggaaggagattctctatagaatgcaaatttctcctgcaaatgatagctttgcagggccatttcaaaatatgtcaacaaaatacattttgggataaaatactttgatttcctctagggcctgctatttgttatttaatgctataccagagtcaggttggagttggggatcttattgctaccaagtctgttttgtcagtcttatgatctattttttttttttttttgagataaattctcaccctgtcacccaggctggagtgcagtggtgcaatctcagctcagtgcaacctctgtctcccaggttcaagcaattctcctgccccagcctcctgagtagctgggattacaggcatgcaccaccatgctcagctaattttttgtttctttaatagagatggggtttcaccatgttggccaggatgatcttgaactcctgacctcgtgatccacccttggcctcccaaagtgctggaattgcatgcatgagcctggccaatgatttacatcttaatgccagtgctggccatttgcgcctaaactccaaaagacaagagggtataaggaggcatatccaacctcccttcctgttatgacctgaatagtttttcagattttctttgtgaccttcatggccaaaaggggaggatccattcagttagttggcgacttagaattttatttttgttttacaaaacttatttcctaggttgagtcactttacctgaacatgatcttaatgattgaatagttgttaacataaataaatacatattttttctaactcacttaatttcacactggttctactggtaaactgtttttcaaaataataagattctcataaggctatttttattaggtttcatatatagaaaaggtatctaatatattgaataatattgtagcttctaagaccaaaatgtcttatttcaaatccctgttctattacttactagtggtacaatcttgaaaaagttactttatctttctatgttttagtttcctaatctgcaaattgaaggtaatattacctattgcatacagttatttctccacttaaatgagttaatacatggagagtgcttaggaaaatgtctgatatatatatatagtaattattcactaaatatttctttattgttataattgtcatttgtattagtttcaaaagatttaacacagaatgtattatgacaaaatttcagatgtttcagaacatgctcatagggaggccacctctaataactctagcaatatgttaacatatgcatgacgctataattgtatgcaacattctaggagttaagtgttcgcatcctatgtatgtaagggtcaagttatttggtgctaaattagatttttttgggtatgactccacatagtctttttggtcacacccatatgtcagcatttagacagccatggattgagggttacgtttaagttcacagattagaaatctcatagagatttttgaaatcaggtaagtttcaagtcaaaccttggtttttttcattcataaagatgggactgtggcctattttgcagacttctgaggatttaatagaaattagtaaacacattacctgatatatagtttgtccttagtaaacatcattccttttctctgaataggtggtcatattgcgaacctctggaatcagtttagacataagaataaaacacacctaatcaaacatgacctgggtcatatcttgagtcttctaaccagagtagccttggattgcccaggctatgtggagctagtgggatgaggaagatggggactagagggaatagatggccgagagaaagatggtgggaactgactggaaagacactttcagcctttggtcaccaccctccagagcttcctaaacttagagaaccagtaactactgctgactgtggcccatagacagttttgtttgaaatagtgtttttaaatatattgaatgctagttgcttagtatttacaaattaggagactcagccttaaatcagaatctctggcttctgtagaaaaaccagatctgggtccattaggcctcacacgtgatgtgagtgggccacagcaaagaagtggctgcgcctttagattgagcctactcttccattcctgctgggcccttgtagcccttgagttgtgacacctgctttcactgaggcaaaatccactttccattgggttaactggtgacattttgatacgtaagaatattttgcttcttttgaacataaatgattatgaaatgaatttctggtacttctgtgttattttaatggattctgcccccatagtctacttgatataaagtcttaaaaaatatactagtagtactatctaggatcaaaggctaatagtattacatctagaagcaccgtatagcaataatgtcaaggagatgaaattcaggtcaggtttgtaattactacattcatatagtaatgataattagcagtttcttaaagcttcatattttatatgatttttattgctatctgtcttttcagagctttattgagaattagcaggattttatgactttggttggtgttagttaaatgaattgcagatgacagtattattaacaagaaatgagaatgatatgcttttggatgttaacagagcaaaacgctggtcagatgtgaattaacatgttcaaaagttttcatatctcttaacacacttaaagctattttgtctatggggaattatctagttattatatttgtgaagtaaacttacctgtgttgtgtttgtgttgtcttacccattgacacatattaacatgtttaaaggtacatgtgagcagttatgcacatagactacaaattagtaaactattttgaagtctagatttcatgacttattaccaatcattctgaagttttgccttctttgcttgatttgtatttttctagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggcaagggagtggctacagattcattaaactgacccttctccctcttttcctttcttacttgctaatctagacagcacaacacagaattaatgaacagactttgaaagatccagacttctggcatccccactagcaaatgtgagacttttgacaagtcatttaatctctttgagccttatttttctaatctatagaatagggatcacagatatattattcactttattacaaggttattgtagtactaacgtttggtttagtaaagggtttaatatatagttaaaccatcagtatatggaatggttattattctcccttcgcataaaaaatctgttgattacacagtaccaggtaagaagtttcaaaacagggccactccagtctagctgcttacaattccatatgaggtgaatatggtaacttgcataattgatgtataaccagataaccttgagaatgccaaaattacttgtgactggaagggaggataaggtttggaagggtgagattcttaagggcaaggctttttaatctttctactcactgccatttttcagcatctagaatagactatgccacagtgatgctcagtgaagcctattaagtgaatgcatgtaaagaagactttatatagtaaatgacacttggattaggtcttaaaatgggttggagctggcctgaaaaggtgagaatgagttattttcttggctgcaaaagtaataaagcaaaggcaaaacccaggagtgtttgaggaatagtgaaaaggccattcagtggaagataatggtatcaaaataggcccaaccatggaggctcctacatgccacagtaaggtctctgaattgtatttgataagcagtagggaataatgggatgtttcagagcaagggggcaacctgattggagcttgttccaggaggattcattttgcctcaccgtgtggaatgattagaggttgggagcaggagaaagtagaggtcagagacacggagaaccgttagagcaacactgtgatccagaaaagagggaaacatcattcaaaagctgattgtattacacaatcactcatccctatttaacgaacggtgctgggaaaactggctagccatatgcagaaagctgaaacaggatcccttccttacaccttacacaaaaattaattcaagatggattaaagacttaaacattagacttaaaaccataaaaaccctagaagaaaacctaggcaataccattcaggacataggcatgggcaaggacttcgtgtctaaaacaccaaaagcaatggcaacaaaagccaaaattgacaaatgggatctaattaaactcaagagcttctgcacagcaaaagaaactaccatcagagtgaacaggcaacctacagaaagggagaaaatttttgcaatctactcatctaacaaagggctaatatcctgaatctacaaagaactcaaaagaatttacaagaaaaaaacaaccccatcaacaagtgggcgaaggatatgaacagacacttctcaaaagaagacatttatgcagccaaaagacacatgaaaaaatgctcatcatcactggccatcagagaaatgcaaatcaaaaccacaatgagatatcatctcaccccaggtagaatggtgatcattaaaaagtcaggaaacaacaggtgctggagaggatgtggagaaataggaacacttttacactattggtgggactgtaaactagttcaaccattgtggaagacagtgtggcaattcctcagggatctagaactagaaataccatttgatccagccatcccattactgggtatatacccaaaggaatataaatcatactgctataaaggcacatacacacatatgtttattgtggcactactcacaatagcaaagacttggaaccaacctaaatgtccaacaatgatagactggattaagaaaatgtggcatatatacaccatggaatactatgcagccataaaaaatgatgagttcatatcctttgtagggacatggatgaagctggaaaccatcattctcagcaaaccatcacaaggacaaaaaacgaaacaccgcatgttctcactcataggtgggaaatgaacaatgagaacacttggacacaggaaggggaacatcacacactggggcctgttgtggggtgggggaaggtggggagggataacattaggagaaatacctaatgtaaatgacgagttaatgggtgcagcacaccaacatggcacatgtatacatatgtaacaaacctgcacattgtgcacatgtaccctagaatttaaagtattatatatatatataatatacagccttatgaacatatatatatataaaggaaaattaggcaaaatagcattacttgaggtactcaatagcctggcagagcagacattaagggtaagagagactggacttgaatttcagtttggtacttgactttgggtgggtaattagcctttattagtcttgattacacatttaaaaggtttaataaggccgggtgcagtggcttatacctgtaatcccagcactttgggaggccgaggtagtggatcacctgaggtcaggagttgaagaccagcctggccaacatggtgaaaccctatctctactaaaaatacaaaaatgagctgggcatggtggtgtgcgcctgtgatcccagctactggggaagctggggcagaagaataacttgaacctgggaggcagaggttgcagtgagctgagattgtgccactgtactccagcctgggcgacagagcgaggctgtctcaaaaaaaaaaaaaaaaaaaagtttaataatgtccatccccatagggccattacaagaatcaacttttaaaaagtcacacattatcactaaaaaagcaaaatatttttccctatgattatagaaaataatgcacattgttgaaaaaaattcatattttgataaccctattcatttagtatggattttagaatacttagtattgttgataagttgacagagcataagatattcaaatgcccttttagagtgtaaagtctttcagaaagtcagaatttaaaaggagagagatattcagatataatctgataattctagagtatataggaaaacctaaaatggtttctaagtagaagacaccaagatgattttgactcaaagagaaaaatgatgcattttgggccatcttttcatggcattttatttcttgacctttttgctttactttagtagttctgactataatggtggaaactttccaacatttccttccatgcaaagtggatgtgcttaggacacttcattagtacttaaattcctgaggtcattcattgactgccatacatcagaaatagaaagatgggtgtccctacaggtatgcctttgacataaatttggtggttggctataaaaactggtggttattcttatgttttagtatgtaattcagattttataaagaaatagcatttagttttatcactattataattttgaagagtatttctgatttggggagcattttatgtattctttggatatttgtagtaatgccattttaacctgtcttgtttagaagacacagtatgctgccaaaattctggtcattgcataggagttctagcattctaattccatctaataggaggggaaagtcatgtgtggggtatatttaatatgatgactgtatgcctagtcagggcttttgatagagaatgggaactagaactaggcaggaagttttcaagctgaacatgaggagacagtgtgcctttgaagccatttgcctcctggagagagacacccagagggagagtgtttagtaaattaatccactgagccaacagactaagctgctgaattatggtcagactcaaatggatcagatgtggagaagcctgtatttgaactgctggccattaggaatggtgtttgttgctatgggaactggtgctaaggaactatactgagagactctgattaaaagggggagggggaatggagaaaaaagcctgagaggacataaaaataaaaaagcaatccagttgttgtaaaacaaggctcaagccacatactgatggctgtgaaccatatattcctatagagtttgcataaataaattcatgctttccaattaatttgaggagaataaaatattgccgagggactgttaatttctatgatatttcaggcaaagaaccaaagtgtaggtgccgttttcatgagaattttagatatgcttgactaggaagtcattacatcacatttatctgtttggatgtgggagacattaacagccttatgaatattcatggtatctggttaattaagttaattgttctgcagaagtgcttgcacttccaaggacattttttttttttttttttttttgcctccatagtttctccctggtatttcatcagtaattctttacatgaactgctacttctgtccttacttttttgtatttggaacattttagcagctctcaggaggaagtggtaggcaaagtttctggtagtgttaagaaaaataactttcaggctaattaaaatgtttaccttgaggtagaacatttatagcttttgtgagaacattaaaattacgccattgttatttatgtgagcagcatgttcttttggcatgtagacatcttttcaaatagagtacagtttcctgaaacaaaatgtaatccatctttcagattatcccaacaaaatatagaacaagctatcgttttgcaattttacatatactttctcataaactttccttttttcttcagagtgtcaaaaaccacatttaaagactaagatacagattaatgagtagtcaatgactaaaataattttctgacttctagtcatgtctgttatcactgccaacttctacagaattagagaaaagttgcaaagcctgagaagacataaacaatttttaaagccatctctagcattctaaaaaaattttgtacttgggcatacccaccgtacttcaaactcacagggaataaatggtctttattttcttaagtcatgatatgtgtcattctctattgcacatgacattacattatgttttttaatagcctttctagaggaatgcttttacggtctactcataattaaccatggtaatggaggaaatgtgtttcatggagtactgtaatccatcgataatcctaaatatctgactctaattatgtggcctcctccaaaatctttaccacaaatctgattgggaagcacaatggattgacttgtttcttccttttctcctgatccattccagatttattagcaattagatggtcaaagggcaggctgtagagggccacaagatcattggaaagaccttgataaagatccactgagtaacaggtttctacactacttgttctcaaaacttagggtccatagactcaccttgtgaacttgctaaaacagagatacctgggtcctccctcctccaaacacattctgagtccatgagttggaggtagaacccaggaatgtacgtttttaacaagctcccaggtaatgatgctgcttggaccatgcattccagaggagtttctcaccaagtcactgtgcatacaaaccacctggggatctaataaattgcagactctgaatcagtgtgtctggaatggggcctgagaggcaacattttaaaaataatatattttttacttccattaatactgctattactgttttaatacctattatccttatttttaaatggacaaaaattgtatgtatttattgtgtacaatgtgatgttttgaaacatgtatacattgtgaaatggctaaataaagataaacatgcataaaattgacataatgatcacatactgattttacattgagaacacttaaaatctcccttagaaatttccaagtatataatgcattgttactaactattgttttagcctgttctcatgctgcaataaggaaatacccaagactgggtaatttataaaggaaagaggtttaattgacttgcagttcagcatggctggggaggcctcaggaaacttacaaccatggtggaaggcaaaggagaagcaaggcacattcttcacaaggtggcaggaaggagaaatgctgagtgaagtggggaagagtcccttataaaaccatcagatctcatgagaactcactcactatcacaagaacagcatgggggaaaccacccccgtgattcaattactcctacctggtctctcccttgacatgtggggattatggggattaaaattcaagatgagatttcggtagggacacaaagcctaaccgtatcaactgtagtcactaggttgtataacagatctcttgaatttattccttttacctgaaattttatatcctggaccagtatctccccagtccttcccacccattagccccagtaaccactattttactcttcgcttttatgagtttaagtttttcagattctacataaaagtaagtatttgcctttctgtgcctgtcttatttcacctagcataatgtcctccaggtttatccacgtgttgtaaatgacaggacctctttaatgccaaatagtattccattgtgtatataaacaggctgattgtccctaatctgaagacttaaaatccaaaatgctacaaaattagaaatgtttgagtgccagcatgatgccacaactggaaaattccacacctcatgtgacaggtagcagtcaaagtgcagtcaaacctttgtttcatatagaaaaatattttaaatattatataaaattatcttcaggctatgtgtataagatgtataaaacttttatgtttagacttgggtcccaccccccagatatctcattacaccaacagtgtaaaagtattcccatttctccacagccttaccagcatctattgtttattgactttttaataatcgccattctgactggtgtgagtgtggttttgatttgcatttctctgatgatcagtgatatttagctttttttttatatgtttgttggccacataaatgtcttcttttgagaagtgtctgttcgtatcctttgcccactttttgatggaatttttttttcttataaatatgtttaagttccttgtagattctggatgttagacctttgtcagatgggtacattgcaaaaattttctcccattctgtaggttgcctgttcactctgatgatggtttattttgctgtgcagggattgttttcttgatttctttttcagatagttgtaagtgtacagaaatgctactgatttttgtgtgttgattttgtgtcctgcaacttaactgagtttgtttattagctctgacaattcattcatggagcctttagggtttcctaaataaataagatcatgcctacaaacaaaggcaatttagcttccgtatttatgatttgcaagccttttatttctttctcttgcctaattgctctggctagaacttccagtactattttaatgacagtggtgagaatgggtattattgtcttcttgaggaacaagacattgtttctcaactcatgagagtaattttaataagcactcaagtattgtcattcctgtttgacagtaggccgtattttgagtaacaagggtcacagcataacttgccttttggtgaatcagttggaaccagtttgccatttagttaaaataaacttttctttgcactggtattactagaagtaattgtgcttatttataattaataataattaaatatgcttattcttagttacctaaaaaattatgatattaatgacctcttggttgataatggctaagctgcctcagcttctccaatttagcaacccaagtacatatcagttcaaagtaacacaaattgaagcaattatgtatgatcacataggaatgcttctgattaacaaaatccagaggactggtctttgccttcataaccggaacacaccacatgcatggtttcacagctcttggctattattggacttacttattatattctttaattcaagaaaaattgtagcttcattcattctgttcttaataattttaaattctctttagcctcctgggaatgggaagggctagctggtatagtcccctgtatctcagatttcagttacacataaacattaaaggggcctgacttagggcgctctttgcctctgtggactggtggggaaaatccaggtgtgtcttaaattctaataatcatgaaaatcagaaatcataatgtttcaaatacaaatcttcatacatgggaaatacaattgaattaaacattttcttcaatgtaggagacatttgtcagataacagaggggattctcatttggctaagagcttacctctaagattcattaaatgtgtttagagcatattttttgtagtttgtagttattttatttttctgagttattatttggattattttctcttttatttatgtatgcatttgtcactgctccccagaggcacctcattttggcattgaagctaaaaacccattcattaaggttgggatggagtgggctttgatatagctagcatttgggaggtagaaaatagacattcgtgatcaaaaaagctgtaagcggttactataaactatttttaaatttctaagtattttaaatattgaacaaatgtgtagacatttgatgtgcatctatactgtgaataagaacttaaacttctaatattcacattaactttcctgattttataaattctcgtttatttttcatctgaacattgaagaatgacatctacataaagtaaaagcaaatgttagtttgaacacattctaccctaatagtgcatgttttaaaattgctttggcaggatctaccaatgtattggcacattctcttcatggagttcctcatgtgataactgcaacattgcacattataatgggtaagaattcttccaaagcagttcatattttataaggaaatgttgatttatataaggaaggccatcttatttccatcagactttaagaaaaggcaggttctttgtctcttagagtagagaaatgtttgactaaaaaaccaaaaggcaatgctttactatgtggattgcctgtcttttcaaaatacttgctttgtaaagagcagtaaatgaagttttattgtaatctgtacagaaaaaaaatattgtagtgtgctcaaaattataattttataaccagatgaagaacattaatgaatactccttaagtatatccaacactgatgtaggactgtaccaagactctaggactaggattatgttattaatgaaaaaacataaccagaaaaaaatttcagccagtagatgtctatagatattttattatccctattggtaaaaagcatataagctcaggtatatgtaacactaaactactgttaaatctgtgtttaccttgcctatctactttaacttcgtttctttgaccatgttttataggaaatagcaataagctgaaaaatttagtactctgtgtttcttcactagtacctgaacaagttaaaaatggtaattattgtagttataggtaaagggaactgaagagaaagtgaggatgttcatggtctacagtacctttagatattctcctataagccaataaatatgctctcttatgtttgctgttttgatacaagtcctactgtactcactgattaatatttaatgtaatattcaagggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaagtaagtctttttcttaaaccaaaaattgtatcccaggttcaatgactgttaataacaaatttcattacattttagggcagaagactgtgaaatatcatttttaccatttaacagctctgatgatgtgcaagaaaggtaggtaaaaactcaatgtaatacagataacctgtatctttaaagcataaaacattctgacaaacaattgatcagacttaggatctttggttatttttctaacatagtagtaaagaatatagaatcacagactcttacaggtcctagtaagcaaacaactactcactcagcctttttctctttttccttccttctttcctcccttccttccccctgtctctccctccctccttccgttctctttttcccttcccttcccctttctttcctttcctttgtttttttccctttctttccttttccctttcccttttcttttgagtgcctactatatgccaggcactttgaatacaacaatgcaccaaaaaatgaacaaaacacacagttttgtccctcgtgataattttggtctagtgtgtaatacaaatattaaagccatattaaagaagggttatagtctttaaagaaatagtacattattattccttataatactagtttacctttaaatgaatcaacacattatgttggcagcaacaaaattgtacgtttttacttactatctaattgaagaaagtatttaacatatataatgatgagttctctaattttctcatatttaatagatttgtgtgtgtctgtgtgtctgtgcgcgcgttatctgttttatgtctttgttttgttttctttcttttaggagggcacagggatctcccaaatctggtgagtcgaaaagtatctccttgagaactgtgccaggttctgttgacattttgttctggtgagggaaaataaccaatcactttcattacctttagactgtaatgatcaatggcaaatgatccagggtcagttcttgaatgtcagcattatggcaattccttgcctgtgttcagtggcacctagaggcttggcacctaataccaggttagtaagcatttttattgaattgttgatacatttcttatagaccattttttttccagggtatccaattaactgttggttagctagaaacttaacaggtagtttatctttgtatattagagattctaagggatttgtcatcacagtaggttgagaacaactgttgaactggaataattatcagataatcattgactatttaacgtcactgaggctaaaataatatttcctaagttttattgatagaattttatgcctactttacttgatttattcatttagttgtggagaacattatattaaatactgatatttcttgtgaatgtctttgctttccaactttaatgcaaacataaatatccttagcatgaaaatcacacatatgtatatttgatactgtattagtctgttttcatgctgctgataaagacatacccgagactgggtaatttacaaaagaaagaggtttaatggacttacagttccacgttgctggggaggctccacaatcatggtggaagatgaaagtcacatctcacatggcggcagacaagagagcttgtgcagggaaactcctatttttaaaaccattagatctcatgagacttattcattaccatgagagcagcacaggaaagacccacccccatgattcagttatctcccaccaggtctctcccacaacacatgggaattatgagagctacaagatgagatttgagtgggaacacaaagccaaaccatatcagatacttttagtcaaaagaaacatttcagttctatttaatgtgaatagtagtgcatatcaatctcctgcccacattttcaattgaataaaatatgagacatcttatatatatctttttatccatgggatatagacattccttctcttgcacattcttcttaatcagctgtccattatggggctgaaaatatttctttcctgaatccaatcctgtagagtgtaggagaaaggatcgtgagtgttgtgaaatataggcaataaacggggaaatattcaaagttagagaagaaaaaagagaaactgcaaacttcgatattgaaaacccagatggcaaggtcctcattaattacatctagtgctaaaacttcaaaggagtattttgaaccttgtgtgatttagaaattgagcctggtggttttccccgacaccttcagaaatcctagatagctgtgtgctttcataatgtagtttccctgactaaacttgaagacgtggctagctgaccaaggagctatgtttggcaggacttgagacaatgtttatctaaccctgtttgtttaaggaccttcttgggagggtagacctgctcttctgggaacaatcgattcatagctccttcaaagccactccataaatgttctgcttgactagaattccactgttgactctgcaggcttaatcagtattaatgaatttttcagagaaggatgactaattagagatttcttctgtggtttataatcacaacatgccatctttgcaaagaccttttgatcaagactcatttgaccggagatttttcagagatgtagcttctgatgattcaggatgattgaacaggagatttcactttcttctttttcccccaccatgataaataataatttatgttagaatatctcagtgcaaattgccagtaggaactaatattcttatattctaagtattctaagattaaatgtgttcatatatgtgagacatttaaagcagtgccagccatgtaagttgtgtttctatttcaagtaaatattgcaaagcaggcataggatagtgcttttaatgtttataaattatgcaattaaagatgcacagtaacactaccatgaacgttttggtgctgtttatttttaattgggaagaagaagcatgatggaaagcatactgagcacctggagtattggtgctgatgaccattttttctctgtgtgcctttgaacaaatcacttaaacttggagttgtcttttccctctacatgaaatgagcgaatgatgagataatctctaaggtcccttacagctctgacttgagctttcataagatactaagagctctttttttattttgttgttattcttaaattaacttcatgtttgcactgaaatcaagctagaagtcatttgtatgtatttctgcaaactgcattctatagcttgatgcatttgtgagtggctgttttggcactaaatcacacctctgaattttcactctcttatattggatggaacagttatgcaagattaaaatgttcagtcatttaactgaacatgtgtggcagcatttgttcactccatttcatccatccaaaggccactttgatttatttcatttcctatgtcacttagaccttctgtctataaataaatatttaaatcacactttagattttagaaaatgttgagctatttgttacacaacttgtgcatattaactcttctataatacatcttttaacaacatagtttcacatttagaatttctaattacattgtattttaaattatgtcttgatatgtgagtaggacgcttgatggtttgctttgtaaaatgctctaatgtaagagcttattgagaaggaagccagtgatttaataaaactcatttgaaagcctgcatcatttaaaaaatagcaagatacggtttatgaattttaggtaaacgtaacatggtgatttatctatcttgtccaatactttcagtaaacagtatacttgttataaggaacagtatgtcataatttttggtataatctcttagtaaatttcttgatgtctaatagaaatatttaatttcagattaaataatggaagtatggctcttataattgcccgaaacacttctcggccagaatttataaaacacctgaaaagatatgccagtgtaaaaaatcaggtatagtaaattctttttgttacttatttgcaaagctattaatcatgtagaaaaagatgctgcaagaattgacatcgaatcctgcctcataagaaggttttattttcttctgaatatattaatcttctttttcccaatctatttcatccaaattttgaaaagcatccgccaggattaatatagattggccttttttgaatgatgaattagtggttatgtatctgtaaccacaaagataaaataggaaatgtagtgttatattgcaatgtgaaataaattaaggataaaattccatactcaggctgttcttcagaatgaaaagaagtgaaatttgagagtttagccttcttgatattatggcagcagactttctaaagttatgatctttagatcttcctgacatttgtttgcatatctgcattgattgaaatagatctgtagatatgtatttaaaaatatgacagttttatacaaatattcattcaaaatgagaatatgtgaagatatacatttccacttaagtgatttgctttaaagagaaacagtaactattacaagccatattattttggcagctgttttgacctgattattaggaaaatgatccttgaactatgtgaatttctgaaattgtgagtctttgaagtacataggtatggttgtaaaaccctatagtttcacactttttctttttctttctttttttttttttttttgagttagagccttgctgtgtcacccaggctggagtgcagtggcgtgatgtctgctcactgcaacctccacctcccacgttcaagcgattctcctgcctcagcctcccgagtaggtgggattacaggctcacacctccatgcccagctaatttttatatttttggtagagacagggtttcaccatgttggtcaggctggtctcgaaactcctgacctcgtgatgtgtccacctcggcctcccaaagtgctgggattacaggcgtgagccaccacgtccggcccacacattcttaaaggtataaaatggtgcttggatagagttgggagataacagacgggaggaggaggagagtaaacccagccaatgactggcagctgaaccttgcttatgtaccttagccatagcaagtctctccatttttgcctcattatattttaaaactttcttaggccatcttcatgaagtttgatctgtcagtaacattatttgatcctcatgtattgaacaactaactgggctgcttaggaacttaaatcataaaaaattacagtcccactttctttatatgtcaaagtagatcagcaggtataatgtaggttgtgagcctacataacagttttatgtatgtgtttgggtggaatatggagatttattgattttcaaaggaatatatgccctttcacattttaataaatttctaaacattaaaaccaatttttaaaaaacccaaagcactatatattcattgctgtttttaagtcagaaaatagaaacaagaaaatgattttaaagcactcaaaattccatgttcctcaagattagtgtcattaccttggtagaattttttccgaatccttttttattaaataaatgagaagtaaagtaagtattaacctcattcatgtacctctatttgagaacttaaatagtattaacctattaatgtacccctgagaagttctgtatttattttggggaggtgtatgttgcacaaattgtttatggaaggtctcttttgaaattgcctatggggcaagtctctcaggcaatttttgtaaacattcttcttcttcatttttttaaatcaatatacctttcttctgattttaaaagcaatggttaccttacacataaagacagacatacagaaaataataaaaatctgtatcgataggaagacgttttctaagagataatattatgcaggatttatcatattttctcatgtactctacgaggcatatcttgcttttgacacaagaaacagttgcctgtgtgtgattcactggccttaactctgatttatttatcaactttcaaaaattaaaatccatgctattttttttttttttgcaaagaattctaaaatattttgcatagtgtatatagtaagaaagattgattcccagggtgactgctttcaagcaatgttaatttgatttgttaattatccacacaggtgtgtttatttaggctctttccttcatggtgacattaaaaatgtgaatttatataaattttgtaagattatgaaaatcagatctatgtaaaaatcatgtctactgcataattcatagcagtgctggtattcaggaaggaaaatgtggcaattcagtttaaggagagtaacatctgcttctctgaaccatttttaccaggttgaataagcgaatgttactgtataacactgtaaaatagattgaaaccaccatgtgcggagtggctcctgttccttccccatctctgtgtaaaattagatagaggctgaacactacccttcaaagtccttgcagctccatcctattgctttgccccccttctcactgtccacacttttctctttcattgtgaccatttttggtagggagtttaaaaccttaaatgtgagtgcttcccccaggatttctttgcagccctctcatcttctcaggatgccgtctcctggatggcctcattgcccctcacttttgaactgtctgaacatcatgcactcccaagggttctgtcatctcgtcttatctgcaggacctctgtcttcttgtatgctgaagaggttctgaaattcaccggcatctggaggccaacatgtctacagccgaccttatcttttcccctaaagttgttccttctgcgttgctctgtgcgggtcaatggcaccactttctacccatccaggttaccctgaactgttccttcttcctcattcctcactaccagtcccctaacttgttctgttggtctcctcttaaatgtttctaaaatttctccctcaccttaattcaaactttaatcctttcttgcttacagtagcctccttttggccttcaggttctctggtcttgtcttccatacctctttttagagaaacttttttctaagacacacattggatttctctcctgcttaattcttcagtgcctttctcttgttgtcagaataatatggaatatcctcagtctggaacacgtggcctttgtatccaggtccctgcctgtgttgcaaccccacctcttattaccaccctccaccacattcccagtgttttggcattttattcgttggctaaggttgccataacaaataccacagaaaagatggcttaaacaaacagaaatgtatttctttcatggttctggaggctagagctgcaagacaatgtcagcaggtttggtttgtcctgagtcttctctctctggctggcacatggctgctttctcacagcacccacaagtgagtggtctttcctctgttcatccccgatgccttttcctatgtccaaatttcctcttcttataaggacaccagtcgtattggatgagggcctaaagacatcattttagcttaatcgtctctttaaagatcttatctccaaatatagttatgttctgaggtatacagagcgaggatttcaatacaggaatttgagggccaaggggcatgatgttgagcacctaggagtcacactgaattctgtgtagttgcttgaccatggtttgcctctagttttgtaaatgcttcctctctccagactttcttctccaggctaaatcttatatgttctttaaggctcaattcaaatgggaagctttcccaacatccatagcctgtttgcctcctcttgtttcctctgttgaactccacacttgcaccatcatggcactcccctgtatcaaaattgtaactgtttacttctcctccccgtgccccaaacataccctcacacaggatactaagctcttggctcccgaaagtcccacttaacagcgtctgtggcttcacagttaaagcatttgaaggatggctagatcttcattttgtgaggagtgcacatgacaactgctgatttaagataatagacttactggtggtggctgtcaattcttgacattccttggcttacagctgcatccctccagtctctgactctgccatccttggcattcttctctcataaggacatcagtcatattggattaggtcccgccctaatgacttcatcttaagttgattctacctgcaaagaccctatttctaaacaggggacattcacaggtaccaggggttaggacttgaacatagttggggtggtggagggaaatataatttagatcataacaggcagttgtgtgttttaaatgaattatcaactaacatgaatgattatgtagataattctacaaggatgaggcatgtagccaaggctttatacccgaggtaggaggtctaacgcagttactgtcaaacagttttgcttggggccctctaattctgtacctcagtcacaacagctgatgccatcatatcatctactgtttaactgtgtttacagtataaactggaaagttggctggaccttggtatctacatatgtaaaatatgggtgttggggaaaatattagttttctgtcaacttttaaaactgtttcattgaggtttacatgtggaaaaggggaaaaactatgtagatgatgtttaattaggaatgtatctcatgtcatttttctgaaaactgaaatgagtagttatacatttctgctcaagttatttggctatattttcttaattatgtcagaaaatacatagtgctttttcagtatagtttccttaggcaaacaagaaaaaacgcaagttgaagtttaccttgcaccattctatagtggtaagtaaacagtgatcttgcagcttgtgtccattgttaaagtgggaatggggcaggcaaacaccttttaaaatccatatttgattggctttctcttttaaaagaagacatacatcccattttatcttcagaagtttagacttgcgttcttccaaattaaattccaagtgtgaaacttgtactagtttgctttatgtcagctaaactaattgacaagttgataatggattatatgtcttctgtatctacaggccagtattaaagattatctttaattgaaaaatctacagtatcactattttatgtaacttctcacagatatgtactatttgtcataaaacaagatttctaggtgctagatctaaaagaacccaaaaggctttggataagagattccttcttccaaaaaaacttggagatccctgttcatagtctcaaagctattaaaatgtcagcatacatgctgatatttacttgtgagagagggctcagtgaactttgattcgcgttagtagctagagataaaccaagtataatgattatttgtatttatttttagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattaggtaagtctatttatttcaccgcttattgtcaaccagtaaacataaatctaatattacaacgaaagctctcttctctgaactatcaaagcaggcagttggttagtttttaaaaaatcagtaaatcagggaagcataaagagacatgcacaaatttcaataaataaaaagcaactttacatttattcaactgttatgtagacccaaggcattttctttggttatgcgtgtctacattggctttctaatttattgttgtgcataaactacagataatgtctacaacttccattttggatttttaaaaatggatcaagatcttaaatcttttagtggagccatctgaatagtaaagtgttagatttttatccttccatcttagtttcctctcactcataattactgtaacatgttttgttcagtaatttgcttttattaggcctttacagagcattcaacttcccttgggaacaattttacatagcaactggtataaacaggtttaggaacctgcaaacgcattcttggtaggcattgtgacactcagtggttagaagaagcatgcaggggtgcccactagacatgggtgttctagaggcataactgactgttttacagaggtaatggagagcattggacaatcaaggaagtcagttaaggaggttttagagcaattattgttgttgatgatttatcaatcagaccttctcagttttctagattacagctctgttgggaatgctgtgtttgttatcaatttgtatttggcattggcattgtgtaccatacttattaggtgtatgtgaaaaacaacaaaataagttgatgaaataatgtattttctttacagattgcatccaagacttatcagtctttatggaggaagcatggaagaaatgattccaaagtaacatgtaattgtttctaaaagaaatgtacaaactagaattttaatataaagaaatgtggccatgctttaaacctgtggtccccaccctttttgggaccagtttcatggaagacaatttttccgtggatgggggaatggtttcaggatgaactgttccacctcagatcatcaggcattagattctcttgaggaacatggcactctagatccctcacataccagttcaccatatggttcgcacttctatgagaatctaatgctgctgctgatctgacagggggaggaactcagtaatgctccattgctctaacctcctgctgtgtggccaaacggatatcctaatagaaattgatgttactaacaattagcctctagggctttaaaagtcaagatgaaatatcaattcaaattctgtttttagatatcaattcaaattcttttttttacaatgtgtttattggacacacaaaaaaactttgcaaccatcataatacatcaatatttaacctagataattctgaaataatttggattctttcatttttcaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttcttaaagtggtagggttttaaaattcatgatacaagtaacaaagtaagttgataacaaatactattttgaactgggcaaaatctagcccaatatgtaattgtgttccccttgtatctgagaggcctgtgttggacaaccatagtactctgctttcactgtgctcagataacctgaaatatatagttgtttctgagtagttctgagtaggaaagaaccaaatgtaaatttccttagagaccatcctggagaagacagttctaaatcggggcttgatttttcatctatgatcctagatgttctcctgaaagaatgactagcctttttataacgatacaaagttttttaaaaatacataaatgtcataaagtttattcctgtgtatacacactctgggttcaggaggttttgtgcttacatttcactactcaaatgccttcgcaaatctcagaacattcctcaccatcactgcaggcctgtgaacagataactttcatcaattaggatggctggctagtggcagggacttcatataaagaaatctttcccagaattgtttttccacattgccttctaatttgatcactccctataacagatgttcaaaattcggccacagctctcttatgaaggcagagtcagataaaatgatattctgcaattatctagatcataagcataaaataaatattacaaaaatgattgtatttaaagaaattttttaaaatccagaaagtcatttaaaatagaacctcatatagtatgaacaaactataaaaatattttacatttca

SEQ ID NO: 10 - DNA, 145347 bp, Homo sapiens
  mutation 91975: a/c SNP in forward strand
attgctatttgggcaacaatatggctccttcagaactggtcgagaatttctgtggtctttgcttgaccttcaagttgggagtttcaaatcagaggctttgaagtctggaggagttcgcagccattaatccttccggggttgtgctaaaggcgtttctagaaagagatcggaaagacccgttcagcacaggcccattgcatcttctctttgaaaacgcttgtctgaatcaagtatcttatacagacccgagactgaggggagcaagagcgcaggtccggctgtggcgaggtgtccaccaccgtacttgtggtcaatgcctggactagagagccgaggccgtccagggcgggctggccagggaaccagaagcgtccctggactggctgagtgagggtgccctttccagcaacccagtggccatggttaaaaggcagaatacaaccgtcaaagaagtccccagctcccacataagagagcgcaaaggccaatggaaccaaggcctcctcgcgagaactagctcgctttgaggacaagatcctggggatggaggtggggactgacgtagtgagagggtctggaggaacagtcgtagctgaaggtcaggacatgaagaattgcacgtatggtagggatagaatggcaggtacaacttttctgtactgaaggaactgggagaggacgatccggttagggaggttggggaactaatctcaacgctgcgtttacagatgaagccgcttttatatggcgtatatgtttgcttagaggggccgacggagattaggagaagccatcctttggcgccaatgatcaaagcgtctgccaaggagaagaagccaagggatgggcctttcagagagggcaaggagtcatgctgctctggatgccagtgtcaggacaagaaatcgaaaggagcgaggactcttcactgcgtgcctcagtctccccgcttctgcctctttcacctctgtcctacttccggcgcgaaagcaggccactcgctctgatctagacctagttaacattagcttttcccttccttccctcaaatcccctcccccctctatccccgtcccttctgccgcctgaaagggttaatctctcctgcgggtaaaaacaggtccgcggagtctctaactggcgacagatgggccactttcttctggccacaaaggggccggaatggagcgctccgcggcatacaaatgggcaggtcacgtggttccaggctcttggctggaccgggaagaccatatggcgcatgccggggaggaaggaggaggggcgggggtaggggtggagggtgaggggagcggttgtcggaggagggcgggagacgagcaaggcgtggggagaagtggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaaggtaattacagttctttcatttttttgccccagaatagaagcaataactgaagactgatgaacctacatattctgtatgtgtgcgtttgcgagagtgtgtatgtgtattgagaccagcatccccctccataattgcccataagtactcacacataatgagtcgtgtcactcaagtaccccctgcaggctttctaatttaaattttaaaaatttgggtttcttttgtggatagcataggagcttcttggattttttaaaagaatgcacggtaactatgattatctgctagtgctgattttaaagtcccaaaagcaataatgacttcactttctcacttcttacagtaagaaaaaaaaatctatgttatcaatatatattttgtgtgcatgtattttacgcacattgggagtgtcaagctgtgttttcagtgaatgaaagggacatggataccttgagtattcacaccatggaaaataaatcaggttcagagatagtttagttgagaggggggaaagtggagaaagggagagggactcactcctgctacctgttaccgctccagaggcggccaagtccccagcagccactactggagccagaaattcagttgttttactaaaggctttttattttccttactagaagcggcaacttcgcggttgccaatcgctgaccattataattactcaatcttttaaagggaggtttgaggcgaactttgaaaagccccaataaagagcgggcggccctttcaatgggctgtttattagagaggagccttccgcacctgatccccggcgcgtgggagagcgctctgcgccgcgcccccagccctcgccctgcagctagcgcttttgtacaaggtggaaatttagcggtgggccagagatggaaggcaagaaaagaaaggcgagggaggggtggaagaccctgtccacttttgttgccaaatgttacattgatggtgaaacaatttggtggaaactatttttcctcctttctgcatttgcttttcagtatcccgtcgatgtaatcttcttaaaaatcgctgccagtattagtaaattacgcaatggctgttcaacttaaatcgctaagtatctggaagccaggacagaaatggaagtagaatgtgtgattttacagcttttttttttttttatggagttgtgagtaactttgaacacatttggataaacatgaagtcgctgaaatgtacagtcatttccacacacattatcctgtcgggcaaccaccataaacacatttaagttaatcactaggatacaaacacatatgcgtgagtggtgtacacatatacatattcactaccctcccccagtcctgtcctcactcctacgtactagcggggcacacgcacgcgccattataaaacactgcatttaactttttctcagaggcattcattttgtaatgggcaggtacttttcgcaagcatttgtacaggtttagggagtggaagctgaaggcgtatctggcttttgaatatagcgtttttctgcttttctttctgtttgcctctcccttgttgaatgtaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaaaccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtgagagcaattgttgcatttcttcttaaagggattctgtttttatttttggggaaagtagttgcttttttgctgagttaaaaaatactaaacactatatgtagaataaaagaaaagaaaaaagtttaccttggcatatgctcttgtctgtttatcttgcacagggagtcaccagttctatgtagataatgaaaagacctaactgatatttcattatttggaatatgggactggacggcagtacaaacagtgtgtttttttctttgttttaagtggcttagcctttaggttttttatttccatttttaaaaatgattgttacatgttttcttctatttctttttttaaaaggtggattttaataattattaacaagcaagacataaacaagtatcctagcttagtttgtctatacatttaagatgtataaaacattactattttcttggtcttctgttatctgtacatttttctgaactaaacagttttatcttgcaaactagtactgtcccagaaaaatttatacacctttaggaagtaccaaagggaaatgagttaattaatttaaagaatccaagagaagtaacattttataattgttctattaacatcttgtgatgatttccatcatttttccaagaaaaagcataatggattatttgtactgaagaacacactatttgtactgtatttaggaaggtgtaattatttcctccccccaccctttggggcactattctgttgtttcatgaacacaactcactggaaaaacttatggatgattctgtctattgttaagtccacttcaaaaaaaaaaaaacagtttggcatttcttttcctctggatgtattgactgacagtcatgattcctagggaatatcattttggcacttgtgccctggctctactgtggtgctctgattactgtcattagtaactccattgtttctactctgattcgggtgccacattggatgactaccccccttcccaagcttgttcctttaatctccttctcattggtgatttaggggttccagaaagctgacctcatttagcaagctgctccagaaaaatgtgagtaatgtaatggacaggaacaattagccatactaataacattgccaatgaggctgcgtcaagctgtgacagaagcagtaaggaatacttcgacgttaaaaaaatgtttgagagcaatttaaaatatattattttaacatgttttctatcagccttcatcacatgacagaaatacttttaagttagtcccaactttatctaaaatgcagcaatctcattccaagtgaatcagagttgttattttggaatcaagctgttgctttctatatcctggattgttctcactgttcttactttaagagacataatactgatatgatacttgaatactaccagccttccagtgtaggaggtaatgaagtgagcattcagatctgatctaacctattaagtagctcaatttcacctgcaattaaaattagacatcttcatgcaaactaaaatctgttgctgtagtgaagagaagaaataaaagaatgccattttgagaattccagcttccaaaatagcaaacagggaaatctagactgtgttcttttgtaaggtagaaatgaagactaaaagttaggttttttttttttttcttcccattttgccaatacaacttcattctaaaacatagggattctttcagtcagtcaaggagtaactcacatgccaccatcttttattcaaaggcaggcacagatgttccttctgcaggggaggatttaatttatgaaaatgatattgtttatgcatgaatgaactgcatgcactctgcataacacatagcacttccatctgatcagagaaataccacagaaccagtgccaatgtcagaaacatattctacaaatttactcacttaaatgtttaatgaatatttggaaggcattttcaaaccataagaaacattttaaattatcttcttttatgaattcctacccatatttaaaagagactcttacagtttttgtaattggctaatgcttatacccagtttgtaagaaaagaacatattttactaaatgaaaaccaaccaaaaaaaaatgctggcaagtttggcttcactggaaaaaatatttcgtttagttttgctgtttaatgcttgtcatgaataatatttgggattctatctgtttcttcatcttgagccacgactattcctatcaaataagatgcttaggtatacttgtttaatgtgaaaatcctatgaatagttatttctagaaaaagctggtatgtaaaatcagggggaaatttcataaagatgaaattgggctaaatattgtaacatgcataattactattgaataggaacacttcacataacatattttactttatataaccaattgcagctatatagtatgatctatctacttttaatcattaaaacaattatatataaattaaaatgaaagattataatatcaagagtgttctactaattttaggtttataatatgttacagtaaaataccatttgaaataaattttgtgttctaatttatcttaaaatctctctgtttttacatttgaaagtccttacattcttacaaaattaatgcattttctgaaagaagctagcaattactaaaatgatatatggatcattagctaacagtttgaatcaagctgttttagttctataattatacaagaaatttaaagtgaaaatacctattaagcaattaataaaactaggtttcaaaatattggctaattttctcctaatgggaaatgtaaaatagcaaaactgcttcttaaactacacaaaaacctcctcacttctccttttctctctctctaacaccacttatttcctgaaaatcatctaaataaaatatttaattccagggtctgatgaagaataaaagagccaatgcaacatcttgtggaacaccaggactgagaactcttgttgttaccattgcaaagaggcgttctggcgtcagatgcacagtgatttgtatggtggcataatcattggctcctggccaggcattatgtttcagaggacactattgtcaagaaccattcaactagaaatctgcactgtatgcactcaaaagttgagatcatctgccttcctatgacaggaagaattctgtgctggcaattgactcatggactctcttcacatacactaaggcttggtccagtggctctgatggaattaactgtgcagccaaactagtggcattgacaagacagggccacagtctctggggacttcaggagaaattgctaattttaaaatgcagagtattatgttaatgctggattaaatcttcagatacattaaatgtggatttggccatctaagcattattatgttatttgcccagttaatttagaggtagatggatggtgacaataaccatctctacagatccacaattctaagagatggatccaattgtgaaatgatatggagagatagagtaagttcaatctagcatatatgaagtaatttggtaactgacttttcttttaacaagatcaaaagctaacctgctttacactttcatgtctaaggacagccaaccagagagatggcttcacacactagcccactgctaagtgcttttcattcactttcatatttcatcatcaaagcaccctcctgccttatttatagatggggaaacttcaggaagttgagatacctagatatttgcattcctgtcttcctttcttcattcaggtttttctttcattgccacttcctcaaagaagcttttactgattcccatttaaaatagcaactgacttcaactccaccaaaatcactgtattgcccctccctctttccagagcatttgcctatcaaatgttatcttatgtatttacttgtatagcttaattttaaactatctatctctaggtcttctgagcacctgagaaacagagacaaagttgtctcttctgtgtgttgctgttcctctggtgcttagaagacctagaggatcctcaataaatattaactttccaagggaactgaagagcactaatgtgatgctaaagcctgttgccttaaccactatgctataagtcaaatcagttgagaatggagaggaccacaaattattttcagtccagcaagtgttataaacattaattctataaaaagaaaacaattgaaactaatttcttattatattgcatggcaccaaactccccccacttcctttttgaggatcatgagttgtctgtcattgtttctttttattgatatcaattggttaaatataatctggaattggaataaaagaaaaactattataggctttttccagaccatgtatttcaatgcatattattttttcctttctgttcattattctttcagtaattgcacttgttctatttttagtgttatgtaaaattactgtagctcataatttctattttgaagggttcagtgtataaacttagcacatcaatactatctttttagtgttcgcgctcaatggtgtcagttaagagatcaccatcacttttggtgacgtcaatgaaggggtattgcaatgcttaagagaactgttaatccctttccactggtgtcactaacaattgtagtgcttgtttattcatagcaggtacgtgactaagtaatgttaacatcaaagcagaaagaggataatagagtgttctaaaaagaaaattcggtggttgggtgcagtggctcacacctgtaatcccagcacttttgagaggccaatgggggtggatagtttgagcctaggagttcaagaccagtctgggcaatatggtgaaacctcgtgtctacaaaaaatacaaaaactagtggtgcatgatggcatgcatctatagtcccagctactcgggaggctcaggtgggaggatcacctgagcctggggaggtcaaggctgcagtgagacgtgattgtaccactgtactccagcctgggtgacaaagtgagaccctgtctcaaaaaaaaaatgatttgagataacatcacttgtcattgtttgttaactgaataatctttattctagccagtgcctaaatacataataaatgatagtacaaatggatataaattataactaaacctaagtagtgatatttatcacaatatttctttactagaagaatttctttgttaatagaggcaaggctacttgtttagataccttaaaataacataagatttttggataaataaattaatgattctttgattctgactggcatattaaaaatattaagcgaagagatctttgcttcccaggttttattttttgtctaattaactactggtgcatttatattaaaacatattgtcaagggaaaacgtatatatatatatgtgtatatatggtgtgtgtgtgtgtgtgtgtgtgtgtgtgtgcacacatatgctatacttggttgagtagtatccccttcccttgcccacctctctcccaaatttatgtccatccagaacctcaaaatgtggcctcatttgaaatattgtctttccagatttaattaagatataagatgtaaattgatacaagttcatgctggattacggtgggccctaaatccaatcactgatgtcctgataagaagcagacagaacacacagacacacagcatacaggaagaatggcatgtgaaggcaaagacagagactggagtgatgtgtctacaaatcaaggggccccaaggatttggggcccacatcagaagctgggaaagagacaggaattctcagcttctccttctgaatccctaagaaggaatcaaccctgctgacaccttgattttaaacttcttgtctccagaactgtaatataatacatttctgttgtcttaagctacccagttgctggtgatttgttatggcagccctaggaaactgataggtatactaaaatctctaatgaattgatgttaaatatatataagtataggagagttcatttaaattcttctgaaaatgtcttcttaaacttttaatgatacagtatataacaaccagtatacgtagttggtatcgggtttgacatttaaacaagctgacaaaaaacagctgtttaataaacatctgaattatataaaagttttattgtttattattcatgtgaatgacttaaactgacatctacatttagtgaagtgtgaatgggcctagccaataaactatgggtaatttttttaaagtctcatctttgaactcacaaaaaattatcaaatatcagctattatgtattcttcatgtgaagaaaatgtcatatttatttgatttgtggattagcatatatattaatagagcttttgaaagaacaaatgtagcactttcccgatttcatagacactcatttaacacacaagttcatattttaaagtacataattttaaaaaaattctagtccaaatgaatttaagtgccatgacttctaaaaattctgtctctatttttgggttttataggaccttgagccagtactcttctggtgagcttaagaggctaagacttcacctttagttatatggggctttcatctgattatttgtctattttgattgctctaaatacaagttagtgtgtatttcatctgaatgtatttcattataagttttggttttatgtagatctggggatctgtcttgtttttaatcttgattggtctgtttgttttgggatagttggtactttcatttcttatgcttgctttctttttcattttgtgcccacctttagtcaggtgaacatcagtaaggaataaaattttatttttttaagccactgaaaaaatttaaaaaccacatcataactctgcctctgctgactgataaaaatgctaacttattaagacaaaatgttatgcaagaagactttattggaatagagaaacatcctttttatgtaagaaatatcaacagagacatgtgcctttcttgtgacaaatgtggtatgtgtgtggattagaggtctggaatgtggcagcatttcagtacttggaggggagaattagagtagggtagaaagatagacggggagcagaggatgattctcacccagtagaaagcagagtgaagaaagaaaggggaattgttttttgcattatattatttgaactgtggattaagtctttccataagccatccctacgcctctaagtaggttttattaacttaagctggtttgagatgggtttttggtcacacacaagaattgcctgatacaagagaggctttgattttgttgttgcttgctcatttttatacactaagatggagaaaaccctggacatagtgaagacgaaattgaggaaggtgttgggtagagtggagggtagaagacctgtaacataggtacagaattacattaaactggaaggacttatatccagatataggagtcagggtagaaagagagaatgttagcagtaagggtaacagagtagcagaagtttattcttaccaggtcctgttatgtgacagtggaggcatgttgaccttctgactaggggagttaaaggagaacactgaaggtttagaataatgtctctaaggatagaaagagaaagtttcatcaagactcatcaataatagggcagcagggcttagggccaagcaaattcagagaccatgatattatagtagtttgtagtggtcttaatccatctaatttttcagcattttctcaatggccaatacttagcagtggtagtgttttatggcatttggacaacagaagtgaaagcactggtaagagagacgttgaagtgaaacaccatggggctcagaaaagcagagttgatccatctggtacatgggcaaggatggtcctgaacaattctgcagtaagttggaagatagaaaaaatacctaacgaacttgtagatctgggtaaggagatttttggcagaatattgtaaggctaattggcttctcttaactatatgagatagggttttacaagggagagataagcgagcataatttagaagaactatagggggtcccaggcagactctctggctggaaaattattctgatagcaagaaattagccccaaagcaaagatgaaaagtagggtacttccaattaaacatgtcataagggcaagcctcaatcaagagtgtggctagaaggcacagctcacctggacaaaagtgcttctaagcatattaggagcatataccacaataacctgacttggacccaaagttgagagaggccagtctcaaaaaaatttgagggaattgcttttgcataatatgatactttatatacatatctgttacatatcatatatatcatattaaaaagaaaaaaaaccctgtttttccttccgttctttcatataacccttctgacaacaaatgtggagtttttcacacactaagcaattctttagttcttgctggacacttcctggatgtcctacaattcaactcgattctcacacaactgcccagagtcagtgcagacccgcagattaaaggcttagccccaaaagactaccccccactttagatgtcaatcacaagtctcaacttcatttacttctgaaggacgagctatacattggaggaaacccctctttctttcaataatttgctagaatggctcacaaaactctgggaaacatttacttatggttaccaatttattataaaggatataactcagaaacagccaaatggaatagattcatagggtgaaaaatgggggagaggcatggagcacaactctctcagcacctccatgtgttcaccaacccagaagctctcagaactccttcatttagggcttttatggagctttatcaagtaggaatgattcatgaaatactggcattggtgattaacttaacctccagcccctttcccctccctcaacattgggggtgaagctaaaagttccaactctgtaatcacagggtgagcttccctggcaactagtcccctgatccttagggggcttctgaaagtcacctcattatcataaactcaggtgtggttgaaagggatgttttgaataacaaaagatgcgcctttttcctttatctttctgagttgtttcaggagctagggacaaaagactaatactataacaacaacaacaaaaaattcaatttttgcttttatctcttgggaattacaaggattttaggagctctgtccagaagccagtgatgaagatcaaaatacatatttcttattatatcacaattcacacatgtacatgatatccgtaagataagtgaactacataaagtaagctcacaaagtttctgtaggagttttgtccatttacaaacagtttgtaagctaaaagtatctgtgacaagcctcagtcaatttagaagttcatttttccaatgttaaggacatgcctgtgacacagcctcagaaggtcctgatgacatgtgcccaaggtgatcaggctacagcttggctttatacatttagggagacataagacatcaatcgatacatgtaagatgaatattagctcagtccagagaagcaggactactgaaagtggaggcttgcaggtcacaggcagattcaaaggttttctgattgggaattggttgagttattatcttaagacctggaattaataaaagggaatttatcatgcagatgaagctttaggtagcaggcttcagagacattagattgtaaaggtttcttatcagacttaaaagagtctgttctaacagtctttaggtctcagtgttgatgttaatgctggtcagctgtgcctgaattccaaaagggaggagagtataatgaggcatgtctgagtcccttttcccatcatggcatgaactagtttttcaggttaactttggaatgtccttggctgagaggaggggtccattgagatggttgggtggcttggaattttatgtttggtttacaagtttaacattaaaagcctctgtacctccaatgttttatggacaaaaagaaggctgaaaaagctacttggctgtaatcatgggccatttcttgctgaaaagaagaataaaatggaggcagaaccaaaagcccagaggctagagccaagagctgctgagaatgatgaattagggaaccactctcagagagcagatctggatgtgagataggaacattttctttctcagggtctatgaaactggcaacatatgctctcctgaatttcagaattgctatggaccagtgactgtgatatgctttctatatttttcccttttgaatgggtgcatctatcttgattatcctctgtctcattattgtatgttggatttgtgtgggacgataacatgtgtttttagttcctaggttcccagaataagaggagcacactcaaagagcgacatttatgagatactggatttttcacttgatatcataattgggtgagacttgaaagaaagtgaacatattttgcaaatgggagggatgttaaccactgacaaccacacccacagggtccactgtattagcctatctgcaaagacggctgccaaaaattccttctgtccatatatacattcccttttttaatgtgactgtttcacctgccagcaactgaagggctttatttccatttccccttgtgacttgtttgactaacagcaagaagcaaaagtaatgctattccaattctagacctgggccttaagaggcatgacagcttctgcttttactctcttgaaactcaatgtcattttttaaaagctcaggctagactactcatcatgagggaccacatgaaaagagataggcccagctagtttccacccattccagccgctccagatgagatgccagacatgcaaatgaagccatcttggatatttcagccccagctgagcttccagctaaatgtaagtacattcagttgatacctcatagagcggaactactgagctgacttcatccaactcacagaatcataatgaataacaaatcattgttgctttaagtcaatacatttaaagtttttttgttatccagttgtagatgaattatacagcctggggggaaaaaggagatagcacactgttagttgcctcatcaatattcatccccaaattctttttcctttttagtaggtctcacctcccacctggaagctgaaaacacctttcccagtctctctggaagctacagcacaggcatgttgcccaattctaaacaataggacatgataggaggtctgctgggtgggatttttgaaaatatttttttttctggttaagaaaaaagaaatgcccaaggaaaacctacaaatgccccttccattcttgcttttggacattttttgggagagggtatgatgcttagcactcctgcagccatctcggggccaacaatagaatccttgttgctacctggtgatagtgaagtagaaagctacaaagctcttgatttcttttcttttttttttttttttaaattttattattatactttaagttttagggtacatgtgcacattgtgcaggttagttacatatgtatacatgtgctatgctggtgcgctgcacccactaactcgtcgtctagcattaggtatatctcctaatgctatccctcccccctccccccaccccacaacagtccccagagtgtgatgttccccttcctgtgtccatgtgatctcattgttcaattcccacctatgagtgagaatatgcagtgtttggttttttgttcttgtgatagtttactgagaatgatgatttccaatttcatccatgtccctacaagggacatgaactcatcattttttatggctgcatagtattccatgctgtatatgtgccacattttcttaatccagtctatcattgttggacatttgggttggttccaagtctttgctattgtgaatagtgccgcaataaacatacgtgtgcatgcgtctttatagcagcatgatttatagtcctttgggtatatacccagtgatgggatggctgggtcaaatggtatttctacttctagatccctgaggaatcgccacactgacttccacaatggttgaactagttcacagtccaacagtgtaaaagtgttcctatttctccacatcctctccagcacctgttgtttcctcactttttaatgattgccattctaactggtgtgagatggtatctcattgtggttttgatttgcatttctctgatggtcagtggtgatgagcattttttcatgtgttttttgactgcataaatgtcttcttttgagaagtgtctgttcatgtcctttgcccactttttgatggggttgttttttttttcttgtaaatttgtttgagttcattgtagattctggatattagccctttgtcagatgagtaggttgcaaaaattttctcccatgctcgtgggtaggaagaatcaatatcgtgaaaatggccatactgcccaaggtaatttacagattcaatgccatccccatcaagctaccaatgactttcttcacagaattggaaaaaactactttaaaattcatatggaaccaaaaaagagcccgcatcgccaagtcaatcctaagccaaaagaacaaagcttggaggcatcacactacctgacttcaaactatactacaaggcttcagtaaccaaaacagcatggtactggtaccaaaacagagatatagatcaatggaacacagcagagccctcagaaataacgccgcatatctacaactatctgatctttgacaaacctgagaaaaacaagcaatggggaaaggattccctatttaataaatggtgctgggaaaactggttagccatatgtagaaagctgaaactggatcccttccttacaccttatacaaaaatcaattcaagatggattaaagacttaaacgttagacctaaaaccataaaaaccctagaagaaaacctaggcaataccattcaggacataggcatgggcaaggacttcatgtctaaaacacgaaaagcaatggcaacaaaagacaaaattgacaaatgggatctaattaaactaaagagcttctgtacggcaaaagaaactaccatcagagtgaacaggcaacctacaaaagctcttgatttctaatgacatcatatgggatgaaccaacccaggaacagcctgactctggacctcttttaatgtcagaaataaaatcttatttgtaaaccactcttagttgttcaggttgttgacacaggcactgaagtgcctccaaatggtgatgaataatgaggcaaaagtcaaagacagcaagtctagtgtcaaattttttgatgcctatgggtaagaagttcaagaaagtgagctattttctttctttttaaaatttatttttatttttgtgggtatatagatgtatacattagtcagctattttcaatagtgagaagggatgttgccacttagtataatgcctttttcatagctatcatagaaaccatatatacatatagtatagaaaatgaggatagatttctgacttaaactgcctatttcatttgtgtgcctggttacacctaattcaagactctacaatacagcattgctagcaattactgtgagaatatttcaagctccctatttgctggaaatacatttcatttttttgttccaagtttatgaatattagaacctatctaaaaaggagcttttaaaaacttgaggaaaggaaaagggagggcctacttttcttgcctgtgttatttcttgttactgctgattgagatgctagagatcatattgggtgagatgtgtcttagaatacagctgagcaattcacttttaacagtttccatctgagtacaaaaaactggtatgtgcagaaaacttgatattctgacttggcgggattctaggatttgttctatttttttctgtaattgttgtagggacatatggccctgtaccttttgggcagcaggagccagaatagcaggaacattctgacaaaattcccactcagcatgagagggaagcagtccccttgatacactgatgatgtgcccacttagcattacaagtgtttgagaggtggacacaactaaaactcacctcactcaaaatatatattgacacggagaaagtaaatacaatttgctgttattaacctttcttctcaccattgagacatgttaaatatctgaaattaataaaggaattaaatttaaaaagtttacttatcatgcatttaacacatttattgagcatctgttatataaatgcactgtttcaggcacaagagatagagccataaataagcagattaaatcactattctcaactgaggtactaatctgatataagagaggagacagaaataagtaaacattataaatcaactacatacttttacatggtgtaaagtgcaattaagaaaatattattgaatagaggtcaattttggaatggttgggcagggaagaccttctgaggtgacaagaagttggcctgggcaccatggggagctctaccatggtgaaaagtgttccagacagagtagacagcaacagcagaggccctaaatgagaatgcacttggcttatctggagagtagaatgaaggccagtgtggtaggacacatactaataataggagaaaactgatagaaaagagggtttgagcaggtgggcaggaattggacaacatggtgtctcatatgtcataatagaagtttggattttattctacctgcagtgagaagttcttaataaaaaaaaaattctataaactggagtttgagaaagaactatgttgatgatagcataagccctcaatcacttgtcacataaactccaaacttcagcagagactcagggagatcaaagggactaccacaggattacccactggctaaaattcagatccatggcagttggtcctgactggaattagacttccttgtctgttgccctcattgcagtgggtctgaatgtctctgtcggctgtgaatttttctccctctatctgtggcactgagaaggtggcccagacttccagagtctgtctcattggcctattacttggggatttgctgcccttcttctggaagtttgggtatttgttttcagagcatacttaaaggcctcctgaaagcaatgttaacaatagcaggatatattttacagtcttctactcagacttggatttttaagaaccagggatggagactgtgtttccagatctagtcaaatcccttccaaacataaagcaacaaagtgccttttaaactaggacctgtactgtttaatgctctggaaacaaatacccaagcttcagccaaaggagggaaagctatgttcaggaagcttcctgaaagttttttgaaagcaattttcatgcattagtattttacatatatatatatatatatatacacacacacacacacacacatatatataaacatatatatatatacacatgaatcactaatgagacaattgatcttcaggaactaacgtgaaataattggggtatcttggtattattgttatagataaatgttgaagaagttcattctttcagatattaattgagcacttactgtgtactaagaactgtgatagatactggggatttaatggtgaacaagataaattctctgccatcagggggcttatattctaacaaacttaaaatttactgagtgttctctgtatttcagtattgttactaagtacactaacttagtggggaagctagacaataaacaaagaagtatgtaataagaattaatagtaagtgctgtaaagaatactaaagcaggttatggtagagagattaatggcagcgtgaagatgtccatgtttcaatccccagaacctgtgaatatgttaccttacatagcaaaagaggctttgaaaacataattaagggttatctgggcaggcccaatgtaatcataagagtccttatctaagacgggggacaaaggtcaaagacagaggaaaagagacgatttaaggatagaagcaaagaggagagatgttagactgctggctttgaagttggaaaaagtgaacatgagccaaaacaaacaaaacagaacaaaacaaaatccacaggtgacctttagaaaaggggtccccagtctctgggccatggaccagtacctgtctgtggcctgtttggaaccaggctgcccagcaggcggtgagtggtgactggtggacaagcaagttttaccacctgagccctgtctcctgtcaggtcagtggcagcatcagattctcatagcagcctgaatcctactgtgaactgcacatgcaagggatctagtttgtgctccttatgagaatctaatgcctccaaaatgctcaccccttcaaactgcccccatccgtggaaaaactgtcttccacaaaaccagtccctggtgccaaaaaggttggggactgctgctctagaagccagaaaagaggagatatattttcctctagagcctacagaaggaatatataggcctgctggcaccttgattttagtcctgtgaaactgattttggatttctgacctccagaaatgtaaaacaatgcattggttttgtttcaagtcactaaatttgtggtaattagatacagcagcagtaagaaatgaatacacaggtttacaggatggtgaattatggagggtgctcaggaatggcctctttgaggtggtggcctttaaacagaaaaatgagcaaagtgaaagaatgaaccatctggtggggagaaaagcattccagtcagagggaacagcaaaagcgaatgctctgagaagggattattcttctcaatgtgtttgaggactggcaagaaggctttgtgtgaatgagcaaggggaaaaagttagtaggtgatctcggagacatagccagggtccagattataaaggacctctcgccttgctaagcattttgactttattccaagaataatgggaagtcaatggaaggctgtgagcagggttatatgctctcgttattttttaaaggcacaatgtaactccaaaatggaaaattggctctgggctggaggtgccagcacaggggaaaccgaaagcagagagctgggttgggagagcggagactgaagttgtccagctgaggggtgcagaagtgcagactgcaatgacagcaggcagaaaggactatatgttctagacagaatggacaggatttgctggtagattggattgaaggcatgagacaaaggagacatggatgatatcaaggattttgatactacagatttgaaacattctgagagggacaggtttgtgatggaaaatcatgagtctggttttagatatgttttagaagcttattggacagccaagtagagatgtcaggtagggagctggacataatacctaaagttcaggagagtggttggagctggtgacatcatttgcagaaccctggatggtacataaagcacgggacagtgtgtggatagatcctaaagagagccctagggcactccagccctggaagaaggcagcttatcaaaggaaaaagaaagaaagaaggaaacacaatccttattacttccatcttcaggacaattcaaagccagtgtttttgacttcctggcttgagtgaagcttgaaaaatggcaacttgcccctttgcaaagctcctaaggagtagccattggcttggcctgtttgcactggctctgggtgagcttttaaaatgccagtgagctctaattgtgttgattgcctaacagctgtgaatacaagatgctgactccagaactgcaactcattctgcgaagggcaccgtccttttccctctaatgactgctgaacagagccacctgaagcctgcatggggtttagcagcagctgcacttctgctctaagaaatagctcactgcagtcagatcaaactgaagctcttccttgcttttcctcgaagcttgggtacttattgtcggagcattaaacagtaagagtcctagcttaactggtgcacagtgctttatgtttggtagggatttggttaggcctacaaaccgtctgagctaagaaccttgagaaactcctgctatagttagctctttctgtgactctgcagtgtgaccaggaatgaggacagaattaagaatttgctgcctctatgatagaactgtttaggcactagaacactggaactagatctacaaccctatgaatttaatttccttttcaactcccctactccttcttttcaatatgatgataatgatcttgtttaaaaaaaaaaaaagccttctgctttacttcccactctgctcctcttcccagggactcactttcttcttgactgcttccccattacaagtactcagctccctgttttatcaccctgcttagagcagccattatcagccttggctgaacattggaattacctgggaacttttaaaaatccggaagtctgggtctcgcctccagagattccagcttagttgtcttgagcgtggcctggacatttgggttttcaaaagttccctatgtaactttaatgtgcaaccacaattgagaatcactagcctccagactctctgtgttatcaaaattaatgagcagctgattttagaaatctcagttatcaggagaaaagggtgaacccccccagggctcttctccttttccaggtgacacttctttatggcagtgcgtgaaagtgaagccctgctgcttgtaatctccctcaagggagtgcaagatccaggcaaagacaagactgcagaggcgctaccttgggggaaagtaggaccctaaatacttacacctggaggcacttacctttaatactgaatttgtcagatgcaaatttgtctatgcaaaccagggccttatctctagcttcccctcaggggttttgggaagtgcgctactactctgaaacagggttgtaaagcgtcacctgtgctctccagggaaccctctggaaaggaggtggaaaaacagaggcttccacccttgcaactctaagtgtgttccttggccagtgggatccatcacctagtattttcttagatatgtggtatctgggggccagtcccacacctatgcaataagaatctccatttgaacaagatgcccaagcgattatatgcaagtttaagattgaggagggctggtttaactcgagggtaacgaaaagtacgaaatcgtactttacaggagaagctaggcggagggagccacttattcttcctcttgcagctgggtctttttgtggtgagtggcgaagcggcgaggctggcaggccagggtgctggactgggtcaggcgcggccccgcctccctcctgggtccctgccctgcgcgccgttgctgtggcagcgctggacgcggctagagctggggctgccgcgccctccacctccttctccaaaggcctccccggacccctggctcgggcccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgagtgcccggccccaagcgtcttcgcctccctccgcgcttcctccctctccccggcccaaggcctacacccacgagcttttgctccaccctccccttttctcgcctcccctccccgtgctcgcctcactgcccggacaggttaccgagtccccaagtcgccgcctcctccttcccaactgggaactcacgcctctcgccccatcccagaacccccagggattctttcgctacctagccttttcccgcctccgagaccttccccgggcaaacgtcacaagcagcttttgctcagagtctcagcagaaaatcttgagccccaaaggggaggtaatttacaaatgtgagaaggtcaactactcctcccctccaagttgaaaaagttttaatccattaactttgatggtacattgaaactataaacatctcacagattatgcctacacaagagttctgaatccaactctcattttgctgacttgaaaatgtaactccagagctttgggagtgtttctgggtttttttctgcccctcaccttccttgccattgtctagaattaagacttcttcaggctcggtctagaaacttttgatttttaatattgaccctagattattggatcacagttttgcgatgcttagttacgtcaagcggtttgcttaacgtttgccttttattgacttaaaattttagttacctaaaaaagttataatgctgtagtttacaacaaatacttcgagtctattttcacgtcttagtcaaatagccttatagacttaacagatattttataaagaccattttgcaagtcttataagtagactttcatatagtcttatttctaagtccaaactcgagaaatactccccattgttgaattagcttagatgtgagcggtgaaagacagatgaaatgggggaggaactacatcaaggttactctacttgcgaggagatgacttgggggagatggaatttggtattcaacctcttttagctaaatacaaatttatgaaattaaaaaaattgccttcccctgttggaaaacaagacacagtgtggtatttatgttacagaatagactcactgtcttaaagtcttgctcaaaagtctaacaaaatgaaaccaactagccagggattcagcactggttgcgattgtgaattctgcctgtgctgcatgtgccatgctcgctcgcttcacgaaaacagtctttgaccttaaagtgttttcaggtgttttaaaaaccaaggtgtagtattttcttgaaccttttaagttaaaagctagggatatagctatggaattatttgtaagtctttcaggcaattcgagttatgcaatatagaagtttataattacagtttggattagcccaaagagccagtttaacctacagtgcagctgaaatgctatagaattaaaatgagacattgtgcaatgagaggtcatacaaaccaatgttgcagtatttgtgtacaaaaaaagcaaacaatgacatgagaaaagaaatgctgttttatattgagtggtgattaaggtaaaataggtttaattagtgcacccctggcagtagagtttaaaatacatcttgacagatttgtaactttaaaggttgcaagtactgattctttgtttaattatgccctaaaaccatttggtggtcttttccttcatacaggtgtaccctttttctttgtaattaatacctggtattcaaaccactttgggcctctaaaattgggggcacagaagcctagagccttagtaagtacttctgtttatggaagaaaccaagagatgttttatttaggtaaaatatagccaggcgtggtgtgtccctgtaatcccagctacttgggaggctgaggcaggtgaattgcttgaacctgggagttggaggttgctgtgagcggagatcacaccactgcactccagcctgggcaacaagagtgaatctccatctcaaaaagcacaacaaacaaacaaaaacaaacactgggaaataagaaggagatattaagagatgatatatttaaatgttagaaatgctctgttgttgaataagcttagatgtgagtggtaaaagattaaatggaagagggagctacatcaaagttactgtacttgggaggacatgatatggtaggatgtggtggggggagagcatgtccattgctggttggcaagtgactggctgcctcagaaaaggatgagggtgggtaggggagatcactggagattattagaacatacgtatgttttcaagattgcttagtttttaaacctcatagtactttgttttcactgatgaaataaaatactatgtgatctttttctaattttccatcttgagtaataagcaaagacattaatgtattttatgaaggctctgactgccaaaattgggacaaattgatggtcttgttggcagggtaaatgagcataaccgtagtaattgtagttctttttattgggttcagggatgacctggaataatggatgtgttattacccttccctgtagaagtgaggctttcgaaaagaggctataagtcaatttgggaggcacaaagtatcagcgctttttggggattttttttttttttaagtagagaaatattttaaatgtgtgatataaagttatgcatgtgcttcttaagcacattaactcaaccagatccaacagctggtctaataactttttaattgtttaaaaaaatttaattgacacattgtaattgtatatatttatgagatactatttgatgttttgatatttacgttgtacaattatccaatcaaagtagttagttatccttcacctcacactttcattatttccttgtgggttagaacattcaaaagactctcttctagttattttgtaatatatagtattttactgttaaccatagtcaccatactatgcaacaaaacaccagaatttattcttcctacctagttgtaactttgtgtcttttgactaacctctctccatccttccttctcccctccccttcccagtctctggtaactattctaatctctgccttatctatatcaaccttttataatagaaaaagattctacatgtgagtgacatgtggtatttgtctttctgtgtctgggttacttctcttaacacgatgtcctccaggcttagcattcacaattgacaggactttattttttaatggctgactagtattccattatgtttctgtatcacattttctttattcatccattgttgtacgcttaggttgattccatatcttggccattgtgaatagtgctgcagtaaatatgggattgcagatctcttcaacatactcattttatttcctttggatgcatacctggtagtgggattgctggatcatatgatacttctatttttaattgttttaggaacttccatgctgttttccatattgactgtactagtttacaatcataccaccggtgtgtaagtgttcccttttctccatatctgtgtcagtacttattttcttttgtctttttggcaatagccattctaactggagtgaggtgtatctaattgtggttttgatttgcatttccctgatgattagtgatgtcaagtatcttttaaatgcacctgttgatcatttatatgtcttcttttgagacctatcaattaaagtcgtttgcccatttaaaaaatcaagttggccaggcacagtggctcacgcctgtaatcccagcactttgggaggccgaggcgggcagatcacgaggtcagaagatcgagaccatcctagccaacatgatgaaaccccgtctgtactaaaaatacaaaaattagccgggtgtggtggcacatgcctgtagtcacagctacttgggaggctgaggcaggagaattgcttgaacccaggaggtggagattgcagtgagccgagatagtgccactgcactccagcctggtaacagagtgagacttcatctcaaaaaaaaaaaaaagtcattattattttatctgttgaattaattttcttatatattttggattttatccctttgtcgcatgtatagattgcaaatatttttctcccattctgcagctgttttcactttgttaatagttttcttcaaggtgcaaagttttttagtttgatgtaatcttattttgtctatgcttttgaggtcttattttaaaaatccttgctcaggtcagtgtcgagaataatttcccttttttcttgtaatttcatagttttcaagttttacattttaaatctttaatctatttttatttttgtatatggtgagagggaggggtttaatctcattcttctgcatgtgaatatctgattttcctagtaccatttgttgaagagactgtctttttcccagtgcatgttcttgacatcttaaaaattcagttggctgttgtaggtgcaaaaatttatttctgggctttccattttatttcatgggtctgtctggttttatgctagtaccatgctgtgttgatatagttttatcgtatatttcgaagtcaggtagtatgatacttccagttttgttctttttgctcagggttgctttggctatttggggttttttttgtggttctgcatgaattttcagattgtaacatttctgtaaagaatggtgttggtattctgatagcaattgcattaaatccatagatcactttgggtagtatggccattttaacaatataattatttcaatccatgaacatgtactatcttcccatttattgatgtgggaagataatttctttcatcaaagttttatacttttcagtgtagagattctttcacttccttggttgtttatttctaggtatctttttttttaaaaaagtactataaatggaattgttttcttgatttttcacatagtacaatattagtgtatagaaatgctactgatttttatatgttgattttgtgtcttgcaactttactgaattctaacagttcttttgtggagcattttgggttttctatctataagatcatatcttctgcaaacagggacagtttgacatgcttctttctaatttggatgctcgttacttctttctcttgcccagtttatctggctagaactttcagtagtatgttgaatagaaattgtgtaagtggccatcctttccttgttattgatcttagaattgatctcgttattggtcttttcccattcagtatgatgttagctgtggatttgtcatatgtggcctttgtgttgaagtacaaactttccatacctaatttgttgggtttttaatcatgaaattatgccacattttgtcaaaggcttttaatgcatctattaaaatgatcatacagtttttgtctttgttaatgtgtatcacatttactgctttgtgtatgttaaaccattcttgcatgcctctgatcccagtgatgaatcgcacttgaatgtagcaagttatctttctaatgtgctgttggatttggtttgctaatatcttgagaatttttgcacctatgttcatcagggatattgtactatagtttcctgtgttgtattgttatctgattttggaattagggtgatgcttgactcatgaaatgagtttggaagtattccctttgcttcagttttctgaaatattttgagaggaattgatattggtttgttaaatgtttggttgagttcagcagtgaagccattcgtttctgggcctttctttgatgaaagactttattactgattcaatttcctcacttattattggtctggtcagattttatgtcttcctaacttaatcttgataggttgtatgtgtcggggacttcgttttttctatgttatcaaatttgatgaaacttgttgaaaaccaactctaaattttgttcatcttttgaaattatttttagtctctatttcatttatttctcctctgagttgaattacttccttacttctaccaactttgggattagtttgttctgttcttttttttctttctttctttttttttgagatggagtttcgctcttgttgcccaggctggagtgcaatggtgtgatctcggctcaccgcaacctctgcctcctgggttcaagcaattctactgcctcagccttcctgagtagctgggattataggcatgtgccaccacacctagctaattttgtatttttagtagagacggggtttctccatgttggtcaggctggtctcgaactcccgacctcaggtgttctgcctgccgtggcctcccaaagtgctgggattacaggcatgagccacaatgcctggccgattagtttgttcttaattttgtagtgccttgaggttcatcattaggctgtttgtcagaaatctgttgtcttttttgatatgggcatttaatactataaacttacctcttaaaactgcttgtgctatgtttcgtaggttttgttatggtatattttcattctcacttgtctcaagaaaaattttaatttcctttttaatttcttcactgacccattggttgtttaggagcattttgtctccatgatttgtgaagttgtcagtttttctcattgttgatttctagtttatttcttttctttctccttccttctttccttccttccttccttccttccttccttccttccttccttccttccttcctccctccctccctccctccctccctccctcccttctgtattgctttgtctcccaggcccaagtgcagaggcacgatcttggcttactgcaatctctgcctcctgggctcaagcaatcctctcacctcagcctcccaagtagctgggactacaggtgtgtgtcactgtgcctacaggtgtgtgtcactgtgcctggttaaatttgttttttgtttttgtttgttttgttttgtatgtttagtagagatggctttcgccgttttgccatgttgcccaggctgttctcaaattgctgggctcaagcaacctgcccaccttggcttcccaaagtgctgggattacagccatgagccactgcacctggcctgatttctagtattataacgctgtggtcagtaaagatacttgatattatcttaatcttttaaaatttgttaagacttgttttgtggcctaacatgtgatctctcctcaagaatgttccatgtgcatttgagaagaatgtgtatctgcagctgttggacggaatgttctgtaagtgtctgctaggtgcatttggtctatggttcagcttaagtccaatatttcttgatctctctgtgtgtgtttgtgtatgtatgtctagataatttattcattattgaaagtgggctgttaaagtctcttactattattgtattggagtttatctctttaggttgaatatttgctgtatgtatctgggtacttaggtattaggtacatgtatgtttataattgttatatcctgttgttgaattgatccctttatcatattatgaccttctttgtctctttttacagtttttgacttaaagtctattttgtctgatatgagtattgctactcctgctcacttttggattctgattgcatggaatatctttttccatttcttcactttcagtctgtctttaacggtgaggtaagcctcttttaggcagcatgtagctgagttttttttccagtcctgcagctactttatatcttttcattagataatttatttacattcaaggtttttattgataagaacttatttctcccattttgttacttgttttctggttgtcttgtagattctcagttcttctttctctcttgtttacctctgtggtttggtcattttctgtggtcctaagctttgttttccttctatctcttgtttatgtatctgttgtaattgctttctttgtgggtaccatggggctaacataaaaagtcttgtagttataataaactattttaagctgatagcaagttaactttggtcacataaaaatactctagacttttttcctccgccatccctaatttatatttttgttgcctttatttctttagtatgtgttccctagccattgtagctgttgttgtttttgaccagttgtactttaaaccttcatctagaggatcgacaggtttacatagtaacatgatatcactggggaattctgagttggatttatacatttacctctattggtgaggtttatattctcacatgtgttcatgatagttatcattttttcatttacagctgtagcactcctgtaaacattgcttgtaaggctggtgtaggagtgaattccctcagcttttgtttgtctgggaaggcctttattctcctccaggatagttttgctggatatagtatcttttgtccttggccgagactcgtttttttttgttcttttagcatcttgaataaattatccctttctctcctggcatacatcagtaatttaatgttactgatgagaaatctactgatagtctaattaggattcccttacatgtaacttgatgcttttctcttgcagattttagaattctctgtcttcaacttttgacagtttgactataatgtgccacagagagaatctttttgggtttaatctaattgggaatctttgtggttccttcatctggatgtctatatctcccccaatatttgggaagtttttagctattatttcattaaataggttttctgtgcctttcttcaacttttctccatctgccagttctataatgcaaaaatttctttgcttagttttttttaaactttgggttatttcacaaaacctattttcagattttgaaattctttcttctgcttgatctggtctattcttgaagctctcgattgtgtcttttattcactgcattcttcagatttctgtgttttaaatgatagatcttgttttaatttctcattttataactttcctgatttcattgggttgtttgtattctcttgtagcctgctgaatttttttaagatcattatttttaattttgtttcaggcattttataaacacccttttctttggggtctgttactagagactcactgtgttcctttggcagtgtcgtgtgtccttgctttttcatgtttcttgtgacatctgcacatctagtggaatagtcacattttccagttgtatgcagtagctttcacagggagagacttttcctgtagatgggtcctagagtgttggttgggtatggtacattggctttggtttggggtggattcagtaccatggtctctgtgtagtttcgtcagctgtaatcttcacagcaatgtctgatttcctcagtggcctaggctgcaggagtttttgatggtggtatagttttgctagggacaggcatgtcatgctagttgtcaggctggacacttgcaggctcggagggctgacaagctgtcttttgggctccccagggaagagaaagtatgattttccagcttttcttctatgtttatttaaaactttgttgtctggctcacagtgttctttatctaaagtctagccagtggtggtggtcatattgcaatcattattacagcttcagactttctagaccttttccattttagtgaccttcagccttcattcgcttccattcatgaccacagaatagatgtagtcatctctattgaaggcaaacccatcccatctcttcagcttcatctagaaatttgtttcatctgttacactttctttctttggtttttagccttcattctctaccagctctttcacttaagcagagatatgttcaagactctcccattctaacagttccctgccttgatcctacaagcttttctctttagctgctaccttgctttttatttttatttttttctcacttgctctgataatctcctagaaaaattggcttactctgaccatctccattagttcacctcttaattattcttcaaccatctgagacctggctttgttctttctctactgaaactcttcaggcagagattagcagaagtcttctaattgctcaatgaagtggaaattttcagtccttattttctgtatttctccttcatttgactttgacttaactctcttggtttttgtaataccaccagcacctagtttatcagtctctcatgggaacttcattctatctgcctgccaaatggtggagtcccaaggactgtggtctgatctgctgttcctcattacatgctttctggtcagtattgcacactgtggttctcatctaccatcatctacctccagaagtgccatatatttagtaagtttacaagaaaagcaactttccttgctccgtagactaactctgatcttttgttccctatcatggttatggaactcactaattattcagcatcagctgtcagaatgtttaactttgctatttaggtttgtgtaagttatgggacaataactaggataactagaattagcttgtagcttatgtgggttagataatacaattgcatatgtaagtagtgaatattttggcttaataagtgaaggagtatttaggaagctatctggaatgttatctaagtcaggattctgaaggtaactctagcctcactgtcccttactcactatttctaaacacccaccaatcctgcctactttatttacttggtatttctccaatctgccatccttctctgtccgaccaatcactaccctagctcaggccttcaaagtctctcacttgacctactccttcacctcctttgaacctgtgcacaaatgttagcttcttagtaaggctttctctggtcacctgtataaaattcccatctgctacatacttcctggttccctgtattgccttatattcctcagtggcatttatctccttgtatactatataatttctgatctctgtcctttctattaccaccccacttcaagatggcaaggatttgtctgttatattagtgactgtcctaataggaaaaaaaatggcacatttatattagagtaacttgagaagaatttttaaaagtcagtatttataaagctgtagatatagagatagtgaagtactcttgggactagtaatcattgggcaggtgataccatttttaagcccaaaagggcatagtgaaagagcaggtgcctgaacctggattcagagagactatgtagaggaggccactaggcaggagctgtggcctttgcctcagcttggctgattacctcactaatcctcactaatcctaaattacccaagttccttcttttctggcccatttcacagtccaaagccaactttaagccagagggcaaggggagcacttgatgcagtccatgcagtatggcctcccagtgaacagggcaggtggaggatagaaactaaatctagatggaggagagggaagatattcagaatatgttttttctttactgtcagcaccttgaagagtgcctggcatatagataatatttattgaatgaatgaatttgttactggtttactggcctcatgaactttagttttgcctattctattataacttggtgactacattcctatatacttgataccaactcctcattaactacaaaggcagtattcccctctccccctttttaaacatcaaaactcttttttaaaaaaaattcttaaatgaatcgccagtatataacacataaaagtatgggtgccttgattggagtggtgggtaaatgatcctgagtctgtctgtttgggttccctctttgcctagcaggaatgtgactgtcttgtttaaagcccactgaagtagaaaacaggatgagagacacactcttcaacatggcataagatttccatgcttggctcctgcctatctctgcatcctcatttctcagtagtttcctcatattttaccatcctgtaattgaaagaattacaaaactagttctctacacaagctttcttgctgttccagctgctgggaattagcttcctttgtgcttttttttatttgaatgattcatgtttacattcattaaaattaatgaagattcattacagttgttttctctttaggcataattggatctcctatactgagacattgaatgcaactttgattgtttttttcccccattatatgttaagctccttgaggttcttttcaactttgcgttattccaggatttctatcgtaagagttaaggttcatccacttctctgatgtgaggttcatggcaggaaggttccatgttgctcagctgcagagtagaaaatactgagcagggcttaaatagattaggatgctgccattataatataaactgtgtttacgaaagagcatcatcaattcagaaaatatctttttcattgactacagtggtgcctgatgatctttctattacaatcttaaattatggtcattttaattatagaatcatacatgggtttatttatgttaaaataaggtaattatcaagctagctgtgacctatgagaaaaatcctgaagaaatgatgaagggatcaggtgactgtttttgaagtcaagtgtgaaaggtcagaccactctgggtcatgggaccctgccaaggcagagcaggtcaagtgctgtgcccagtggggccaacccccagtatggtgccagggactgggtgtgagaagtcaaaaattaagaatacacctcagaaaggggacatggacagatgccacagacttatttgcgtatttcatgatttagcccttagcttgtgctgatactggatcagatattttcagagttcagtattttcaaaagcatcgctgatcacctgttggcattgttttacatctcaaccaaggaaaaacttttgggacatctgtttaacaaggggtaagcttttatttgaaatgttcgattaaagcagaagagtcaggcatttttttgtgcctccccaaagaaagatttgtttactgtcctgtgtgaataaatataatgtcattatttcccgtaaaggaaaagctgatggggagagtaagtaatgggtaagattaggcaatgttaagctcatatattagtatgtttaagagtgatcaatttagggatctctgtgacagagatgccaaatgctcacagtgctatctcatgttggaaacatgtgtctcctccacttttcctcagtcctctgaaatgacggccctttagggattgacagatactatacagatttctgtgctgatatgtgatttgtctaaaacaaaagtttcacaaaacaattcttaccattgccatttaagagtcactctgatatgctctgtttccattgcaaacaaatgctcattatgatttgtgaaattaacttcacaatttcctaatggataacaccttgaagtatgaaaagcactacaggatcttttatagcttccctcctccagctctctataatctgctcccatctgtggtgtaggaaagatttcagcagtggccgctgaaggccctaagatcttgtctcaacagatagcaaggtgcataacagactttggacaggttgtttaacatgtctgagttactgtttattcactggcaaaatgaagggcttatattatattgtctctaagtactatcagttctgaccacctatgaactttcattttaaagaaaatacctatttctatggcctttaggcattagggaattttgtcaaattaaataaatctcagtaaggtttgatggtcaatggggcccactgtctggtgtgtgtggaggggtgttgtattttacatcaggaacttcagagccctcatgaatttctaattagaggaaccacctgggaaatataagtcaaagccctttgctcgccttactcagctttagggcacagtgactagaggtgggcaatcgctttggtgtaggtattgtcattggaaaggaagaaaccattttctggaggaaaagaattggttgaggctagctttaagcagctatttcatgatggacaaaaggactagctcatccattcttcattcgtttctctgtatcctctatcaaatttctgagtaaagattttatacaatgcttgattagcattcaaatagtatgtttcaaagattttaaaaaaaataaaactaggcctttgaatcataattatggcttataactctatttttcatatacttactatctcaagttacaaatttcatgttatgtttttttcaaaagagtattcctgccacaactcagagctcagctgaattagagcagtgactagaaaatctgagaaggctgagcttcaaaataaggtctggaaagtgtttcttattgttacaagagagtcaaaatgattttcttgagctttaagtttatgtaagtatttacttgacacttagcagtttaaaagataatgtgcaaaaatatgaaaatgagaaaaaacaatttcaaaacaagagttggtgattacgtgagacttagtagagcaaagtatattctaagtattaatctgtctaagctgtttgggaacagatgtacgtgaaatggataccgggtgttctgttgtgtacaccccaagtgagacatctgttggtagactgtgtggtcagaaataatggaagcaggggttaaaccccaatatgacctattactcatgtgaattattgaaggactaattactcagtaaaacatgatgctttgattcatcagtctacacgttaagaaaaaagcctctttagaaaaaaatttagttctgtttctaagctgtcaaatttgaggaaatttttaagatgtatgcaaagactcaaatttccatagtaactgcaaatactatctgcttataaagttttaaaatgttttgacaggtctactaatttatcataaaaatagcctcaaaagttttagctttttgttagggtaggttgggtctcacagaaaacaaatgtagagtgaattttctaaagcagggctgtccagttagacttcctgaaatgatgggagtgcactatatctgaagtgttcaatacagttaccaccagctacatgtggctattgaacagaaacatggctagtgtgactgagaaactgaatttttaattatatttaatttttattaatttgaattcaataactgcatgtagcaagtggcaactgcattgtacaacacagctctgacacatggagagttgaaaatgtttgtttactttcttcccaagttttcattttagtctttgtttctacatagaaaggaagatatagcttttgaaaaatgaacctgaatgtagaactgatatggttatgcaatttgagctgcctatttaaagataaagcaactgagtttagagatttcaaagtggcagagtcctttaacatatttcgtgggctggccacggtagctcatacctgtaatcctagtactttgggaggctgagatgggaggattgcttgagcccaggagttcgaggccagcctgggcaacatagcaagaccccatctcagggaaaaaaatatgtgtatatatatgtatatatatatatatatatatatatatatatatatatatatatgcatacacatatatacatatatacacacatatattaacatattttgtgtgtacaaaaaatatttttattatgtgtagattagttggttactagtaaagttgaagtcttgtctatagaaatcattgtatttttcatggtcattgtgatacattgtttgaactgaaatttggcaaattcaatctgtttcttactacaagaatagtacatagatttgaaatggtaactctcttagtctgtgtactctgaccctgtgaacgtctggagactaatgttattcctaaatatgctatgtccacatggcagcatctgaaggcaaacactttttaaaactgatctacttttgtggacccttcctctctctctttcctgcatcccggatggggccctctggggctggaactggcacagaactattcccctaggagtgggttcattgaagccaagggacacacaaattgagaatcagatagactggaccaaggtcattaaaccagagagggcaatccagatggggttgtccaaagtaggaagttctgaagtgaattgcagaaatccaaacatggcaaagctaaaggaatagagaaccagggcaatggatatagagaacagagcaattgggtatgcaggaagatgctattgcctagactggatgtttttgtaccctctgtaatttgagaaaatggaccgtccttgttgaaatggtcagggatgtagtagataaattcattgcagttgtgtaatctcagcactagaatactgatcataaccatatcacttgttatcccacctagcctgccacttgattgggttattagattacatttcagacattgacaagtctacaagcatcattaaaatcctaaacacagacttctgaccgtattcctacccaagttttagaagcactatgccaatgacgggggtagtatatgctgagcaggtgagttttgattgtgtgtgtctacatgtgtacgtgggtgtggtgagcaacaggaaggaactctcagccatgactctaaatgctcttgtgttggccaaaattggtataagctaggaggagaaacacaaaggagagagaggcatgaagttgaaggacattaaaccatttgcaaacttttggcatgcaaaccagaatatgaggaaacttagtgtaatgggtgactgaattcagaggtagacaggcaatcaggaaggtataggcaccaaaaatagttaccattggtgagcgtttttgtttttgtcattggcatggtgttatgaacttatgttaagcctaagggtaagtctaaaataatgtaccagctggcatcagggaattcccatgtacattcctagattttcattagaaacagtgttctggaaactaccactgctgctacacagcagtgcccagtgcttgactgaaaatagtgaacacttagatttgtttactctgccaggttctgtgctaagtatcttatcttgtttaaccttagcaaagaaactatgtagtctagatagaatttttatccctagggcccagaggtgttaaataacttgcccaaggtcataccagtaatttcagttgctggggttcaaagctaggcagtctgactccagagcctgcactgtccccatttggttatgttgcttccccagttaagcaagcaagagtctatctgacatctgagttggtggtagtaaagcatcatggtctgaaccaaaataataaaaacctttgaaacaacattatctgacttctttcaggcttttaagacagttccatcatcaacagcttattccatttctctggccacttccagtttctgaacaaatgaagaaaatgggagtgataaattggagtttttaacaagtttttttaaatctaattttttttatggaaaccaccaaacatacccaaatgtaggaataattatgtaataagtcctcatgttcaaccctaagaggggtgaagctctatgtgacccattactgagtttaaacagttttcaatttatggccagtcttatttcatctatactctacccacatcccttcttcccctggaatgattgaagtaattcctaggcatcatataatttcatctgtaagcatctcagcatgtatctctaggagataaagattttctaaaaaatcatattactactcttcaaatttaaaataatctttatagttttacatatccagttagtgtccagattttcctgatattttctctattttttaaatatgtcaaccttgaaatgaggtccatattatagctgatggctatgccttttaaattttctcatccacagattcttcttccttttttttcctttcaatttatgttttgaacaaactagtttggcctatagtttctcatgggcaagaataaccttcagactgggatggccatcactctgatacccgtaaaggggatgaggcaggttggggaagggagagcctcagaccatgatcagatgtcacaagatttttgcttacctagggtgaggacttgggaaaaagattgcccattaggagtcctgccttgggcaaaagtggccaaacttcagctgtgctgtcacaggctgtgggctgccttggaaatgtaggacctcaactcctctgaagttgaggtggagcttgagggtacgaatccctggtggccattataatgactacactcattgggatggcatggcaagttcatcctcaaagatggatcctagcatccaccatgaccaatgaggtttttttattgttatgatcactataaactcaaggatttaaacctattaaatgtttttcaattcacagcaatgattatttttactgatcttcaaattgtcacattttggatttttagaccaatgggagccccttcatcttgacttctgagttcttttgacattcactcagctgtctgatagcttccctgctttctggaatggcaagatattccaggttcatcttgaacatttcatgcttgagatatggaatcaagctcatcatcagagggtcctggttccttttactggatagtggtattagagacctcaatttgagaactaagcaacatcattgctaaaacttcccctatgtgtaccttgttacttaggtttttcaaagaacagagctagaaaatatgttgggtttttttgttttgtttttaaagaaaaaatgtatcataggattatgctgatacttccaattcaagtgcaggcctaagcttttcacattgtctcttttctcctacccttaaagtcctgattcctaactataacaacatcattactcatttgctttatcctgcattatgtagacacaatagagtaacaacaccaatgctgccaatcaaaagtataattactgaaacccacttaagatagtcctgcaatttttttttttgttcatagagtgtacactactagggaggtgtagtcaaattactatgttttaaagacacttggaataattcatatctgtgaagttatacccccaacttatttgttttttgtattattgtttcattttgcttttgatgtttaggcatttcttttttaaaaatcaattttataattacgtgaaatacttatatggttccaaaatcaaatctactaaacaaactatattctaggaagtatagcttttatgtttcccttctatgcttttccttccttcctgtaggtaggaaagcttatttgttcctcaaagctctgggttgttcttttattttatataaataaacatgtgcatatattcttttcattacccccacagtacccaccgtcttaaacacatgtacaatatatgtgtttttctaccttgatttctttcttacttagcaatatgcccagaagttcactctgtagcgctttacatcagcatcaaaatccattatgtactatcgtttattgacctctctgttggagaaatttggattgtttctagtcatttttgttatcgcaaatagtggtttaataaaaaactttactttccgttttttgtttttcaatgtgcttttaggatagatgcctagaagtgagattgttgagtcaaagaataaatgtgttaataattttgctcaatattaccaaattctttcaaaagggttgtgcaattttgctttttaaaatcattattgtataagggcatgtatttcctgaaaatttctccagaagagtttattgccaaactttaaaaaaacagcctgatacataataaatgatatctcagcatagtttaaatttgcatttttcttgttaaatcattcatgtttttactgtagtcctcctaacatttagggagcaccaattatggggtctctagaaggttccaggattctgtaatcaatttgacatgatttctgtcttcagatattcacaatcttcaggaagatatattgacaaaagaataactacatgatctattttgtgtgcaacttagtacttacagagcattataaatgcacatggaaaaataggtaaaggagaaaatcattctctgttgggcgggctgagggggaagtcaggaaaagctacagagaggttcgagggtaaactttaatgtgggccttgaagtatgatttggagttagcaagacagacaaaggagcaaggaaaccattctagaaaaagaaaattttgaaaaatctccagaaaaggatgctttggcctatttggaaaataacattgtcttatttatgggggagatgacagtgctttgtttttagtcagtagtttatacaggactttgaatagcatgcaaggaagttggcgtctcaacctgaaaattgaggaaggtgtgacaaaggctgggcattaggtgagatcaagtatttctgtttttttttttggtaaattaggtagcaggatagattataaatgggctccacactgaggagcccagtgtgatggctgatccagcagatcagggggcagtggctgcaaagctgggagaatggcaaggtaagcctggatgcaagggatattgtcaaagacaaaatttgggggatgtgaggcttaaaagggaaataaataatggtgatggtgagatttctagcttgggcagtgggatagatagtagacgctgcgcaaattcgtttttaaatcagcagaatgagaagcatcttatttgaaatatattctaccaaatcttagcatcaaatgtgctagtgactagcaaaatatgtaaacagaagggaagtagcttgaaaagtacacaaactggagaaattgctcctgaaggactgtaagttgaacccttttaagcctaagatctgtatttcctatgagccctaggctctttccttgtgtatcctgtttcttattagagtagaggctacttaaaaataatcatagtttaaagcgctctattttcagaaaacattattcattagatgttagtaaataatgtaatctttatacattcataatatttctgcattattggagtgtaaaaagtcagtgaaatagtcatttgtaaagatgtcagtttttatctgtggaaaatagctgttcataccattttaagcttaaaagttcttcatttacttcttaaaatatccatgttggtattattttgtctaatacaagtaattaatatttaccccaaattaagcttttaagtttactaaatgttacaaacataattcaaagcactgtttagtgtccatctgtgcaggaaaaataagatcaatacaattgagcagctgttagcatgtattggtttccttatattttaagtatgttttcatgttttgaaggtgtaaagggatgacagtatgttttgttgtggttttcatcatacagataaaaacttattacagttgaaatcttggtgaacataatacattttaaaatttccattcctcacccatttatctagatatttagacacagtaaaataaataacatggatacatttttgtcatgtgatttatgttttttaaaaagtagaaataaatttctctaaaagttatttttattttttaaatttagcatttttcatatttgaggaaaaaacaatatgtcttggtaccctagcttctgaactaataacacacctgtcattttacaggttattttaatgtttttcattgggatcaaacctactctggaaatatctcatgggtgagctttatttttatgaaatgttcttggcacttgaagacctttgtaggtacatgccagactcatcttacatccagttcttctgcatggaaaatatgtgcattgaaattctaagtgccttttcaaatttgaccttcttagagaataatatgagtcccaacaattaggaaaactatggaatgccttttggcctttacttttcaaagattttcagtcagtaatgtttaattagcattcattgtgtacattgtccttttttgtgtgatatggctagttccaaaggaatattctagaagatctcagccttctgctattgaaggtgataatacactactaagttatgtgttgctttacattaaaataatgttgcagcagttacttattgcttaactagcgggtataggacatcaggttgaaataactgattttgaagtgaagagttcttgtttatatcttaaactaaccaagtatgttcattaactttgagaataacaatgatctttttcattattcttgagtagactggataaatcagaaaacccatgttagaggtccctgtaaaaacttcagtcttatttggtaagtccctttataagagtttcaataaaatcaggtaaatttaaactctgaaaattctacgtactgtctatcatgttcaatttactgttaaccagtactatgcactggaaaaaatttttttcaccttaatgagaccactggtcattactgctgctactgatgctcttttgtctgcacatactgttgcaacataatgtgttgtgcatttgatacggatattatcatattgccataaggagctgctattattttagacaccaactgattccatgatagtgtcagatttctttaacatatgcttatgtttttgtacaaatgaccccaagaaacatctgctagttttgtggtggtatctactgtttcttttttagaatttgacctgtcagtcactttttaacgtgaatctacaatatttgagttgtattcctttctcgtttttatgctattgatattaacaaaattgagtcagttttatggcataattcagagagaaaccgaagctgtctatggatgttattttaaaaatacctttttcatgatgattgtgcctttaaatttttgtcattgattgacactttaaaattgaaaagtgcccttttaatggatcctttaggttccaaaatcttaagttgaaaatttctgtctattggtcctgaaagtactctctgaatttgataagtatgtagtagttgtggtgtatccttggtcagtttatatcctgtgctaattgctaatcttacttagtttctttgatgcgtgtgtgaagacaggcaaagaaaaaggaagtggaatttctacaaaactgtgaaatctttactttatggagactagagaaatttctaagtaaaagaagacactcattctattgtagttaggatcccttcttttacttgcttttcatgatcttgactgaaaagcaacaattgagatttccattgcccgacgctttctcttctgcttttctttttgtttctcttgcatttttaaagacagctatttattcaaaaacaatatgaacttttatttattggacttaaacctggaacatcaacaaaacaaagaacaaacaaaactacctttccaaatttattttattagaggatgctatcaatacaattttgtattatgttcacacttgataccaaacctaaacccaagaaagtgtgtcctgtgttacagcctatccctctgtttaagataataactagaacaatttacttttattttctactcatctgctttctgtgtatcagctgttgtcctccctcagcctcgaagcatgtcatcatttccatctccgtgctcattcagtcatccttgctgctcttagtcccctttttgtcccttgggtgacttatgtcattaggacaaccttctgtccccacttggctgaaactgagctgaggcccttgccagttgcattaggtgtggcacctttcatggctcagtttgggcctctgtgatatctgtgtgccttctactccaaactccattctgccagaggtggcagggtgactggaagctttagtttcagtgacaaaacccaagcgtggctatgctgagtgtctaagtagctttcatttaggcctgaaataggagagtcaggcgcctctgtgtcccctgagaaagagagatttccctcagctctctgggcccagcactcaaccatttaagtcagctggttagtataatttccctaaattgtggtttagtttccctatgagtaggactggagtaggaccaagtaaggaaagtccctagtgacctttctgcctcctgaggagcaggccatttactttgagttgtagcttcccatctgtctgtccccactaccctatccaaggccctggaggagccacaggatgagggaggagattcatggaaaagcgccttcaggtactgggtatgtctggagtaacatttaaagtttaaaagactctttaacaattttcctctgatacttactactgcctatacttgtttggttttagtacagtaagttttgcctatcgtgggggtgaagaaaatagaaatattcccattaactttgtatggtgcttggtatgacaccctgaacaggtgcacccgtaattgtttacttgatgttctttttaataagtcaattatatcatcggaaattgaagaatagcaaagttaatttgtttaatcattctatgggaactcttgcatgctcgttcactagaggaacattgcgtttctcccttaaaggacaaggctttgttttgtttttaataagacacactctttataattaaaacaaaatcccagtgttaagggatttctgttttaaataattggatttctttcctttgttcctctaatccctctatatgagaaaaaaatctaatggtgtcttaggataaatatttttagattaaaaagttctcttaaccactgaaatttaataatacttctcaaagtttatggatgatatagaatgtaatgtaaggttgagaattttagatttggcaaaggcaaagatacaaaaactagtgaaaaacaacaaactggaaacacttttaaaatactgatgtatttatctttgcaataaattattcagaaatataaataaactcactatttacatagttttatttaaatttgtcctcaaaatactaaatttagtactatatattttcttctttcagataaatgctttcctgaaaatggtattttaatatctacagatggtttagtttaacaatggttggggtaaaaatgacatagggaaaagcaaaatgtgacagcccagcttggttacctttagagaaactcagaataaactctattcccatttccttctctttcccctttccatactcgagagcccttttctgagactcttaagtcatgtttgggccttggagaggataaatagcagggtgggtggtaaaaggggagagtgctttgcttgaggcaaagttttcctccatatgggaccttcctcaagccctcccttcaaaccctttaaatgagagcatgagctcctaggacagaggtcatgtggaaagcagcattagcatgaaggggggtgctgtggaggggtgtaaggtgcaaaaagcagcattagcatgggggaaggtggggtggaggggtgtaaagggaatgagatgtgaagtggttaaagggccatttttctagttggcctctgggctttgatgaaccttttccagtgtgcctgtttctccacttagccctgggctaatcttgactcttaactttccaggtgtgtatctatgctgatttctcctgggtttggaagctctgagaagctctggttctagttcaatcacaagacttttaaagaaccagaaaaataaaacaattttttaaaaagtaatgaagaaaagacttttaaagaaccagtgaaaacctgggagtaaaaatatagaagacttgagaaatttcatctttacctttcaagtgggcagcatgagaaattcttgtaaatggtgctttcaaatcttacacaaggttctcagttacctttatttgtactccctagactgtattgcatcccttgctatgttgactaattcccacctaaaataattcaatggcctcccaatataatctggcattctaattaataagctaagaaattatttggtttttcactcattggcgttaaatattcttcagtgcccacatttggaaatattggaacacagaaatgaaaaaagatacaatcagtttctctgcttgccatgttttccttgatatggcaatacgacaacaggtcaccctttgaagaaaattcagagatgctaaagtagaaattaaaactgaagataagtcaaggcaggatagtataggagtctgctacagctgccatagcaaaatactacagcctgggaggcttgaacagaaatttatcttctcacagttcttgaggctagaagtccaaaatcaaggtgccattggggttggtttctgaagagggttctcttcctggctttcaggtggccaccttcatacagcatcctcacgtggccttttctttttgcctgcatggatagagatctctggtgtcttccttgtaagaacaccagtcctattggattaggaccctatgctatgacctcatttaacctaattaccctatttaaggccctgtctctaaatacagtcacactgggggttagggcttaaacatattttaggggaacacaagtcagtccataacacgtgatttgctatagttttcctttacctaaatcttttccaaccttgagagtggattttggccaggtgtggtggctcacacctgtaatcccagcactttgggaggccagggaaggtagattgcttaagcccagaagttcaagatcagcctgggaaacatggcaaaaccccgactctgggggggcagggggagtgggggaattagctgggcttggtggcgttcacctctagtcccacctactcaagagggtgaggctgaggctggaggattgctacagcccaggaggcagaggtcacagtgagcagagatcacaccacttcacttcagccctgggttacagagtgagaacttgtctcaaagaaaaaaaaaagtgggttttattcttccccttaaattcctattaatagtgaggtgaggcttcttgtgttttttttttttttttccaagacaatggttaatgtgtgattacttaaaaatgatatataacactaagaaataaagaattgttaagtgagaaggaacatattaaaatggcttggaaagatgggtaattttttacattttaagtaggttttctcaactctaactctgtggaacttggtcaatctaatcagtctaaatatagcacaaataataatagttatatggacaggagaaatagtagccctcaaagatagtgaaatacatctgaatatcactaacaatgtcatgaatttgcttgttctaaagttttctgaaagtatgaattcataactgagtttttttttttttgcctatgactactaatgtttgaggagagagtagtgtcagaaccacccccccatttattacatgtttatttcatattttggtactgaaatcagtgtttattttgtgtcttcctgataaatcttgccaataagtaattaccttccatactgaaaagttcttaggattaccaggttgctgggggcaaccttaaaaggccatgcagaacattgacttaggtggctattaccctgctttattcaggtctgagcatttactttcctactacaatcagaatactgacctacatttaaaagtgcaacactgccctgttatctaaatccactgtgttcctgagaggaaataccagaaaagagggcaccaatattatttttctgctgttcttgatcataagtgattacctttttttttggttaggcattctgcttctgaaagataactgaggttgaagttaatagaactaagattcttatataaaatcataggaaagataattttcaggattattgaatcatattgaaaaatgatataattgtgttaaaagataaggactaaaatgagttaattcaatttggaaatagttaaattagaatttgcttctgtttttgatgaatactgctttttgaaaaatcttctgagtatttaagcttttactactctagtcattctctctaaagtagacatagaagcgtgttcttatcttgatttggtaaggctctgaaaatgcaaagcaacagatgttgtacccagcataattatatgtatcctggaaacacatctttattgagtgggatttgttcttggggaaacaaaaatttggcaaacaaaggacattaacttgctgatctcagcagtaattacttgggttagattataataatcttgtgtaggtggtaactgcatgcatatattacaaaatctaattctaaaatacgtacattaaaaggaaaatgaacttgcgcaaactttagatcatgtatccccttgaagagcagaaaagatctcaatttcattatttgaaagttgtttgaacagctttttggaagaggtttccaggattccaaatcctaatatgtgtattgatactgaggctttggactaatctttgggggttactgccttttttatgcccactgaaaatagagcatttcaaacaaatgaactgatctctgatctttaagcatgccagtaactctttggaacaaatccatagttatttttaccaatgactgtattaaaacagtactttctgtattatctcttccattccaaggccattttaaaacaccctctttctcttctcccaataggtaaagtacgacagagctccttaggactgggttatggagaattatctggaggtcaatttgagaaccactgtgcaaaccatttcttaaataagtagctacaaggttgtccttacaaaaatttctgaagttgatggtgttgcgttttggagtctgaagcttaaataagagtttgtcagtggtcatggtctaaatagctgattactaccaaggtcatctaatttttttttaacacaaaaaaatgttctgagcacaaatgaaaccttcaggacaagacatttatgttttgagaatgttcttaaatgattcctgtcgtgtatcttattttacatatcttaatgatcagcatgtattttttgttgttgatgatgattttataaatgtgctatcacctagtttctaattcctaacagctccttcatcagtagaatattgctgtagcacagttttgccatctgttaagaaaagatggtgactaataagagtggcacatttcagggctggtgtgctatcgcaacatctagtgttttagtactgaggacagtgatgtatgcagtgttccttacagccatggggtgtgggaatgttttcctcttcggcaaagtctgtgtatttctatagctgaactctcaggatccagaggaaaaccacaagatgatgaaaccagatgattgtcatcaaatttctattccccactacatgattattagttttcgtcaaaagaaatactcatcctatcctgggttggaattggtaaagaattttgcattgtgactaggacacctaaaagtttttaggatgagtacaaatggaatttgatagatttccccaaaatgtttgggaaaagatttattcctccctaggaacagcaagagtagcagcatcacatgaggcaactcctggtaattttttcttcttgctcttatttcaatgatatcttttcattcttttctgtatctctcaatttctatgtttctcctcttaatgtatcctgtaaatttcttagtagaacctttttactaatgagggtttcctagtttgctttaggaggcactcaggatgcccccttttgtaaggcagtaaattgaaaataagaacttggtgaaggtccacgtgacggttagtttccattctccattgtaccaaactgctacagggaaagaaccatatttaatcaacctcaaatcctcaatatttaggtcagaaaacacttggcatagaagagacactcaaattttgcagctaaatagattattgatagaaaatatgtttcttgcctctacaagcaatatgaaaccaatacaatctctaaatatcttcagactactaggggcaaatactgtattataagaataattcttcagaaaggaaaatccagctactctcatatcacctctctatgttgaaagctagggaagataaactggcttccagccagtgagagtccatgtggacctagtgctggctggagatccctaatccaaaggcaagagccagatactggttgtctgctgaaaatcagaagatgacctctctggtagtaaggccagtgactcatccctgcatcttttatcctcttctgatttgtataaggatctctcctttttccccagtacccactctcaagaattgctttcctttttaacatgatcataccaaaatgtatctaacagtaccttgatttcctttctgaggaatttagggagcatatttactttgtcagactcattagaggtttggcttcttggtcgggttcttaaatggacaacttgtttgggtgatttggcagagaataggagaagccagtcccctctgatagagcaaacctggggagctgtggttgacccacctgctaactgtcctgtacaattaggcatgtggcatcagtgggtgactgaccagagccaccatctcaatggcggctgttctttccttcctgtgccttctcagatctcttttttgttcttgttactccactatattggtttttcttgagtttttttcaagcaaatatcattattcacttctactgcagttcctctgttgttcgctttttctcttagtcttcattgttttccattttgaacattcagagatccatcaaaaaaagtaaaataacaggaagggagaggtaaacaccagtcaaatgaagtattataatagtgtattactatactctttaaagtaattgaagggtggttttttggggtcagaatatctgttagaatttggaatttgccactcttgagactggggcaagctatttaaactctaagcttatctgtccttcctcacaatctgtaaaatgggatcataataatggcacccagtttatggtgtagtgagcattcactgacacaattaatctaaacttatttgcactacatagaacagaatttttgtctattaaacaatatagcgttttaggcatgaaagaaactttagattaaattaaatatcatttttcttaccacagggtaagtttctgttttgtttgcccctgtttctctaactcctagaatagtttccagcacatagagattaaacaaatattcgttgaatgaatgaatgcatctattctaatcctcttgttttaggaatgacccgtcaggctcaaaagtgaaagcatttccctcaagattggtgacagagttggggactaaatctaaggctttctcttcctacaccagtgtcctttctgagaacacgatgccattttctcaatatttgtttatttatatggtaaattggtaggaagctgtgtggtactataagaggataaactttgataatgaggtatacttgctatcaaattctaacattctcatttaaaacatggcataccatttgtcttctacattttcatatgtaaagtgaggtgatttctaccttatagaactattgtgaggattaactgaactaatctttgtagagcacctggtcccatttattttttttttttgctcaccccaccccccaactttctagctagataacttatacattcactctgtttttcattccttcttgaatctcctgtggccagacttgacccctgtcactctacagcttactcgtcaaggtcagtcctcatctgacttgacctactaagagtctgacaagtagtcacactatgctccttgatacagctttcttcacctaccttcttggatgtcattcttttggttctcctcctaccccattgggctgctttttcccagtctccattcttgggtattctcattttcccatgtctgtcctctgacttcttattgtctctgtttctgttttctctggttggaccttctctagtttctggcttcaaatactatctaaatgctcatgtctttcaaatttgtaactctagtctagacctctcctctgaattccagttttataaatcttctacttaaatattagaggtctaataaacttctcaaacttatgttctacaacaaactccacattttctcctgcagcctctaaatatgtacctcctatagattttcccatttcagtaagtgggaacttcattattctgattgtccaaaccaaaaacacttggagacttgctacattccaccctttgtctttcattctacatccaacctatcaacaaatcctgttgcctcttccttggaaatatatccacgcttgagcagcatcattgtcaccacttggtgttatacactctcatttctcacctggagtattgtatttctcatctggagtagtgtctgtccaacgatgtcccccatcagtctgttctccatgtagcaatttcgtttttgtttgttttaagattgggtcttactttcgccttggctggaatgcactggtgatcatagctcgctgtagcctttaattcctgggctcaagtgatcctcctgccttagcttctccagtagctaggactacaggcacacaaccacacttgactaatttttttttttttttaacttttactagagatggggtctccctttgctgcccagtctagtcttgaactcctggcctgaagtaatccttctgtgccagcctcccaaagtgttgggattataggcatgagccaccatgtctggcccagatgttaattttaaagtgtacattagagcacatcgttcttctgcatgttcagcataaaatccaatgtccttaatgtagtctatattaccctacatgggctacttgtgcctgatccctctactcttatgtcttatccctctcctgctttctcactagcaccagccacatcttaccgttccttgaacacaccaagtatgcatttgccacaggaccttgatgcttactgttccctttgcccagaaacccttggaaccagctatgtgttaaaattcagatatttactgattttagagagctaaaatggggtatatataatatattacataacactcacagctggtttgtggtagcatttcataattaaataatatttctgaatgaaacattaagaatgcccatgctaagagggatgagtaaagactcaactctcattgtcagttcagctgcagaatgaggtcagctcaagatttgctgccaaatgacttaagaaaaaaatgtttttggagctttggggatttcagaattgcagatgagagattctagacccgtacctacacagcatgctcccttattttgttccaatctttgttcaacgattatttattgggtagtcaaggaagatctctgtctaaaaggcttctctgtgtggaacaagactggcatgtggaaggtttccaattaacgatattgaaagagtgaagctcaaatcatttttcactcaaatacatactatttagaagacagtggccagtttaagaataatcattattggaaacaaagtactatttgattagggatagttaacacaaacacttattagtattagggatatgtgaaatacttaatggatgagtcatgtgctgacataaaacccattatccattttagttcctggtagcctaactggttgaactctgttttattgatctattattgatttggcctgtaacttcaagttacattttaatgtaatttcatccttttctgatcaccttgtgtcttcaagcatttttaagcagttgatagatagttgaaagatattatcactatttcaatctaaaagatattatcactattttaatctacttaaaatttttactacattcattttaagtatgacttatggaacgaatcgaaaatacaagatagtgaaaaacttgtgaggatcacctgaaattttagcattcactttccttacatagaggaacttagtctctctaaagaattatgagtaataaagtatcataatgatatttgtcttagttttggttaagtgtactccacaggagaaagttaggcatgagcaggaattattgtagtcccacattctcaaacagttctccagtaagaaagattttatgtgtttccagaaatcattttcctcctcttcagagctttgggaccataattgtatttaaattgctaatctgttttaaggaatcataataaattgtttaacatttatattcaatcaactttgtaatttgtataaatttttcagggtgacatttgaacaatttttaagaaaatgggaaatacagaagtattcttagttttaatatattttaaaaagatgacatgtgatctactgactgaaatccttcaatcatttttgtttttctccccaagattagatagaatggatgtgattttatttttaatttgcattatggagagtacttttggggggttttatgaaaaagacttcatttattttgttagtggtacttcagttgcataagaaaatgttcttttaaatatagtggtcatttgtgtgcagccttcaagttagcaaacatgcctttgagtagtcactatttttgaaggtctttatatctgattgcaatggcttatattcaatagtcctcctactaaatgaaataaaaatggatgcctcttctgccacagaggcacaggtggacatgttggtagcaagccccatgcggtgtgacacatggcacagcccaacatgggggcaaagagcatgcggcttgagctaggagtcactttatggctactttagtgtagatttgtgtttttctgtggaacagccattattgaagacatttatatagtatgatgtttgtttttcattaaatgctgattgtgatttcttaaaaatagttaagacttgattagcagaacctatttagaagccagagttcccctgcttcacctcttgctatctatataaatgatatttttgactctgtcctttataatgttggcaccctgtgcatattagatgtaatcagggctgaaaggaaacttgaatccatctggaagcaataaacttttctaaaagactgcacagtgttatttaatcctgtgacttcttactgtgagtgaaattaaggtttgatgcagttgtgtcacatcgtattgatatcaaatttatctttctaaaaaaaaactgacagtattacagcacagaggagaagatggcttgctgtaatcctgtaagctattttacattgattacatgctacataatgtacctaagtatataaaatacttgatctagaatgtttatgttttctccaaaattttctcatcaggtaatactttctcaacttcacctttagttttggcttcttatcatagtactaactatgcggtagtaattgtgttatgatgaaaggcatggagaagaaattataattttaaaactattataaagtggagacacacttgtataattaccatctatgtagactgccaaggtataaacatttagcttattttagtatcagactctttgaatcaatttaaggctttttcaataaaattggcttcctctaatttctactccaaaatggttaaaattttgttttacttcaaatacgttgtagggtatcatatttcatgtgactaggagcctaaactatatcagctgactggcataatttgtgaattatatgtgtgtttattaaaatttaaagtttttattaagacttacaattttattaagacttaatttttttccttacattttgagtaagtccaactgaaaataacttagagacttaggaaatttgactacattttataagtaatttccttgtaatttttctttcttgtggaaacaattcttactgatttacttaactcttttttcaatggcaaaaatgaaaaccaaatatatttgtcaactatattcttttaattgtggaaatgaaaggttcatatcccccatttgcctagcatattaaaaataaacatgacctttgtcttgaatgttgttaacttggattttaaaaatcaaaccaattataagctatattaaaattgcttatcaccttccctttgtcttcagtaagtctgggcctaaaaatactcatcatatgaataaataaagttttacaaatactttttagaacatcttgaattatatgtgtgtttgaagcttacttttggatgttcggtcaacaaggcttctgacagtttctttttatcttccctctattccctgccactgtgcaccccaaagtgatccctgaccacagtggtcccattgctggcatcaggaaggtagactgaggagttcaggtatcctagaggctgttaggtgaatctcttctacctctttcctggtcctaggaccactggacacttcaagtaaaaataacaattactttaatctctcaggtaaagtttcttctcccttccagcaacacagatctgcctgtgccgagttcaaatactctgaactttcaacagttgttctgaatacttttttgtcatcttatgatcaaatattgagagcattgaggggataactgaatgggcatggtataaaagtcagacttttagtgtttctaagtagcagaaccctttggacaatttagagggctgtgcgatatcctcaccgtgactgctgggaagtaatgggatctgacctgcagaggtactaccttggctgacaataatgacaaaagtgagagcaaagtacatatgactatccttgaggtcctcaggaaaaaaagagtattagtgagttgaactgtatgtaagggtctttaccaataaggaagcccatgcccagacataatccttacaccctggcaatagaaaccatcattgtggtttacatctcatcctgttcctacagtccagcaagttcaggccacaaaaggtttaagcactttttcctttgttctcatagcaacagttgcccatggaggttcagttacactaatattaacattttaatatacacaaagaagtgcctcgaatgtagtaggtattcaaacttgttaaatgaaagaagtaaactttcagacttaccttgaactactacagttttattctttctctaacctctcccactactaccatcttaaaaccaccatttaattagtattttataacaagttattaaaggctttcaaagacctttgaaccttcaccctctggtaagttaataacttctgatatgcgattaaatgtcaactgagtagtagtgggccctaagagctcagagggactgagaaatgaaggttattgtttagaagagtggctcaatgtgcttcgacagttggttaatatttgaaaagactagagtcaagaaagccttccatgtgctaggaaatgaaggagcaaaggtccagaggtggaaatgtatacagtgtgattaagggattttctgattgatagtaaatacagtcaataaaaaacttttattggaagcctagcctgtgtttgaagcattaagctaggtgctgggatacagagattagagatgaagataatgatgaagatattgttgaagtgaattgctgagaagctggagaaagggccaattaccataatctgaggctcaggaggaattggtgcaaagatcatctggtatgatatatatgaactgtatatacaaactgatctgtgtagctgaactgataatgccaaaaaaaaaaagactaggtttttgattaagatgaatccattaaggtcatgttttctgttggtgccattcttggagacctcccccaaccctatacatttataaatgtttttcctgagggactgagatggaagtggacatataaaaggaaaggtctgggcaaatacataagtaggtagtaaaatcaaggaacaaatgatctcaacaaaattgcccttcttgaaatgaatgaaaatgatgaaagccaatcacattgcatgatgaacttggggtatagaatatgaaatatttaaaattgctttatttcatgatgtttcagatgtagtaggaacttgttgcatagatggtgtaaaaacaatctagtaataaaatcttaggtatttaatacaaggtgaagaaagatgcaatgcataaatcatgccattttaggcttaattttcataaggctatgcctgtctttataagactatataccaggagttctcaagctttttggtcttggaacccttttatactcttaaatcgttgaaaaccacaaagaccatttatttaagttataaccattgatatttgttgtattagaaattaaatagacattaaaaatatttactatttaaaaataaccaaaaagatgggcatggtggcccacacctgtaatctcaacactatgcgaggccgaggcgggtggatcacttgaggtcaggagttcgagaccagccaacatggtgaaaccctgtctctactaaaatacaaaaattagccaggtgtggtggtgggcgcctgtaatcccagctactcaggaggctgaggcacgagaatcacttgaacccagggagatggaggttgccgtgagccgagattgcgccactggactctagcctgggcaacagagtgagactctgtctcaaaaaaataaaaaaaataaaaataaaaataacagtaagttcattgcatattaacataaataacatatttgtattaaaaataactattttccaaaacaatcaaaaaagcagtaccactcttctattttaaattttttcaaatctcccttttctaaaaaaaaaaaaaaaatattgtgtaagtttaaggggtacaagtgcaattttgttgcacggatatattgcttagtggtgaagtctgagaatttagtgtatcttcacccaaataacatacgttgcacccattaaataatttttcaacacccacccccttctcactctcttgagtctcctttgtctatcattccacactctgttcctatgtacacattatttagtacccacttaaagtgagaacatgtggtatttgactttctgagttttttcaactctggcttaatagaagacagctgaaatctcagaatgcttcttcatccagtctgttgtgaatatgttgctttgattcaagtatctaaggaaaatacagttttacacagatgtgcagctgaaaaggaaacatcttttaatatgttcagataattgtggatattgtcctttgatactatagcaaaacttatcaagtgctaatttcttaaaggctggttataatttgaaatctgaaaacatatctatttaattgtagtttgctatttgaaaatttattggtctgtcttgtactttgaatggatattttgcccacgtatgattttataacatcctgtattggccttttggaaaatttggtttactattatacagtttctaaatgttgataatttttattataatatattttaaaaagtctaatgtcactgccagtctcatcagaaaattctttgagattagaaagctgttaagatcatcatcacacttacaagttttacaaaattttaattttactcaaaactttatattttatcattgacaaagctctcagttgctttgcttagtgactgactcactttgttcattttccagaaagtgtttaccaaatgctgctgcctcaataccagagtctgtattgtcagttgatctttcaagtaaaaagtggtgttctatgaaaaacagctagttcagctgcgactgaaatgatataagtgtttctcctggagcaaaccaccacttcgatttgtagcagaaatgctgtatgtatactttccattgttattactcataacatttttaaaaatatactcaagggtggagatttttttaaaaataagtgttattgcttcatcaagaacagttaaatgaaactggattttttaaactgagtttgagttaatgaagaatgcagcaattattagtaaaatttggtgctccaccttgattcatactgacactccaggagttttacccactatttcttttgtacctttagtgcaaatgttaatatggtaggaatggtaaatgacatctttagtattattataaaaatcgtttttaccctgtatactctttgagactacacattgagaattgctgatgaaggtgttttaatttatcataagcactgaaaagatttacttaattcaccaatttctcctgaatatttgtttatataaaacaagactatgtgtatacacctacctttttattaatggtagagatctaggaaaattaatttctaagaactagccaggatatttggaatgtgaataaatcatatatccagaaaaaagctttagaagattgtctatgattgaaagtcaaacagctctcatttctattatactgttctttttcaaagaatttaccaattttatgtggtatttatgattaaacatacaccatgtaatttaacatttttaatgtcacttttacatcataggtattaaagattagcatttttattgtctgtattttaaagctcaaagaataacatttaggctgggtgcggtggctcacacctgtaatcccaacactttgggaggccgaggcaggcggatcacgaggtcaggagattgagaccgtcctggctaacacagtgaaacaccgtctctactaaaaatacaaaaattagccgggcatggtggcgagcgcctgtggtcctagctacttgggaggctgaagcaagagaatggtgtgaacctgggaggcggagcttgcagtgagccaagatcgcaccactgcacttcagcctgggtgacagagtgagactctgtcttaaaaaaaaaaaaaaaaaaaaaaaaatttagatttttgactgtttcattgattcatcttagacttcacatgaaaatatctgtatatcctcaaatgcttacattcttaagaagtatctcagccatttacacatgatagaaacaactaaatggaaaaaaattgcagttggaaattcactattttttatttgatccgataacaatgtgacatttgcgattggactgtaattttctgtctttctctctgaaaataagttcaaaaatttccctctaattcttttactagataagaagcctacttcgttgtaactcttgatatatgtatgtatttaggaacttaagcttttctgctaataaatgttatgtcataattcttgaggatagtattatattgtgatgggttttcagtaaactacaggagcagccctatttgtttaaaccctagtttaacctgattattaacaattaaattgtgttttcttctaacaattaaagtgtgtttaaatttattggtcccttgcttcacagatttatctcagtatgtggtgtattcaaacagaattttgtatttttaattaggggattagataaccaattctgaagagccaaaaaaattgttagacatcacattgcttaaccatctaatataccataagtgtgtgtatacactatgttgtgggagccatctatcaggcaggcctgtttttcaggcagtattttaaaaagtggacatgtgcagaaactgtgagcacaattagcgccaagcagataaatccagctctaatcctgtttacggtctacatcagacagatgtgccaagattgatttagacaagcccgaggcttacagtaatatttttaaaagtgccattcgctgttctatttttgttaaacctttgctaaatattcttaagtcttgttggttttgctcttcttattaaccaccgtaagtaacctactttaagcaggtcccgctttgctctcatggtgacaaggtaacctgccaggagaggttatctttattccctgtaattaagttgacttttccccccaaaaaaatacaacaataggaagtgggtgctgaattaaataaatagcatgatacccagtagatgtatacttaagttccttgcaagaacagatggtccccagtatctctgtaagtaatgtgagaggacagttaatgttctgaaacaactagctataaccagtatgatactaatgaaccagtagatttcaaataataaaccacatgccgccaagcaaaattatatgtcattcataaggatttaattatcataacttgcaaaaaagtgtcaatagatgatttctatatttttatctactgatatcaaatatcaatttatgaatagagtttcacttcatattttttaccaataaaggtatgttttaacattaaggtagaattaaagttatatttaaaatacatgccccaaagtatgtggtgatttttttttaactcctcttttactatactgtctgtatgtattgggctgtatatggaaatgtagcttttacatacaattaggaaaacaattgcttttatttctagcagaaacttgtactataacagaagtggctagcatgggaatcagagtagttatcttgtagatgacaactgaagcagacataaaagatgtaatattttttcagcactcaaaaatttataagtaaaattttataaacaaaaagcagtatttttgtgattcatatggaaaataaaatgagtctgagtcattcttaaggtgataccgtaaaggtgtatagataagaagtccatttttaaatatacccaagacaacagttttttctctcagtatggtttgttttcccttttttctctttaattatgtttcccataagtatttgtatattctaagaatgtccaaaaaataaatgttttgcagtgggggttgaaaagaaagaaagacctttttagatttcagctgatcttatcagatgatctctagaaccttgaaccttcaaccttcactgaagttagctggagggcttttcacctggaaacctgagaaacctcagaagccttctgctttagctctctctcaagtctaggaagccagtggcctgcgaccccacagagccagctggtccactcctcatataagaacttcggtaacaatacaaagacatagcaaagcaccatctaatctgataactcattaaacaatatttagatggctcaagactttaaataaaaacattttaagcttgtttatagaatactaacaagttttattcccaaagactatattcagagtgagaaaacaattttccttaaaactaatattatatacatgttcatatatgttaggaactagttatatgcaaaatcaagtgactcttgtgattagaactggtcacatttattcatgtagcataaatggttaatattgccaaaatgagtaatagatcagattttctatgtgagatattgacacctgagagatttacagtgtttcactgttgtgaaaaatggagtgctgaagaacatttgtctattgttatacatttgtaaaagaattcacaaattactaatttcaaataagaactaaatatttcttctaagcctatagtttttctttttaatttcttctaagcctacagtttttctttttaatttcttcttgtaacattggcaaaaagaccattcgtgtgaaaacctcagattttgatctgtacacaaatgcaggagtagagattggaagcttgagctggaaaagcaggaaatactgctcagagccttacaaggattttcagaattttcactgttgggtcctcctggttgctgcagtctaacctcgcatctccttgaaggcagccccagtttctgatgaaatactcttcagttaatttatacatatgctgtcttgctgttttcctaaggactgcaggcagaactgtggttcacctactgttttaaatttggctagatttaaaaacagatgatctcacttatatgtggaatccaaaaaagtcaaacttatagaagcagagagtacaattgcggttgtcaagagctgggggaggggaagcaaggggatgatggttaaaggtataaaatttcagttagacagaatgaataagttctggatctattgtatagcattgtgactatggctaataatgtatacttgaaaattgctaatacctgaaaatcactaagagactacgtcttaaatgttcttacaacacaccaaaaaaaggtgtgaggtaatgaatatgttacttagcttgattttaatcatttcacattgtaaacgtgtatggtactgatcttgtacctcatttcattttccatatgaatcagaaaaatactgctttttctttataatatcttatacagcatagatacaatttttagtggtcaattatattgtaatatatacataaatatatatgattttcattggtcaattatactgtaataaaacagcaaaaaataaagttgtaattaaaaaataatttggaagaaaaaattagcaagtggttggagattgaggaagatgggaccaataagtcctccaaggagagtcatacattagttttttttaaaagtccattattaatcttataatatttaatatgtttaatttcttgacacttattaatccaattaagtatgagaacactgtggataaatctaaaaaccttaaagttgagtaaaataaaccagatacaaagaagcacatactttatggttacatttatatgaagttctagaaaaggcaaaacttagctatagtaaaaaaatcatggtcctgagggaataactagagagtggtatgagggagctttctataatagtgggaaaattctgtatctttattgggatagtggttatgtgagtgcatatacttaaaaaaactcatggaattatgcccttacaaatctgtaatttttgttggtaatttataccttaataaaaaacaaaacagatgacagggttagtgattgtttccttgaagaaggtctttacatgggtctgttgttaacgagttgtagtaaaaatcatccaaaatgcttggattcaaatcttagatctgttcctaccagatgtgtgaccacagacaagttacttacattccgtcttcagtttcttctcttttaggaaaaagcatctagtttttgttgtagagattaaattagataatacaaatgaagtacagagaacagcgtttggtgtgtaacacatgttcattattagctacccttattttttagagaatggaaatttttaaatttaaactaatcaaactattttaggataagcaagtgaaacaatctttttttcaatcgatcacagaaatattttcactgaagacaaattagacatttatataagcaaactacagtgtcattaccattcaaattttcatatgcatattcatgcttacatgcatatgaaagcattacacatatgtattctataaatatatacaaaacagtaatggaaatgtgctgtactattttgaacatctttctagtcagcccggcattttatttacttttgagacagggtctcactctgttgcccaggcttgagtgcagtagtgtgatctcagctcactggaggctggaggtcctgggctaaaggaatcctcctacctcagcctcctgagtagctgggaccacaggaaagcaccaccatgcccagcttatttggtttattttgtttgtttgtttattttttatttttttgtagagatgaggtctcactatgttgcccaggctggtctcaaactcctgggctcaagttatcctcctgcctcagcctcccaaaacactgcaatcacaggcattagccactacactgacctctacattttaatagctgagtagccttctgttatatgaatatacttttttttaacaaaaccaatactccattattgtacatttaggttgtttccaagtttcactcaaataatgcttgggtaagtaagtatttttatttattattattatttttttgagatggagtttcactctgttgcccaggctgaagtgcaatggtgtgatcttggctcactgcaacctccgcctcctgggttcaagcgattctcctgcctccacctcctgagtagctggggttacaggtgcacaccatcatgcctggctcatttttgtatttttagtagagatgggatttcagcatgttggtcaggctggtctcaaactcctgaccctgtgatccgcccacctcagcctcccaaagtgctgggattacaggccgtgagccaccacgtctggcctggataagtattattttagctaaattgtgcatatttattcccttagagtaaattcctggaagtaaattgctggatcaaaaccaggtatattttaaagaattttccttttctacattaaaaataattataattctgattacaagaaaggaaaattatggagcttcataagaaaaaattagtctcatatttcatacctcatattgcatatttaataggtaaccagtgttaaatttgttgtgtgttttccactgggatttctttttatctcctttaataaaagcaggatcagatccctcagattactttgtaacttgcttttattctactttttcatacctcttagcatgaatgtctttccagaccagaatacagagatttcacttactcatttatgagctgcagaagatgactatgatttattcaaccattctcctattgaagagcatgaatattgcttcagatacttttgttattataaatattagtgcaattaacattttaaagtcttttgatacatattcccaacttgttctccagcaattaccatttttgcattcccaccagcactggggctacttccctttagttgcaccatcatttagcattatttttgatcttgtgccaatctaaaaggcaaaaagtggtatcttgttgttttaatttgcatttctttgattactaattagattgaactttttcatttgttcattggtcaatttgcatttcttcttttgtgaaatgcctgcttgggtcttttatgtactttaccattaaagtgtttttcttgattaaatagattatgtaactgtcatatgttgcaaatatttctgtccatttggcctttgcttatgactttttatgagtctttaggacttttgaggtctttattaggtattcaataattttaatgttaaatatattgatgtctgtcttcctttgtgtcttacggcttttctatttaaggttacgtaaatttctaatatacaaatattggtgtatattatgaaatagggccctatttttctttacaaaagattagtcagttctaaatcatcctttgctatttctagcggcgcttagatgccaccattatcacatcagtgaatttttaaatgtgtaattgtttcctgatctattcatttctctattcctagatacttctattgtaatagctttaccaaatatatctgatagggtgtgtactccccctcattacttcatttatttatttatttatttagagacagagtttcagtcacccaggctggagtgcagtggcatgaacttggctcactgcaacctccgcctcctgggttcaagggattctcctgcctcaacctcttgagtagctgggattacaggtgtgtgccactacacctggcaaatttttttttttttttttttttttagtagagacagggtttcaccatggtggccaggctggtctcgaacttctgatctcaggtgatctgcccttctcggcctcccaaagtgctgggattacaggtgtgagccactgtgcctggccccctcattgcttttaaaacattttcttactgtaatatatttattccaagagaattttcaaatattttatgagattccttgtccattccttacatcaaaaaataccacggagattttgattgaagttctattataagtagttacttggggtggggggaggggggagggatagcattgggagatatacctaatgctagatgacgagttagtgggtgcagcacaccagcgtggcacatgtatacatatgtaactcagctgcacaatgtgcacatgtaccctgaaacttaaagtataataataaaagaaaataaagagaatactggcatggaaaatatgtaatcttggaacttgttgtatctccacttattcaatcctttgtctctcagtagattttgaatggctctttatcccacacgagtctagaatcattttgctaagtttattcctagatataatatgctaattgatatgggaattttttttatctccattataccttcttcttgggtgtagacatatttgtagccagcttcctcactgcatattttttattaggcctaatggcattaagtttattattttggattttacaaaaaaaattatgataacatctttaaatagttagtttcaactcctcctttccccttaaatccatcaattactgtcttttatttcactttccttatgtactgactagaatgcctagaataattgaatgctatgagtaataataggtattcttgccctgtttttggaaatccttctggatttcagtaagtgtgatgttggcttttggtttagtatctttaaatttgcaatttacaagatattttacattggaatagtcattgagttgttaagtaaagcacaaacatgttaaattcagactgaagtacaggacttcaatgaaaagttaaaagagtttatttcatcactttcattttttctttccctcagtggctgtttgtcccctccccccaccccgctccatcccccagcttccttcctttgtgctcttattgttctaggtttgactacataaaaagagactctcaatttatatgtgatacaagaccataactaatattataaaattagtctagaagaagttatttgcaacctatataataagggactaatttcaagattatttgaaggactttaaagattggtaagaaaaaaatagacaaccgtttagaataaggcaaagcatgtgtagaggcaactcttaaaaaaaaaaaagtgagctgggtgtgatgatgcacacctgtggtcccagttactagggaggctgaggcaggaggatcacttgagcccaggagttcagggctgtagtgcaccacagtcacacctgtgaataaccactccattctagactgggcaaacataagaagactctgtgtcttaaagaaaaagaaatgaaaagatattcagtttcattaattgtttgactagctgatttttggaaaatacccacaaatataaccaagcctacaagttattttaaggtgggtaagagatacatcttatctatatgcattcacctatgtgaagcggacacccagtaacacccccgtgtggaagacaagcttccttaaacttcacaggacagtatttcccatgtagtccatcatagggtgaggatttttcaggacctttggtaagcctgcttgctttcattcttgagggtagaggaagggtgcaagacttccctggtctctcccaagcattttggggaccctggccataagcctacttgctcaacaggtgcaaatgactggtaatatgctgaccagatgcaagtgtaccaccaatgatttgctgtgactgagtttggtttcctttgcatatactatccagctttttgtttctaatatattcttccttaagggaaccaggacttcttggggaatccagatgagcttgaaacactgtttttataagagaagggctgttttcaaaaacatctatagttcgtaacaaaggagttagattgaagggactctcactgttcagtctgtgacaagcatgagtgttaaaatggagacaagaattttagttaattgtaatgttgaatttgtaaaaggctataacttcataatatgatcaaggggaacaagcaatctaaaatgtgttaaagtagcattttcaaagtgcggtccagggactctcagggttggtgaggtcacaactgtttttataatattgctaagaatgtatatcactctccttctctccaaggatacggtggagttttccagaagctatgggatatgtggcgatagccttgccctaatggagtgtgtgctttgtgctttgcatttttgtcctttaaaaatgcttggttttaattttgaatacaataattatagatagatataacctacataaaccaaagttatttgcggccctcagtctttaagggtgcacagtggggcctgagactaaagagtttgggaattgatgttctagagaaaagtcagtcttactgatgagggttaatcaattagtatttactgaccgggacaggacaaaccattcattttataaagacacacagagcatttcactaaaatacttttactctgattaagtggtgattttagtaatagtaatgattgtttgattttctgatacctgaaggaaaaagagcctgttgaattgatactttgagggtgttgagttttaggtcactgggtgactgtagaaatggaccaggagaagaactgaaacttgagccttctaagaaatagaagaccaaaaaatgtttagtgttaccctatcccatgaccacaataattgagaaaaaggcctttccgttccctcttccctaccctcccccttctcccctaccctctcctcccccctcccctccccctcctctcccctaccctctcctcccccctcccctccccctcgtctcccctaccctctcctctcccctaccctcccctccccctcctctcccctcccctctcctcccccctcccctccccctcctctcccctcccctccccctcctctcccctcccctccccctcctctccctccccctcttctccctccccctcctctccctaacccctcccaacctttcccctccttctctgtccccctccccctccctccctgtcttcctcccaccccccactccctgtcttcctccttgtcttccatcctcccttccttcctttccttcctgtctttcttttcctttctttcctttttcttctttccttcctgtcttccctcctctccgtctgtctccttctccttgtccccttctctctgtcttgcctttcctttccttctgtctttttctttctttctctttctttttcactcttcctttttttaatttcccttttacttgccttctctctttcattccttccatgctttcttttttttagtggtatgtatactttgtgagcaatcagactatagcttgcagaatagttgggagaggccaaaaatgcccctgagaatgcaagcaaggaacttcttagtgagcatatgaacatcctcactccaatcggaggataacattgttcatacttcaaggactaaaaagctgagagagggtctctgctttctgttacttttagcactcgagtcatttctgcatgtatttctactgattactttttctcctattttggttcatatgttttctgcttctttgcttgtctagtgattttggattagatgagtgacattgtgaattttactgtgcaggatggctgaattttttttctattcctgtaaatatttttttggcattgttctaggatgtagttaagttacctggaaaaagtgacatccttttgagaggcttgcttttaagttttgttaggtggaatcacagcagtctttagccagctcactaaggaccaatactcttctaaatacttaccataatgtcatatgaatttccatgtttttccacttcagctggtaggaacacctgtgtcatctctaagcattgtactgttaattcttctagtagttcttatctggctttgtacatctgctgatcaatactttcagctaaagtctcaaggggacctctgcaaatctacagtgttcactgttcagctttctcttctgtagtaaattgcacagtgaactctagtccccttagccttcctgaacccccagttctccttaactcagggagatcaccaggccccaccaggattcctgtatctgccctgtgacctggagattctctgcaggcaataggttggggcggtcgtagggtccactttgttttcctcctcttcggcttcactgtcctgtgttacctgatgtccaatgtctgaaaactactgtttcacgtatcttgtgtgcttttgtagttttaggtgaaaggtaaaactagtttcttattattccacattggccaaagcagaagttttggaagtctttttttaaggtctaaaacacttctactttgagagtcaattgaaatggtcttttccacaataattattttctgacctatggtttaaagataagtcatgaaaattttatgccactatttttttttaagtctgattatggttaaattcagggggctatttcctcctagattgacagagtttataatgtttcctactcacaataattgtacttctgcttcctctttgcatgtgttactttaatgggaatgtatatttccttttcgttaaggctgccttcaacaatttgtcataaagtcacttctgttagtgaattctattttttctgttactttactctatccttagtaccaaagagctccttatgtgacaccaatttattactaaaatgtcgctttgtttatgttcttggaattcttcatacattgactatcctcagatgtcgaatgttgtaggcctgtgtggcagggactctcttccatttattctatttttaatctaattcttgacaaaataaacccaatttttcttttcttcccctttccatctcacgtagggactggcataaagggcaatccataaaattacaaatgatgaatttttttggttttaactattattcatacatttaagatatggtcacaatttttatttcttactagtaattcattttattttttaacttttaggttctggggtacacgtgcaggtttgttatataggtacatttgtgtcatgggggtttgttgtacagattatttcatcacccaggtattaagcccagtacccattagttatttttcttgatcctctccctttgctcactttctaccctctggtaagccccagtgtctgttgttcctttctatgaaacacaatggttttaattggaaaatttatttttttttcaggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggtaagtactcctcatgggaaattttaatcagcccagtttccttgatatacatgattaatctagacatgttttgagtaaaaacaactttagtgatgttgagatagtttccttctgttcctagtttttgtcgtgagaaagtgttgaaatttgctaaatactttttctacattaattgagataatcatatttttccctacatcctgttaatgtggtatcttatattaattgattttcatatgtttaacatccttgcattccaggaataactccccaatggccatggtgtataatcttttaaagatgctattgaatttggtttgttaatattttgttgagtatgtttgcatcaatattcataaaacatattgttctgtagtttttctgtactgtttgtctgactttggcatcagggtaatactggcctcatagaatgagttaggaagtaactcttgaatgactattttcatgaagaagcttcaataatctgaaataaaatacttaaataatttagttcacctgagagttgtttttagaagcgtatttatttttctattaatgtcttttttgaactatataagaatgtattctccttccactcacacattgatggcaagtgtgtatttgtactctgtggcctgaaaataagatttttttgaataatcttaagaggccatgctttatactctggtaattgagaattacctatttcacagtagctttttctaaaggttaatttccagagaaaagagaacatgtttattaggatatatctcttaatgaattcagtgtatctgaaatttctaaatgacattttcatattttgcatactaaataaaattcataagtacaaatataatgcaattcataagtacaaatataatgcaatttggatttctagaagttatctagttaaaatatgatcttaggatttattttttttgtcttagatttatgaatcttgcttgtttttctgttaattcatttcttcttgtttgctgcatcagtcagatcagagtagaggcagcttgtatagttgatggcacagtttagggttagatggcacaggatagaaatgggtgctagacaaagagcagtcacagaggcatgttagaaatttccagttccagcatcattgatgaagaaaaccatgaggacccaagttgatcaaaggcagccagccaataaagctatgctcatgcgagatgagctgaagtgacattacattaaaattggaagaccctcttactaagtggctccatgcttccctgctagcccctttgggacttccaagaagacttggttatttcaagaagacaagaacccacagaggctgtagtttagtttatctctctggaaacatagagaatatgtataattaaataaaagcactttaatagtgaatcctttacagtgttatttgaaatttatgtcaagtgatttaaaaagtaaaaatgaaaattaataatttcagtggaagtaaattgattaacatgaccaggaatacataaaacttgcatggtcttgtctataaaataaggatatgtcatttaattaggagagtcaaagctcattcttgcgcttaaggtctgaggaactcttctcccatggggcttatgaagggctacactgaggcaacttcctcaatatatctcagccataaaaccaagagaaagtaagaagcagaggacatcacaacaaagctcaattcagtaaaagcaattttataggagtagagggacttgtcaaaaacaaaaacaacaacaaaaaacaatgtccaaatatttattcagcttaatgagtgatgtttttgtttgatctagggttaaaatctagacaaattacagagatgaataaactacatatcctttagtctaccatcctctgaaaatgttactttttgaaactttgattttgataagagctggaggcactcagggagtcattctctggcatggtctttgagtacagagtgattttgctgattaaaagcaaatagattgacttttaaaatcaactcatacaaacaaactgttaaaatcctctaatgagagtgaagaaacctaaccaagactgactgatacattactgctccatctctgcaccaaagtggactcagggaggcctgtaggagatgccaactccttatcctactccccacaaagacagttcttggctatcttcatcagacacaaatgaatggttgaggctccaaagctctctaccaattcttgtgttacactggcacttttaaaaaattttgtttattttttatttttaaatggagtctcactctgtcaccctggctggagtacagtggcgtgatcttggctcactgcaccctttgcctcccgggtttgagcaattctccctgcctcagcctcccgagtagctgggattacaggcacccgccactacgcctggctaatttttgtattacttagtagagatggggtttcgccatgttggccaggctggtcttgaactcctgagctcaggcaatctgcccaccttggcctcccaaagtgctgggattacaggtgttagccaccgcacctggctggcacttctcttaaaactaatatctcaagaagttttttctttaagaatcttctttcaattgcaggtccatgtagttctggtattcattaaagtgcctatcccaggggttttggtatgttgtgtttcaattttcatgtttcaatttttttgatttatgcattaattttgttttttcagaattcaggtgcaggttgtttagtttccatgtatttgtgtcgttttgagaattcctcttgttcttcatttctaattttatttcattgtgacctcagaagacacttgcattgattttgattttttttatcttattgagatgtgacttacgactatgtggtcaattttagagaatgttccatgtacagatgtgaaaaatgtatattttgtgttgttgggtggaatattctgcagatgtctgtcaggtccatttggtcaagagtctgatttaagtccagtgtatacctttgttagttttctgccatggtgatctgtctggtgctgtgagtggggtgttgaagtcccccactattattgtatagctttttttccccataggtctagtagtatttgttttatgaacctgggtgctccaacattgagtgcatatttatttaggatagttaaatcttctggttgaattgaaccctttatataatgccctcctttgtctctttttgatgttgttggtttaatgtctgtttcttctcatacaagtatagcaacatctgttcttttttaattttctatttgcatgctagatctttctccatcccttcactttgagcccatggttgtcattacatgtgagatgggtctcttgaattcagcagaaggttaggtcatttaaaaaatctaatttgccactttatgtcctttaagtggagcatttaggccatttatgttctaagttaatattgatatttgaggttttgttcctatacatttgatatttgtgtattgttaagtagttgctttctagtttgaattgtgtaattgctctataagatctctgagccttgtacttttgtgtgcttatatggtagcaagtattgttcttttgtttccatgtttagaactccttggagtatttcttgtatggcaggtgtggtggtaacaaattcccttagtgttttcttgcctgggaaagactttatttctccttcatttatgaagcttaatttggcagattatgaaattcttggctggcattttcttttttctttaaggaggctaaaagtaggcccctgatctcttcttgcttgtaaggtttctgctgagaagtcctctattagtctgattggatttcctttataggtaatttggcccttttctctagatgcctttcatattttttctttggtgttgaccttgcatagtctgatggactatattccttggggatggtcatcttgtatcttgcaggtgttttctgaatttcttgtatctggatgttaacctctctggcaagattagggaaattttcctgaattattgcctcaaatatgttttccaatttgcttacttcttcctcttctccatcaagaatgccagtaagtcataggtttggttgctttacataatcccatatttatcaaaggctttgttcatttttcagattctttatgtttgtctaactgggttaatttgaaaaggtggtcttcaagctctgaaatcttgtcttctgcttggtgtagtctgttgttaaaacttccaagtgttgttttgttttgttttgttttgttttgagatggagtctcactctgttgcctaggctggagtgcagtggcatgatcttgactcactgcaacctctgcctcctgggttcaagcgattctcctgcctcaccttctggagtagctgggattacgggcgagtgccaccacccccgactaatttttgtattttttagtagagacaaggttttgccatgttggctgagctggtctcgaactcctgaactcaggtgatttacccatcttggcctcccaaagtgctgtgattacaggtgtgagccaccatgcctggcctgcttccaagtgtattttgatgttccctttagtgaatttttcaattccaaaagttctatttggttttatcttaatatggctatctcatgtttcatatcctgcattgtgtttctggtttatttgaaatggattttaaatttctcttggctctcactgagtttccttgcaatacatattttgtttttttagtctgtcatttcaaagttttcaacttggttaggatccattgctatagagctagtgcaattctttggaggtatgaagacactctttttgtagtgttggagttcttgggcagattccttcttatctgagggagctgttgattcttatttttgaatttcctattggttgggcgggacttaaactttttttttttttccccttgagggtatgactatggtgtatgttgtgtgtgatcattcaactttgtttctgggtgctttcagggggccaaggctctttatggattccttgggcgtggtagctttcttaaatgctgcttattgtagcaatgtattggatttgtgagctgacactctatctcatgtggggctgagggtgcagaagtctcaggaagcttattttgtggagtagtgctaagcctttctggtagtgggctttttatttgatagtacagttcaggctgcaatccagtagatggcacttaaaaaataagaaccagcttgccctcagttaggctgatgtccagtagaagcacctgtcctgacaggggagtgacaggaagagattctgttggtgtgtgccgaggcctttggggtcgctggttggggggagatagggggaggtgcactagctcctcatgcaggaatgtgatctgcttttctatcataccccatcagagggctcatgaccttcagttcataaagattttttccttgggttcccagccatagtctgtctgtaggttatgcatatgcccctctgaaggcaaccaccaaaatggtcttggggcagagcctcttcccccagtctagggcagacaactccatgacttgtatgtcctccattgctgggacactgctgctctgtgtagggatggggagttgggccccaccctttatgtaagcctaagtggcattctcactttcagcaggggtggagccatcttgaaaaccatgaaaaactctttcttcgagtacctgtgctggcccccagtgggaagaaccactgctgcgtcttcaacagcgtgtggggtgggagggtattgccacagatgaccccctctccatatccgttccttgacatggtgttgccccctttagcgattggcactgtgcccacctttcctttgtcccaaaggggttttggcaagttgtgtccctctcccttataggtggcctacactaggggggttagatctctagaggttccatagctccctgggaacttgctggccccctgggcttttcaaagtcagaacaggttatgaggtatgtttgctggggatctggtgctacagagactcaagggtagagaatccctgggcagagcagaggcccaccactggtgcacaagcaatatggtgaccaccatctcagtttgtgtctgaggggagtatgggaacccctgcaggagctggccacccagttctctatccctgggaaattcctaaattaccaccaataacattgccctgggtcacaagggtggggccttgaattctttgggggttgatctctgccagactctagctacttttcctttctgcaccccagcttcttcccatgggcactccaaaaggtcctggctctctttccccagttttccattagaaacttgtccatttgacagtaactttgatcttctttctaagaagagctggcatccaaggtctgtggtcagctatgttggaaaaaagaaggagaaaaaaactagtttgtattaaattctgaaagactagtggcactggttaagtctttaaaggattgttaacaaaagaaaatctttttaaaccaaactcctaattttatcagaattgtaactgaaaatataaatgtatgaaaacataggtattatgtaaaatttgctcaataaaagaataggaaaaactactatttatcttggactgatagcatgttagtttgagatttgaaccctttctactctagtaagtagtggtgggaaaaattcactgtaggagtctgcagacataacaaactatcattagactgccaagacctccacataataaagcaagcagagaatgtcaaataagtatgtgaaaaatgatcaaaaaagagaaattgaaaatataaatagggtgctattaaaaaaggatagcatttatgttatgacatatgtacacatgaatatcactttttagaatttcatccttcttaggacttattcctgagtccgaggattgagaggttctgataaaataagtctcagtgggttccaggcatgggctttctttaaaagtctctccagggattctaatgtgttgccaggaccaagtaccatggacagccaagatctcatcagcacagtttgattgaatgaacttatgtagaaccctgaatgccacacttaaccaaagaaacctttccagggattaattataggtgacagaacatgctatattcttattaaatattattaaaagttaagcaatacccattcctgattcatgtaaaattctcacttattttccaagagttttactgtatgactggtttatgggatgcttggaaaaggttgacagacatggcaaaggttcctgcagtgtttctctttgtccatcaacagccctagctcataacctctaccctttcagctaaaagcaattagctcttcagaagtgattcattctatttatacttgggataagtaacatcaggcagtcttccctagggcttctcacgggccctggtggcatttttattctaagagagggttatatttttacatgtaattggtcataattatactaaaaacaagtaattggtgtcttatacaagaaaattatatttctgctttagtcattgacagagtatcctgagaataagagttaagaagtatattcattgtcatcttatttctgatatatttcaaattcttttgctaggaagaagcccttttgactgtgctttgtgtaacaaaacttcttcggagaaacaatttagataaactttgtcagatcttatgtgattatattcaaaatgctaattgaagattctctaaacattttcagtaaaatgttgaattgttttcatgctgttaaataagttaacatgtcttcctttactaaagtcattattataaaaatgtaaatcctaatgataatagctgatgtttattaagcatttagtaggttccattttttgatagcaacttttatgaattatctcattaaatcttcataataatagcatcaagaactacaaatatgttttcatgtaagaagggaaataaaattatgagttttgctgtgaggtttgaagaatgaaaacaatgcatgacttagaaaatagtataattaagtgaattttattatcattatcatctcttagtttataaatgaaaaaactaaggcttacataatgtaaaaatcagttaacaaggttaaacaaccggtagatggtagaggaggagctgggaataaatctgtacatgtctgaatctggagcaggaacccttaactgatgtgtcattctagcaggtcatcagttactctacaatacctattaagtatactttatttactgtgtttagatttatagtagatttagactctactgtaaaaacaaggacttcatacacctgctagaaagtatccatatcatcttgtttgaaagttgtcccgctctagtgttcttttctaatcatgatgattcagaactccaaactcttgaagcagggcaacccgtagggtcagcattcataatttctcaatacttaaaaaagtttcctcatgactgttgctattattgagatttctcaaatgtcttggcctgaattgggtgtgcactatgaaaaaaaaaatggcagacatttctttttgttaaaggaattttaaaaacacatataaacacactgatttgtgacagattaccaggctttatgtttagcagggtttcctaagcaaaacacaaattctgtaaatctacagaattagataaaacattgactcaatccttagatgagagtataatggattatcacttaataacttctgtcactgaaaataaatgatgtaaaaagtaataaagttctactctcacagtatgaataaataggaaatacataatactttaaattaggcaacaaatcattaagcccccagcattcattagactatcattaatgataataaaattgtgtggtatttatacagatattatatgtaactccaggaattttgttataattgtgtatgaatatatttgttgtttgaggcaggtagatggatatttgcagcagctatgtgctgaagcattctggtaatagttttcaaatcaaccatttttttctccttgtcgatcatctttaaagcaaaagcaccgttttttactatattttttgaaaaaaatacattaggtgtaaaattatatattttgaagaagttcactttctgtttttactagtttcacacctttgttattttttcagtggaaggagcagagataggcaaaggcgaagcctgtgtgtgtggtcaggttcctgggcccttcatagcatctgatgccaagctgtgttctcttttgtgtcattgccttcccacttgctaattacgtgacagagctagggacttccctctgtctagaatgccccccatctcttgtttgcctagtgaaatctggtttgaagttcaaggtctgatacaaaccaggtgatcctctgcaaaactaactgtacctgagcaaaccaggcacttactcttttatatgttcctggcactgctgatactctgatagaaaacatcatcacttaatgctaactgtgggctcacaaaggggatacttctactgtaagaagactgtaactcttcttagcacagagattagtaagtacttgaaacagagtttcacatataataagtgttcaataaattttattttttatttctaacacttggcacactgcatagctcagtaaatgttggtgaagtgaactgagtattctccttatctattatgtggtaggcattattctagttgcttctgttataaaccaactcatttaatccttatcacagcacttttattgtggtcaatattttttaatcctcacagatggctaaggaatcagcactctgagagattggttgacttgctttgggtaaggtgcttataaagtggtagaacaagattcctatccaggccttctgattcaaaaatacattctttttttttttttttttagtagtgttttctggaaaggcagggtataactgactatgctgtgtatttgggactaagtatattattgtcaagtatattaaaaatgtcgcaacactggaaaggagtccatcaatgggctatgcaggttgagggatttgtagatgagaaactgataaatttggttagcaaggaaagccatcaagctgtgaaccctttatattggcaaaagagagggtcctttgaaatctaagggaacagaactttcctgttctccaagtttggagcagaataggtaagctctaggcagtctaatgcccaacttttaccagtggtgttttagttttttttttttttccaaaaggaaatgatggaattctttatatacttctgaattgtctatcttttcaaaaataaaaattttcattttgcagtacatacagaatcaaaagactttcaagtcctaactccacaaatgtttattttgaagctctttaaactgtttaccacggatattagtaaatctgtcagaaatgaggtgacttacttatccttgtcccaccagatatgtgggaaggatgatcacgctagatagcatggatgggtcctctatttatctctttttacttgaatggaaaacacatcattcagattaatcaattagtcattgtgactgatagaatttttatatggataatctgggtttggtccctagctttaccacttacttggggtctttatgtcttctatggtctcctatctgtaaagggaagttgataatgccaatctagctaggttactgagatgcttaaatgtgtaatgtatgcaaagcagcaggtactcaataaagggtaactcttactattattgtatagctctccaggtatgtattgagcttctatagaatccatagccccaaactctttagccctttgagaccaagattaagcattgtctttccagaggagagggtgagagagattgccattatactaatagaattcatcattatcaccgtcatcatcatcatcatgatttcttggtgtgtcatggaatgtactgtgtttcacattaccaacagatgttaattttcacaacatccctgagacaagaaactatgattacattttacagataaggtcatgcagctataaagttgtgaaattgggattcaaactcaggcagtctgtccccacagtccatgttcttaacccaccatgctctcctgacacttgaaaagttaggaggcgtactccatagcctgtaatgttgctgcagagagaatctaattttaaatccagtgaagcatattagttgctgtctttgatatgccattcagattgtgctatccttatgatgcctaccttggttgtatatgtaactgggcgtcaaatatataaatactcaaaaagtgataggtgccaataaaatattttatagttaatacttatgtaatctgtgttctctgtgtttgagggctggttctaaaatactgctctatatttgacttctggttaaaacaataaactttgctcatattagttatatagttgataccattctcatgttgctaacatgtctgtaagtaacagttgaaattgatctggcaattttagagctgtcagacccaggagatgagagaaacatttaaaatgtttataacattaaatcagctgagtcaagagagagaaagagaaagatgattcagatttcttgtactggtggatgtaagtgcttggaactgaaataaaggagaaggtgtagggagggagaaagataaagaagtcttccctttatacaagttgaaattgagttttctttgagatatagaggtgaagacattttaagaaacttcttaaaactctctaatgtggcttttcaacctgtttccatcaatttggcacatctcacttttcggcacaacagaatattctaggtttatctcacaccttccttgccccagcccaggaatcagccatttctctaagaaactcttgtttattttggtggggaacagtattgggaaaccaacatctgggagctaaatatactcctagtggttaggaggtcataccttgtagactcttgtagctgacggagttaggacatatttattagaaatcataagtttatattgatcttgctaggatctatccaatcctacaagattcttccctgtgtctctcctttgtatttgtgtatcctttcttccatattaagaactgtggctcccaacaacaaggcatgtgcccatttgcccaatcgtatgatgtataaaaactactttgagaaaagtggcagccaaaccactaagaaaaataaacttgctgaaatgagttcaagatttattggcagctctttttttggcccctagactgaaagtatatatttcaagtattgtgttcaaaaattatttgggttagctttttccacctttcataatagtaatattatttacttgaaatacagttggctttgtttctatattcagtttttttctctctatcttcattaatttcattatatatatttaatatgtaggacattaacatgtttccaaaagaagaaaacactccttcctgtatcatttccacctcatctctcttaccccttataggtaaccaattgcactggtttctagtttatcttacttatattcctatttgaaaagttacctcatatatgtatgttttttaaatttttatacttttttacacagaaagtaacgttcagtatgtactttgccactttccttttaaacttaacagcgtatactggaaatcactccatatcgtgtcacagagagcttccttatattttttaatagctgtataagacttcattgtgttgtctgtaccatattttattcacttccccatgtgtggacattttgactgtttctagtatctgcaattactaataatgctgcagtaaactttgtgcatatcgtaccttggtaaatttctagacatagatttctgggttaaaggttaagcacatgtgtagttttgttagatattgataaattcctttccatggggtttatatcatttttaaaatatttaccagcaacgtataacagcgtccattacttcaaagcctcaccaacagattgtatgttttaagtacttttatgttttagaatttttccaatgcgataggtaaacaatggtatatcaatatagttttaatacattaaagttcagcatcttttcaagttcggctagtctcagggctattcttaatatcttgtgaattatcttcatattattttcccatattccataatacttttggttttttttcctcctcaattctgacaagttctttatatttcaggaatattagccattttatttgatatgttacaaatatttttctcccaatatataacttttctcttataacgatttttttttcatgaaaagtttttaattaaaaccttttatgggcccaggtgcagtggctcacacctgtaattccagcactttggaaggctgaggtgggcagctcatttaaggccaggagttccagaccagcctgaccaacacagtgaaaccctgtctctactaaaaatagaagaacattagctgggcttggtggcacatgcttgtgatcccagctactcaggaggctgaggcatgagaatcacttgaacccagcaggtggaggttgcagtgagtcaagatcgtgccactgcactccagagtgggcaacagagtgagactctgtctcaaaattaaataaatatataaacaaaaccattatgggccaggtgcagtggctcattcctgtaatctcagcactatgggaggtcaaggtggttgaatcatttgcgccmaggaactggacagaccagcctgggcaacatgggaaaaacctctctctaccaaaaaagaaaaaaaaaaaaattagctgggtgtggtagcatgcaccagtagtcccagttactcgggctggtcacatgagcctggggaggtcaaggctgcagtgagcagtgattgtgccattgcactccagcctaggcaacagagtgagaccatttctctaaatacatacatacatacataccttttgtggagttaaatttacacactttttctttattggctctggcttttgcattgtagtaagactttctttacactcaacttatagataaattcacccatgttttcttctagtacttgcatagttgaattttagatctctagtccatttggagtttattttttgtatggtagaaggtattgatcctattttttcccaaatagttgttacccagttgtcccaaaacaagttattgaaaagtccatctttgtcccagatagactggaacaaaatgaattaaagacttaaatatgaagatttttacttgtgtatcctttcttcctagaaagaaaacataggcgtaaagcttcatgacgttgaatacttcatgccattggtctggcaataatattactattatgaaaggtggaaaaagctaacccaagtaacttttgaacacagtacttgaaatatatactttcagtctaggggccaaaaaaagagctgccaataaatcttgaactcatttcagcaagtttacttttcttagtggtttggctgccacttttctgaaagtagtttttatacatcatacaattgggcaaatgggcagatgccttgttgttgggagccacagttcttaatatggtagaaaggatacaccaatagaaatatttatatttaagtctggcaatcatttttaagatgtgaacttgaacaggcaacaaaagcaaaaataggtacgttggattacatcaaacccaaaagctcttcacagcaaagggaacagtcagttgagtgaagagacaacctatggaatgggagaaaatatttctaagccacacatctgacagagggttaatatccaaggtatataaagaactgcaacaactcaatagcaagaaaacaaataacatgaataaaaaatgagcaaaggatctgaatagacatttctcgaaagaagacataccaatggacaacatgaaaaaatactcagcatcactaacaatcagggaaatgcaaattaaaaccacagtgagatatcgcctcacacttgttagaatggctgttatcagaaagataaaagataagtattggtggggtgtggagaaaaaggaactctagcccactgttagtgacagtgtaaattagtatagctgtgatggaaaagagaatggaggttcctcaaacagtttaaagtagaactaccatatgatccagcaattccacgactgggaatatatccaaaggaaatcagtatattgaagagaactgtattttagtgattattgcagcattgttcccaatagccaagataagggatcaatctgagtatctatcaatggacaagtgataaagaaaatatggtgtgtatacacaatgggataccattcagcctttgaagagaaggaaatcctgtcatttgccacaacgtggttgaacctggaggacattagctgagtgtaataagccagccaccaaaagaaaaataccacatgatctttcctatatgtggaattttaaaagttgaactcaaggaagtagaatagaatggtagtgaccaggggtatgcgataggctgagggatcaaggagatgttggtcacgggatacaggatttcagttagataggaggaagaagttcaagaggtctattgtataccatggtgagtatagttaattataaagtatacttgaaaattgttaagagtagattttctgttcataccacaaaatgataagtatgtgagataatgcatatgtaaattggctcaatttagccatttcacaatgtatatatatttcaaaacaacatgatgtacatgataaatatacagtttatttttaattaaaaattttaaactctctaattggtcttcaacatatagtacacaagtcttttcacgactctttataatggaacatatgttcttggaatgctaaaaattattttttttggaggccctgcaaataactaaaaatttatcttaaaagccacacctaattacttacatatgatccagaaaggatactttgaaaaagctttttaattgataaaatcattaaggtaaaacatattcataaaagtgttctctaataattttataattttctagttcatgaaggattaaatatacaactatcatttgaattggattttttatgaggttaattgtatttaaatgctaattattttaactaattttgtggttgacttctatgtagagtagggaaaaagaatttcctaaagccagttacgtatatctctttttagtctggatttttaattaggaaaagtgatatagttaaataggtctactctatagcatcttctaaaatgagtaaaaattcattatatcaggataaaaaatgataaagatatatggatgacacatttggctgaatttttcttcttcgctgttctcttgctctctatttaaatagtcttagctcttttatcatttaaattctgaagtattgaggtgattattccggcagcaggtgattctgctaattactgttcagtcagttttagctattagaaacagagatatgtttacattgctgggctgcatgtaaatttagaagttacatggctttgtttttactttgacttacggcattaaaattattttcatctgtgtatgtaaagatctgcatctataagcttttgtggataataaggtgaaattgatgcattttaatataaattgccaatataaaatatctctaactcagacctctactggaaagttgtcaaatcttatgtaggaaaggcttttaccatcactgttacacattaactgggcatagtttaatattaatagctcctgagacttgtggttaactgaggtttctatttcctgtgtttgggttttatctttgcaacaacttggttgcttttctgtgtaaaatagtggtgaatatacacaagagtatgacaaggttctgggctcttaactttgatgaacaccatgccatttccatcatgctgcactcaaaacagcacagatgtgagtctgggagtggcgtccctgccgctctcatgagcctttgtttggagaacaccctgattaacccccacccttcacggttcattgactcactgatagatcaagtttaaactagtatatattagcacatttgttaccaacagaggaacagttggccattctgttttacattgctggttcattgcaaactggcgtgctaaaaaggtctgtactctagagtatgaattgggaagttaccaaaggactgagaaccaagtcagttgcatattaatgttgaattatacctatattttaatcttggattgtctacttgggggatgcttacactgttgtcaagttatgaataagtgataattaccactttgaaattcatctttttttttcaaggagtttaggggatttaggtgtctcaatatagctttcatattaaacagtttgtcataattggatgagagcagagcaaggtcatgactacctgatgccttgtgttggagcattttaaaaatgttttccagagagttatttgtacctaatgactttacataagtccttacattatactttatttctaggtcacctaaaaatgttaattgtttagtcaagagggttaggatgtgtgtctgttttctcatgaaaaaaattaagctgttccctttttatcaattttcttgcaatctaaaggcttttttttcttaccttcctaacctagtgactaaggtcatcttattgttacagttcctttcatgggagataggtttactgcatcatttggcagtttcatagggtgaattttgtcttggcttcatctttccttactggttgtcatcccctgggccacctgcttttttgcattttcctttctcttgtgagatgatgaagctctgtgccccgatggggatgagagacagcactctgagttcaagtctaggataaggcaatgggcttgcttttcaaaacaaactagtgtcatacgggctgctgctttcaggtccactgtctgattttatcactgatgacttgtttctggaaggcaaactgatttaagttctgagcaaaagggtcggtgtttattttcaatgctactattaatttagagttttaatttagaaaagattttttaccagttctcaaatatgatttttctattgactttaagtttgtagatataaggagtagacatgagatagagactgaattgcttttttgtttttaaaacttggcagtaataaggggttgcttgttttttcatgctaaatattttttctaagggatctagatacctatcagaaaacttaactttgataactctggttctttattaagtatttttgtcttattttaggaattaatagaaatagttgtaattttagacttcctttataaaataccaatttaaagagaagctttttgcttaaatgattgttttgcagtgttgtgcttttgttttctttaatgcagttgaaatcgcagctttataacttattttttaatttggggtttttaaaagaatattagttatttatttatatttattgggcacctactgtgtgccagacactattctaggaactagtaaacatagcagagagcagaatcatgaagttcttgacctcaaggagcttaaatcctagtggtagagggggaattcaaaaaaatcaaataaatgtatttctattatgtcaagtgatggtatgtactaccaggcaatcagatgaaaatatttcctcttctatacacagtgggcaaggaaggcttcattgactgtggagttttagaagaaagctgaaagtaatggggaaagagagccatatcgatatatgaaggaaaacatggtccaagcagaggaaacgaaaagtgcaaagaattgagcaagaaagtcatgttcaagtggagtcagcaggggaaagagtaggtcacaaatgcggctgagggtgggtcatgaagggccttacaagctttgtatgagtttttacttttattctgaaaaaaacaaaaacaaaaacaaaaaaaaccggggagctatttggggattttaatagaaaagtaacataatttccttttaaaatggatatgtggccactaagtggagagagtggtgtatatatgagtggatggaataattgatacaggcaagcaggagacaggttaaatgaaaaatggattaatccaggcaaaagatggtgacttaaattaagctgggagtgggagagatggtgagacatgcttagactttggattcatttttccagatagaactggctgacagagacatgtcatttaccaacatagacatggcagattttttttttcttttctgagacaaggtcttgctctgttgtccaggctggagtgcaatggtgtgaccatagctcatggaagcctcagactcttgatatcaagtgatcctcccacctcaacctccctagtagttgagattacaggcatatgccactgtatccagccaactttttttttttctgtagagacaatatctctctgtgttgcctagggtagcctttaactcctggcctcaagcattcctcctacctcagcctctcaaagtgctgggattataggagtgagccaccatgcctggccaatatggcggttattaagaggataagtcaaagattacatgaatattctgttatgaaaagtgtcaaacatatagaaaatataaacagtattccagtgggcacccatatttttatcaccttgattctacagatcttaacatttttctgtatctgcttcaaacattttattctgccaatgtgttctaaagtaaattgttgatattgtgatagttctctccaaaatgctgcagtgtgtagctctaaaaatagatatttttcagataaccaaatatcattaacctgccaaatcaatgaatgataattgcttattaacatttaatacttggtccatagtcaaattctccatattttccataatgtcttttatagttaacttttaccaactagtgtctgatcaagaatcattcatttaactaattacatttaaactgtaacattacaacatgttttttcgtatgttttattctctctgacattgacttatggaagagactagattatttgtcctgtagacattttatcatacataagagttactaggagagctctgattactagtccccactctcagaaattttgattcagttgctctttccagtgagctgctggtgatgctggactttcattctgaagaccatactttgagcactactgctgtaccactatccgatggcttctttgtgatatcgtttaacttgttgttctgttgcctgtatttcctctaaactgaattttcaatctaaaggcttactgagattcatgtttgatactttgggcaagaatacttcataagttctagtgcttaatgttaggtagcacttaattctgactatttcactattcatgaggctaagctaaggaggtgacagcctgatccttctattgtaatgtttcatgtgaaactactagataatttgttgagttggggggtgggtagggaagagatatctagttttcaataaatatttcacctaatggttttaacacacattgatcatccttgcctgaactaattatttaattagggatggcaacatggagactttctaattcaatctttttttttttttctaaatgaatggccttgtttttatttttaaatggatgttacttcgcaactggggttatttgattacccagaaatatagcgcatattaaaaaggtaggataaatgcttagttaactaattaagcaatttttaattaccagttttcacagtaaggcactaaagtttctgacttgagcaaagataaagtggaaagataaagtggtcgtttagtgagatgggcaagactgtggataggtagactaggtttggtgggaaagtcagaatatcagttttgaatatgttaagtttgagatgtctattagaaacatatgttgacgaggccaggtgcaatggctcatgcctgtaatctcagtactttaggaggctgaggtgggcggatcacctgaagtcaggagttcaagacgagcctggccaacatgtgaaaccctgtgtttactaaaaatacaaaaattagctgggcttggtggcatgcacctgtaatcccagtaatcccagctacttgggaggctgaggcgggagaatcacttgaacccagggggcggaggttggagtgagccaagatcccgccagccactgcacttcagcctgggtgacagagcgagactccatctcaaaaaaaaaaaacatatatatatatatatatatgttgacaatatttcagttgaataaaataaaatattctagctattttaggtagaaaggcattttataccgatactactactaaagggtaagaagatatgactgtagtacattaaatatgctgatggcctacaactgttgctgtgttgctttttcctcttcaccacacatatgcagcctcatgaaacattttccatgaccagcacactgaaggaaataaaaggaacctagtttagagatggttctgcatgatacaacaaaaatgagctgctaaagcattacaatcccactcaagagtattcccccatcaaatagtggggctggtattttaatcagttgatactaattgtcaaggtgtgatggccaagggattgatgtttatcagtgtatggacagtggttcagagtttggtgaattagtcgagttgaaagagaaagattggtgacaaagatgtatgaggtggaaagtatactttcacagaataagaacagaaaatgagatttatgtttttttgtaaacgttcaacaaagaaaattcattcagaggaggaaataggtaggcaagatgccctattctacagatgttagtcagcatcactgcaaagcaacctcagggcttatgcagtggacacttaaaatagcactggtgcagggatgggagaaataaatggatttaataagcactgctgcttaccaaggttgattgaattgccactattgccaagtgttctacctgcaaacagatcaaccttgagccctggatatggcaccatgtcccagagcaaccagccagccacctggtggcaggttgattgcattggatttgctccattatggaaggtcagtggtttgtcactgctgcgatgaatgcttactgtacgtttggatttgcattccctgcccaccatgtttctgtcagcaataacatggccttattaaagccttattcaataatatgacatcctatataatattgcttttgatcaggagactcattcacatcaaaataagtgaggcaattggctgtcaactacaggattcactggtcttaccatgttcctgttgtagcatattgtattctacctggaagatgaaaccttgtgacattaaagtagtttttagttccataaacataatacaggggtctatgaatcaagaagtggaggtagaagtgttgtcttttacttcacatctaatcacatgttcaaaatattttttcatcttgcctctgcaactttgaactttgctgacacactgaggttttagtgtgaggaaacaatactttcacatgggaacatgatagtcgttcaattgaactggacatttagaataacctggccacattactgaactgtataactgaaacaacaaatgaaaaaaatgaagatgctacgctggcaaagatgattaattttgattattgggagaaatagtattgctactgttaggaggaagactatatgtctagaaactaggaggaaacctgggttgcctccttgtagcagggtaaaatgagtgagtaccttgtctaagaaagggaacatgaccaaactgaacccagaagacataggaaatctaaacagatcaattaacaccaaagaaacgggcattttttggtacttctaaaaaagtaccagactgatattttcacagagatgttcgttatacccttaaggaacaggaacagaaaacttctatactatttaaactattttagaggatagaaaaggaaagaaaactccagattttatttatagaacttgcatgaaattgataccaaattctgacaatgcaagttcaaaaaggaaaactagagatcagtgttacttatgtcaaacagctcttaatagaatagatggatatggttatcaacatgataaatatgtttatcacattttaaagcctacatggagaaacatttgaggttttcttattctagaactgacaggaatgtcctttattatgagcactattagtcaaatttttctggtggaactaatgtaagtagactgctgaagaaaatgaatggtatgaacattggaaaggggaaattaaatgattattatttacagataaaataattgttaagctggaaaatccaagtgaataaagggaaggcctacaattaagcagttaaggaaagggctaggtatagaaatcaatagttttgatatatgcaggctatagccagttaggagatcagttaggggaaaaacacgttgacagcagcaacgaaaagctgataaacctagaattgttcaccacttatcttaaaatgtttaacatggtactgagggacacaggagattatttatgtggaaaaacataccatgtttctatacagaaaaattgaacatcacaaaagtattatttgatcttaagataatttatatttaatgcaatctcagtgaaataccaggagaatgtttttaagctagacaaacttatttcaaagatcatatgtaaaaataagcaaaaatagatgtgaaaaattctttaaagtaatgagagaccagtcttattgactattaagtcattataaaactataatgtttaaaagatggtactgacatatgaatagatcagtggatctcagatgggcagtgcagaaagagatccaaacacatacaaaaatttagtacctctaaaggtggcatttaaaatctgtggggaaagatggattttccaatgaataatgttgggataggtagatagccatctggaaaaaatgaaagtcaaatcccaactttttaccttttatcaaaatgaacttcagatacaattgaaaatataaaattgagaccataaaagtattagaagaaaaatgcagtttttaagtctcaaaaggggactcttaaatatcatacaaagcccagaggccataaaagagatgattgataaattcaaatataggtccgtgtaagcgaaaactttcagtatggagaaaacataagttattaaggcaaatgacacactaggaaaagcatttgtaactcataacaagcctagttttcttactgtgtaaagtactgccataattgacaaagaaaatatgaagaattggcaagtgacatacatagaaagttcatggaaaaaataactcttaaacatttacaaaattttacaacctctcatgaaaagagaaatggaaattgaaattagagtcacatacagtatttcacttttcatttgtcaaagatcaaaaagtttgaacatactgtgggtttatgtttataaggatgtaagaaaacaggcaatctaaattccttgtagagtgtaaattggtagtaataagagaaaaatttactgaatactttgtgccaggtgcttttctaagcactttacatttaattatctcaattaacttatccagaaagtaccattatttctgtattacacgtgaggaatttgaagaaaagttagacaagtaattcaaagtcacacagttaataaatgacagagtgaagatttgagaccatttcctttttctcaagtgtccacttttggtcgcaactctgctgtttctgtagtgagtgatttaacactatatgataaaaccttaagagtacgtactctttgatccagtgattctacttccagaagtttgtccattttgcatcaaatagatggagaatagcattcattgcattgttatttgcagtaaaggaagattggaaacaacctgaacatttatcctcaaggactcatccatacaaaagaattgaagtaaattcatccagatgaatatgaggcagctttagatagagtgagatggcatcctatgtagtgatatggagtcatctttaaaatacagtaaaaggaaaaagcaagatacagaatagcatgtagggaagctgctgtctatgtgaaaagctgtagaatatacgtgcatttttgtatatgcatagaatattcctagacaaggacaaacatggtggttcatacctgtaatcctagcactttgggagactgaggcaggtgattcacttgactccaagttcaggatgagcctggccaacatggcaaaaccccatctctagaaaaaatataaaaattagctgggtctggtggtgtatgcctgtggtcccagctacttgggaggctgaggcaagaggattgcttgagcctgggaggcaaaggttgtagtgagccaagatcatgccactgcactccagcttgggtgacagagcaagacaccattcatctctctatctcttttctctctctctctttctctgtctacacacatacacatacccccccacacacatatatatacacacatatatgtgtgtgtgtatatatatgtgtgtatatatatacgtgtgtgtatatatatgcgtgtatatagatacatttctagaaggattctcaaagtgatatcagtgattgttgtgcaagaaggaaactagatatcagtgaatgcgctaaataaggtgattttgaattctgtagcatgtgtatgatttacctatagagaaagcagtctagcatgagcgtgggtttctcaaatatagaatgtttgcagtgaggtcacttggtgaaaagtatagccatgtcagacagatgtaggttcagattccaggacttccaggactgctgaaagggaaaggggctttggatctccttcagctccaggcagcattgctcctttcccagctttgacattagctggagggaagacaagttcttagagctctatgtgcttgggacaagaccccttccccctactgccttactcgccaaccataactgctgcaaacaattcttacctcttccaccccatgtcactgcctaaaacccttcatcacctggcctcccatgcctctaagtctctgtacatcccctagcctgatactgtccccaaccctcctcaactccagacaccattttactctaccctctggaattgtccattattagcaaaatctcctttattttcaacctcctttctaagtatttcccccacattcttgttgtaatagagacacagctttcccaggactgtatagctttccttgcagtcctctaaagtggtaactggtttctctgccatacatttcataccactggtcctggagatattgtcaatatcttaatgtcttccttccatctcacttaaattttgagaccataattcctttttcctctcttaaaagttctcagtgttgaagctcaatccattagatacctctagctggcactactagttgcagtcctgtgcagactactgagtcattttctttactccctgaagacttaaactctatcttactctcactctctctgacattactcctattaaaatgttatgtttctttagctattctttcagtttttggtctcctctccttcaacgaggatgatttctagaatgttggttctcaaaatgtggcccctttgcagacatcgtcagcacctgggaacctgttataaatatgaatctgcagaccacaccccagactactaagcccaaaattctgggggctggagcccagaatctatgttttaagaagcacgtcaggtaattctgatgaatatgccagttccttagatcttgttattgtcattactgacaactttctctgagaccacaatttgaatctaccaatttttcactagtactcacccatcttaagtccttactttccccttaccagccagacatttgaatattccttgactcttctctttcacatactatatccaaagagtcaacaaatgctgtcagctataccttcaaaatacatgtagaatctaacttttaacctccactgcagtcacttcagtccaagcacaaccatttcccacctggagtattgcaactgttcttgtttggtggcccttggccctactttatctactttccgcaaagcagccagagtgtttctttcaacacctaaggttatatggcttcattgattgaaattcaccgtgcttcacctctttctctacaaaagccaaagtccttgtaaatgcctgtaaggctcgagggtgatctgaccttccctggcctgtcgtgtttcggtaaaagtaagctgagtctttcatagttaaaggacagcaatattgtcctgcatgatattttaaaaacccaatcaagaatcacacattgcatttaattttcatgcctttagtctccattaaaagtgtgccctttgtattaataattggagtgatgagggacagagtttaagaatatataaatattttgtccccaactgactgtcactggatggctttggcacccattggtgattcttacctgaatcagtaattattgtgatgactgaaaatagtgatttttctcactgtataattcttctatatttattaattaccttaatattatcctatagaacagaatgttcccttctcatcttttgtttgtttagtgtcagtattactcatgaagttgggtgtttagaaaattcaatgttgtataatactgttattattcaatattgtattttctcagtttgagtcttccatctgcgtcctttcatgtaaatagtataaagatcagtaatagaggaacatagagtaaagtgtgagcagagaagccttactctgagacaaacttcagagaggtgaactctgttgctgattaagaaaggcttcactgaggaagtgttgtttgaagtgagctttgaaaagtcataaaattttgacaaaagtggggatggggtggagcttaaaggaaaaactgtctgaacaaaggaaggcccggcagactaggaatttggcaataatacagtggttttggaccttgatgaggaagttgaaatggaacataaaaaccctctgcatttagctccatttatttgctcaggcagctctcactgcctaaaattttcacccctgctgttttgctcaggggtgggatgaggggtaatgagggaggaaattttagggggtgaaaacagcacaagccaaaaaccctgctcagatactcccttctcttgaagccttttccagatccctaataagaattaaccaccctctctcacacactctgttgtactttgtccttctctgttaaccagcctctgtgttttgtgctgtctgtatttgtggatacatcttcctcctttaaagcacgaatcatatcttaatcccttggcccttcttcccagtacttagcacaagtgctcaatacatgtttctttaacgcgtgtaacagaggaaggcgaggagagtgagtgggattgggagcaggaggattctgaatgtcattttaaggggtttgggctcgctcttcaggcagcaatgagccatagccgcctttgaactgtgcagcactgaccagagctgtgatgccaaaggatgcagtggaaggggaggacagccagcatgcctgggcatggtccccaagtcagaggacatcagtgggagaagggagaaggcatggaagcaagtggctaccatcttatgaatctgagcactcattcaaaggtggcaaggaaaaaggaaggcattgagcacggttttgaggtttccagcctgggtgattggaggctgatgcaggcttcttaccaaaaagggccctaggcagtttcaccaggaatgtttaaggagtttatcatgaccctatctcttcctcgtctaaaactctccctaaaatcaaaacagtatgtcctgttgaaatactttattgtatcaaatataatgagaagtaaaatattctctctacttgatgtatgaaacactgacttcttgtagtggacaattttcacttgtctttttagtaatggtttttattaaaaatagatgttaataactgcttgtttaatctttaaacgtggccctctgagagcagcttaccgtaaaagaaacggttgtcagctttctttttgctcctcagtccctcctgccccttcctaacaacagaaaatttgctttgcacctgctccaactgggttcgaagagataagcatcttgcaagcccagaaaattgtagtatcaaatctcagccccaactgtgaggcagcactatcattgaatccctgctgagaggcgttgctttcccaattcccaaaagagttctttctcccctggccccttttcaggcttgaactctgaccgaaaccctctttttaactcccagcatgcactgcacttggtactgacactgacccatccctgcttcctctgttctgcactggactcatcagtaggtcaggcgttggtagccctggggtcactggggtgcccaattccaataatgagcacatttagctaaggagaggaaatgtacccttctatttgttacagtccattgctttttttccagaaacaaatgctaaaagaacatttgatatattgtggtttggtaaatacacatagcactgcctaatattcacaaagttgcctcttttttttgcatcttccttcataaattaaatatattgttctaactcatgatttattttaagagggatatacctatttcacagctaggaaaatgttttcaaataaagttatattcagaatactcttgcaagaatttcaaataaaaatagcaaatactatttaaatgcatataacattctaacagacttgtgtgtcattttaaagggaaagaaaaaaaatgatgacaaggactttacaactttgtctttaaaatttcttcttaggctttccaaacagaccgaagtcattaaaaatactccttaacccccaaagtcacaaaaaagaagctacccaggtttattatgagaaggttgaacctctgttgaagcttgcaggaataaaaactgatgtaacaagtaagtaattttcagaatataatttcaccatctacaaaaacatacaaaagcaaaataatctgaatttgtccttaatgcaaacttgggaaactacttgtaatatctatagcatttttacgtcttcataacctactgcagccagctcgagggttataatttaattatttttgttatttttattagaatattaatattttctctttagaattttttcagatattttttcagacttaaacaattgttagatataattacaaaggaagctgtatacttgtttacatcttcatggagatgtttgctacttacacgttaattttgcagttaggcaagaaattgattttttgctcacttatatagttgatgtctttccatggaattcttccttgggttgttttcgttctgactctgacccctggtggttaggtcaaaactaagcactgaactgctggttttattaatagatgaatttagagatgctagaagcttaaatttgttgtctaaactaagaaatgtacttaggtttgtgccaaggaaaatagaaacttgttaatgctaaacttaatagatgattagtaatatcctttttgatttttttaatttggtagtcacatttctttgtttctttgagacttattttcgtatggtggggaactgagtagaagagtcgatgctatggagaatcgcaaccttcctagctttatttctatgtggcttcgctaacagtggaaatttgcaataaattttaattgatgaaaagtattataaaataagcctactcaggggacaagcccagagtgcaattggaacttcctagtcccagttatagattcctagggaagggattcacagtgatgtggctttactcagctgtaaacaaaggagataagtttcaagatgttaataatatcattgaaacctacacctagtgatctgatggattgaggtagaagaaagttcaaaaaaaaaaaaaaagcaagttttgtaggaaggtcagcccccatgaaatgtgcctataactatagaggttcgagagaaactaccatgaaaaactcaagaggaatttttgaattaaaataaagttatagtgaagaagttaacctttatgtttgtgaccttcggcttatttagaggtgatttacaagtaaaagagaaaattcagatttatgttttctttctactgaagatttccaaagattggctgaaggaaaagtttgagatttgtattagggtgagacaattaaaagttgaataaacatattggcatactcaatgactattttgttcattgcttttacatgtgaatactacaaagcagcttaacatggatattgctatatagcattcacttcaggaatctcattgtatgcttgctctgtgttcaacatagtgcaggatgcgagatgaataagctatcatacttggatgactttctacattattagagattcaaaaaaatgcttaaaaccattataactggggtatacataaaagaactttgatgtctcagaggtgatattttgatcggaagattcaagaaaagcatttgaactaggcagtttttaagaggcagacaaaaaatgagggaaggaagtcaggctaacaggcatgtactgtaaaagttgggagggggggcggagagagagagtgtgtgtatgtgagagagtccatgtgtgttacacccatacatctggagagtttgtgccataactttgctctactttcctcagtttttacattatctgaaatcttactctatcatcataaaatagctgccagtgaatttcatcctttcttattaatatccagtgggatggggagaggtgtgcatatgtgtgcaagagagacccaacatgctttaatcctgaagatgaattaaaatttccttttttaagtttgggcacagatactgtattagcgcagtcaatctggaataatcatttatttaaccatcaagactcttcccaggggctgaggacagatccccttttcctgatgactgaaatgcctcagctgaatctggattctgttagggagaagaaagggcaaaatgacttctaggaaggctctcaacaatgtatactacaggaggtataattccaggttatggatggatccttaagctgcactcagcagtttactcatcgtgtattgatccacagttggtgtaaatttttttttatcatactgttgcaatctggtttggcaaagatgactccaccagcagaattaaaattaaaaaggaagagagaaaaagagattggagacaagaaaactgatatacaaggcctgaactaaggcagaggaaatcatctaaatgtgctttccttcttaattgtattggagacaaaactattatgttctaggatttttttctctaaatttgtaaatattactaagtaccatatttaaacataaaacaatagaatattccgtaaagcaaatttagaatttacttacatttgtgcagaatggctaattattagctgcctaacactcctcctacaggcaaatttataaaattacatcatttgcttataaaaccattttagtatgcatattggctcaatatttatgaaaaatatttcttgaataaacctgtgaatatttgaaaagttttagtcttcctgcctatcttacagtgttatttttgtagttgaaataatatatttgaaactttgtatattatactacagaaaggtggtcataatactgttagtttcagtttcaaaaattatgtcatagtaagatcgaattcgtactttatttgaaagtatatggaagagtaaagcagaaagaggacatatcttctgcatgtccagtgggacattgttttaatgtatccttgtgtgaatgggtgagtccaaatggaattggaattacaaaataaaccctatatgatgagttaattaggaaatagtgctatataaatatgaagtataatatgaagaattacagctagatatatacactataaggtactgtaattttttcataaatttattttaaaaatggatcttaccacattaataaaaacacacttctttcattttgggttgtgctgaaatcctaactacttctgaatatagatcagcatcttttgaaatatttgtgctaaagttgcatccccactctgctaccaccaccaaggtagtatcttatctaatagcatcagaaaaacttccgggagaacctggaaagaattattttttcctaattacctattcgtacacaaatcaaagaagagtatgaacgataagcccatgctggcatatgatatcatttctcttgcttctgaaacaaagcaagttttagagattgtaccattaaaggtgtgacagatattttgaggatcagagatccataggataattcatagtacaatagagtgaaaaagttaaggcagcagagaaatcagactgaaaagaactttcgaggccatatggttcaatttttctccttgtgggtggagcacaggtgtgtggcactcaactttggcttggccacctacactagaggcagagtacgttgttactggacaatactgtttgacattcttatgaatgttcagagttactgtacctttgggcagattagaaaaggcacctcctctgtgctgacttacaaaaaggtgccctttcttccagactaattcatcctttgcttataaaaccatttcagtatgcatattggctcaatatttatgaaaaaaatatttcatactttcaaaatattcatatttcaaaaatattcagcccaaggtcactagattcagcctaaagtcatttgttagattgcaaatccgtcattcccgttagccaagtacctttgtgctaggcataaactgtacaaaatgagaacttgtcagctgacattcgcctctttgtaatttttatgtactagagttaatgttatctcttgtagtaatatgaaataaatgtgccccatctattgtataggagtcattgagatatttgaagagagatatcctgtctgcccctcatctcttgttcacgataggtacttccatcgccttcagttactttttgcattaacagagctgctagaccttatcatggtcattatcattatcatactcaaagacatttatctgaaggaaaccttgatctctgccagctcagggctcttgggagtgcctagtcaccagataattttacctcctgggcagagttgtcaagaaagtggtgtttgttatcattttccccttctttctcctaaaatcacgcttctaacatggctgttaacaagcctcttcatagtgtttctctggttgtttatggctctacttgaagccttccatttcttggaaatgcctcttgcctttctaaatctcacccagcagaaagctaggccatctaatgaaactgtgtcacaaaagattccagtagcctgaggcatcactccttccaattttacctgcattttaatacaaaatctgaaaagtaaatgttcatgcatcatatctagctagagagaaagataattctgtgtaaaagattctttttgttacctcttaaataattgtgggtgtatatggccagtcctgttcccagcattcagatgtgagttaggaagttggaactttatacctggggacgatgaagactcactaatggggtatatacaaaaaagtgatatgattaaatatgtatctgaaaatggttattctggctagagtgggggagaggtttgagggagacaagataaaaggctattgtagtacaggtggagtatcccttatctgaaaggcttgggaccagaactgttacagatttaggatgtttttagcttttggaatatttgcattatacttaaccacttcagcatctctctaatttgaaaatcatggacacaggaaggggaatatcacactctggggacagttgtggggtggtgggaggggggagggatagcatcgggagatatacctaatgctagatgacgagttagtgggtgcagcgcaccagcatggcacatgtatacatatgtaactaacctgcacaatgtgcacatgtaccctaaaacttaaaagtataataaaaaaaaattaaaaaaaaaaaaaaagaaaatactccaatgagcatttactttgaacgccatgtcattgctccaaaatttttagatgttgaagcgttttggattttagatattctggttacagatacttaacttgtctacacatgaaagatatttagtgatcagatcaatcagctaatttagggaattagctgggagaaatggaggaatgctatggcataatttaaagacagaaacaactggccttggccatggagtggttctggagagtggaggaaagggacactctagaaagaagtcattttcctgtcttggggtagatgatggaacacaaaaagaacaatatatttgagagagaatatatttgaaggtatacataatggattctgttttgagcttactaactttaaagtacctacaggacaggaaagaaaatgacatttcagtatcatatcccacactagaattttatcaccaaaccaagaaatgtttccttatgtccaaatcaaatctcacctgattttatttcaggtgattttctcatcaacattgaatatcaaccttaagactttcttgtcttcctgaggaagttgcatttgcaccaaagaggggagggggaaattcccagcagtgagaattgtgttcaaagacctgtaaactgtgaaggcttcacatctcctatttagaaagagcacaggttggcaatctcataggaaaaggcaaatagatgaaagaagaggctgggttacattttttgaaattacatttatctagcaatcctttctttgtttgtttgtagggggatgatttgaatctggctgtcactgattccagggcccacaatagcctgtctaaatacatatttggtcctttctactatatttaaatagtaatccagatcactctttatccttttgcctaacattgttttgtataaccacctattacttcatattataattcattatttcattagcatatattgtctatctccagaatgcaaattcctgaggccaaagactaattcattttgttcattttgctaatatattttatagatgtagatagtcaggttcttttcattttgtttctttgttctagatctttgattttattggacttttgcaatgttacttaaaaaattgctattttcaggcaggttgcattagtgtataatcaaattccacccacaatatcaaaaaaagactattacaaattaaaaaaataaaaatagcattcaataataacacagttctaaagctcattattggatctgaaaaactttaccaatgtaagctttggtataaaagtaaggcttggtgaactgattcttagcataaatattttttcatgatattcttatttttaatgtgtatatgtaagatgttttattttgcattttaaggttgtaagtacttgctgtagttataaatgaatgatcagcacacatcttctttgataacctttcaactttattaatattaatgtttcatatgtagttttattatggctttcttctgattggaatttaatatagagaggttttattcatgtgagtgttaatggcattttgaataagctatgggagaattacaatgtaacactgctggatacagaatgattcttttagacaccaagactaataatttttaacaatatcgaaaaacattgtaggaaaagcttgaaccatgctggcaccagggacagacaagcatgaaagattaatgtaatcttgcatataatgacacacattcttacacaaaaaatccatctgcaatgtcatgtcagtcagcagaaatctttgatgggtggatacagctgggctgtctcttctggcagagctgccctggaaaatgctaaatgtggttgtgatgcttggtgccatctgcagtgtgcccgtttatcctgtcttcactggcatttacgatactgcatagggcatcagtgactgtggagacagcgatacagagtgacagattcatttcctcggagggtctgagctctggtgggcctgtgtgccaccctccttcttgggtctgggtctcttataattggtgttggctttactttgtattttcacatccaactcttcctctttttagtctaacagttccagtacacattcttctggtttgtaaatcttacactaaccttttgactaatttattcatgtaaggttgccaaaccgatttaagattgactgttcaatgccagctaatatgccttatttccaaaatactgctcctcctaagcctctgatttaaaggacatgtgtcttatttagggaatactaaacaggcaccaggacaaattgggtaaccactatgcgtgggatattcccaaatgactttatgtagttgaaacaaatatatgaccttctcttacataaagctataaaacatcaggccagtaacacttagtcctcttgcccatgattaaaatataaatattcaagaataaatgctgttttatgacttgaccatatgtttatcatattattttgccagaacaagttaaaaagtgtgatcattgtttaaaactgtcactttgtgtatgtgtgtgtgtttttttaatagtaatggaatatgaagggcacgctctgtcactgcttaaggaatgtgaactccagggatttgatgggtaggttatattattaatcaatatatgttatatcatttatgtattaaatgccttcactagttttagctacatatttggaacctaacatttaaaaatatttgtagtgtatgtactttggctctatcttgttcatatctatgtaataataattaatgataatatgacatggtcatctatctctcaggatctggcataggaaagcaaaaagaggaatctaattattaaaatactgggaaatgacagtgtactactctatacttactaatgtgcatacatttgcatctataattatttgcttttaccatatatctagagaagcactaatggaagatgttatactggtcacatggcataactatatgatgatcttcttttgcaaattaattgataggtttaatagctacccattggttaacttgtctgtgatagattgagggaagatattttataaatacaagtaaataaatacattatttccagaaacaataagaaataattttaattatctcataatgtagtgactacaatttaggtatgttattcacagtgggcatcggaaaccattgttcgcaatacattggagtgtacagagattgttcactggcatgcaaacgttagaaccaaggcaagtgatataaatttcattgccattttttaaaattaggtgaaccaatttgctaaagtgttggactgatgtgtaagactaaaacatattatattcctttagggaagttctttttacgtgagtagatatttgagaatttaaaaagttgacaagtgtgtgaattatttgtgttacatggtgatgggcagggggcaaagacccataaggtcaggaaagggagttaggtctgtactttcaccaaagtgaaaggcattaaccttcccaaagactgatttgaatgtgctggggagggaagtgatgcaatcaaaatggagtattggcagggctgtttttcagaaatgcttatttatttatttattttttggatgaggagaaaacaatagctgttgagaaagaaaatgtggtaagtaaaacatgatttttccaaaaggaatctaattgagggaagtaaatctagatagcaatattatataaacattgggaatcaaaaatatggggtaggagattacttcagaactttatacttagaggtagacaaaaacattaataggcttcatttagaaaattgtcttacaagtatacaatttaagaaaagtccttgtgggaatcatgcataccaactacctatttgaatatgctgcatagtccctcactagacctcatgagtacatgaaggtagctgcattgcaaatgagtacctgcttcaaaacttgattaaagaatgagaataaagatatcacagatattaaacttgttcttacacagcagcattacagaatgttctgctgaatgcagtatctatcaatatgttttactggtatttgtactgggtaaagggatgaaaagaactttgcagaatgaagaaagacgattgctgaagtgtagtacaataatatttttctctttacctgaacatatttaatccttatttatttttcatggcaggtgttgttatttttcagtgtagagctaaaagatgtatagatttttcagttattatattttataaaccaaatagtttggcctaaccattatatgaattgagttatgtaagtgtttctaaactctatggcatgctgatttatttcagacttacaataatttcaaatttctactgaaagtcatcttccgtgttctaagactctttaaatcaggggtccccaactccgagactgcagatgaatatcagtcagtggccttttaggaactgggaggcacagtaggaggtgagtggcaggagagggatcatttccgcctgagctccacctcctgtcaggtcagcagcagcattagattctcacaggagtgcgaaccctattgtgaactgggcacgcgagggatataactggtcatgcgagggatctaggttgcgtgctcttgatgagaatctaatgcttgatgatctgaggtggaacagtttcatcctgaaaccatccgtctcccaccccaccctgcagtccatggaaaaattatcttcccacaaaaaagtccttggtaccaaaaaggttggggaccactttaaatagcttatttatttttgtggggtcagttttcccagtagaagctgatatggtagttggagtaattatcttaataaactggcaattttaagtcactgtacttagaattacatagagagatatatgaggagaataatagaaacatagtttcttcaggtacttcaaaggaacaattctcttgcaagtaaaattgtttgaaaatggaatattctacattggtgagttttctattcctgaacctgttctaaagagtggctaaaggaaaattttgggggaaatttatagaaaaggtgcagagatgagagaaggttaaccccaaaatgctatggcattttgatgagagacagactcaaatttctttaagaactttggcctgaagcacctccgtctgacactagtggaactattaatagggagtgattaggaaatcacctaacagtttggtttctagatacaggctgaagaagttaagagccaagaaagattctatgtatagtatttagtaaagcaaaacaatttggtaagtaatgtttaagaaatgctatttcctaagattttggagttgtatttattttttttaatgaattacatatgtttctatgagacatcttgtgacatttctaaacccaacagaaacagtgtatcagcacttatgacagctagttctccactgcagtgtgtcctaggaaacactctaagatccactgttaaaccttatgagagcttcagattctatattgctccctattttactgggcatgagtaggaagttttaggaaggaaaataaaagaatatcagctgcatagacttgaagcagtaacacttgcatttataagtgtgagtatagttttaaaaatctatagattttatgcaattgtaaatatatgaattcctcgctattaatatttgtttcagaatttttaaaaaaattgttgagttacttttcttttgttcatttcaccattaattagacccataatgttgtagacattatttggattatattgacattttatcagattgaacatatctgtattacttagtaaggtaaaaagcaaaaacaaaaacaaacttttccagaaagaaaaaaaactgtgaatcaaaactacaacaatatattgaacatttcatagatgatgggttcatagataagtataaaaacattcattaaaaaaatctttatcactctttgaaaaaggatatattatcacccagtgtttcttttctagacagaataattctgtttggagccatggcaaggagtttacttattttaaaaacaagatttgtcacatgcaaaggattagttactctaaggtttatgttttagagtgacacaagtgtgattaactcactataaatgattgaatactttgctttttgcctttcttgtatatttagactcttgtgatatttttgtaagaagctgttgatgaaaaaaaccaaactgtaaaatatttaaagaggtttattttgagccaaatatgagtgctcatggcctatgataaccccaggggggtcctgagaacatgtgcccacagtagttgggttacaacttggttttatacattttggggatacagaagttatagccaaagacataaatcgataaatgtagggtattcattggtttggcccagagaggcgggatatcatggagctggtgggaaggggagctcacagatgaattcaatgattttctgattgtcagttggttgataagctttgctgaaagattagaagtcagcagaaagaaatgcttgagttaagataaatggggtggtgtaggctgggtgcagtggcttagcagtggctcacacctgtaatcccagctctttagaaggctgaagaggggagatcacctgaggtcaggagtttgagatcagcctggccaacatggcaaaaccccatctctagtaaaaatgcaaaaattagccgggtgtgatggtgtgtgcctgtagtctcagctacttgggaggctgaagcaggagaatcacttgaacccaggagggagaggttgcagtgagctgagatcacaccattgttctccagcctgggcaacagagcgagactctgtctcaaaaataaaataaaataaaataaaaaattataaaaataaagataaatgaagttgtggaagcacaggttcttgttatgtagatgaagcctccagatatcaggcttcagagagaatagatggtcaatatctcttatcagaccttaaaaggtatcaaactcttagttaaatctctcctggatcaggaaaagacctggaaagggaaggagattctctatagaatgcaaatttctcctgcaaatgatagctttgcagggccatttcaaaatatgtcaacaaaatacattttgggataaaatactttgatttcctctagggcctgctatttgttatttaatgctataccagagtcaggttggagttggggatcttattgctaccaagtctgttttgtcagtcttatgatctattttttttttttttttgagataaattctcaccctgtcacccaggctggagtgcagtggtgcaatctcagctcagtgcaacctctgtctcccaggttcaagcaattctcctgccccagcctcctgagtagctgggattacaggcatgcaccaccatgctcagctaattttttgtttctttaatagagatggggtttcaccatgttggccaggatgatcttgaactcctgacctcgtgatccacccttggcctcccaaagtgctggaattgcatgcatgagcctggccaatgatttacatcttaatgccagtgctggccatttgcgcctaaactccaaaagacaagagggtataaggaggcatatccaacctcccttcctgttatgacctgaatagtttttcagattttctttgtgaccttcatggccaaaaggggaggatccattcagttagttggcgacttagaattttatttttgttttacaaaacttatttcctaggttgagtcactttacctgaacatgatcttaatgattgaatagttgttaacataaataaatacatattttttctaactcacttaatttcacactggttctactggtaaactgtttttcaaaataataagattctcataaggctatttttattaggtttcatatatagaaaaggtatctaatatattgaataatattgtagcttctaagaccaaaatgtcttatttcaaatccctgttctattacttactagtggtacaatcttgaaaaagttactttatctttctatgttttagtttcctaatctgcaaattgaaggtaatattacctattgcatacagttatttctccacttaaatgagttaatacatggagagtgcttaggaaaatgtctgatatatatatatagtaattattcactaaatatttctttattgttataattgtcatttgtattagtttcaaaagatttaacacagaatgtattatgacaaaatttcagatgtttcagaacatgctcatagggaggccacctctaataactctagcaatatgttaacatatgcatgacgctataattgtatgcaacattctaggagttaagtgttcgcatcctatgtatgtaagggtcaagttatttggtgctaaattagatttttttgggtatgactccacatagtctttttggtcacacccatatgtcagcatttagacagccatggattgagggttacgtttaagttcacagattagaaatctcatagagatttttgaaatcaggtaagtttcaagtcaaaccttggtttttttcattcataaagatgggactgtggcctattttgcagacttctgaggatttaatagaaattagtaaacacattacctgatatatagtttgtccttagtaaacatcattccttttctctgaataggtggtcatattgcgaacctctggaatcagtttagacataagaataaaacacacctaatcaaacatgacctgggtcatatcttgagtcttctaaccagagtagccttggattgcccaggctatgtggagctagtgggatgaggaagatggggactagagggaatagatggccgagagaaagatggtgggaactgactggaaagacactttcagcctttggtcaccaccctccagagcttcctaaacttagagaaccagtaactactgctgactgtggcccatagacagttttgtttgaaatagtgtttttaaatatattgaatgctagttgcttagtatttacaaattaggagactcagccttaaatcagaatctctggcttctgtagaaaaaccagatctgggtccattaggcctcacacgtgatgtgagtgggccacagcaaagaagtggctgcgcctttagattgagcctactcttccattcctgctgggcccttgtagcccttgagttgtgacacctgctttcactgaggcaaaatccactttccattgggttaactggtgacattttgatacgtaagaatattttgcttcttttgaacataaatgattatgaaatgaatttctggtacttctgtgttattttaatggattctgcccccatagtctacttgatataaagtcttaaaaaatatactagtagtactatctaggatcaaaggctaatagtattacatctagaagcaccgtatagcaataatgtcaaggagatgaaattcaggtcaggtttgtaattactacattcatatagtaatgataattagcagtttcttaaagcttcatattttatatgatttttattgctatctgtcttttcagagctttattgagaattagcaggattttatgactttggttggtgttagttaaatgaattgcagatgacagtattattaacaagaaatgagaatgatatgcttttggatgttaacagagcaaaacgctggtcagatgtgaattaacatgttcaaaagttttcatatctcttaacacacttaaagctattttgtctatggggaattatctagttattatatttgtgaagtaaacttacctgtgttgtgtttgtgttgtcttacccattgacacatattaacatgtttaaaggtacatgtgagcagttatgcacatagactacaaattagtaaactattttgaagtctagatttcatgacttattaccaatcattctgaagttttgccttctttgcttgatttgtatttttctagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggcaagggagtggctacagattcattaaactgacccttctccctcttttcctttcttacttgctaatctagacagcacaacacagaattaatgaacagactttgaaagatccagacttctggcatccccactagcaaatgtgagacttttgacaagtcatttaatctctttgagccttatttttctaatctatagaatagggatcacagatatattattcactttattacaaggttattgtagtactaacgtttggtttagtaaagggtttaatatatagttaaaccatcagtatatggaatggttattattctcccttcgcataaaaaatctgttgattacacagtaccaggtaagaagtttcaaaacagggccactccagtctagctgcttacaattccatatgaggtgaatatggtaacttgcataattgatgtataaccagataaccttgagaatgccaaaattacttgtgactggaagggaggataaggtttggaagggtgagattcttaagggcaaggctttttaatctttctactcactgccatttttcagcatctagaatagactatgccacagtgatgctcagtgaagcctattaagtgaatgcatgtaaagaagactttatatagtaaatgacacttggattaggtcttaaaatgggttggagctggcctgaaaaggtgagaatgagttattttcttggctgcaaaagtaataaagcaaaggcaaaacccaggagtgtttgaggaatagtgaaaaggccattcagtggaagataatggtatcaaaataggcccaaccatggaggctcctacatgccacagtaaggtctctgaattgtatttgataagcagtagggaataatgggatgtttcagagcaagggggcaacctgattggagcttgttccaggaggattcattttgcctcaccgtgtggaatgattagaggttgggagcaggagaaagtagaggtcagagacacggagaaccgttagagcaacactgtgatccagaaaagagggaaacatcattcaaaagctgattgtattacacaatcactcatccctatttaacgaacggtgctgggaaaactggctagccatatgcagaaagctgaaacaggatcccttccttacaccttacacaaaaattaattcaagatggattaaagacttaaacattagacttaaaaccataaaaaccctagaagaaaacctaggcaataccattcaggacataggcatgggcaaggacttcgtgtctaaaacaccaaaagcaatggcaacaaaagccaaaattgacaaatgggatctaattaaactcaagagcttctgcacagcaaaagaaactaccatcagagtgaacaggcaacctacagaaagggagaaaatttttgcaatctactcatctaacaaagggctaatatcctgaatctacaaagaactcaaaagaatttacaagaaaaaaacaaccccatcaacaagtgggcgaaggatatgaacagacacttctcaaaagaagacatttatgcagccaaaagacacatgaaaaaatgctcatcatcactggccatcagagaaatgcaaatcaaaaccacaatgagatatcatctcaccccaggtagaatggtgatcattaaaaagtcaggaaacaacaggtgctggagaggatgtggagaaataggaacacttttacactattggtgggactgtaaactagttcaaccattgtggaagacagtgtggcaattcctcagggatctagaactagaaataccatttgatccagccatcccattactgggtatatacccaaaggaatataaatcatactgctataaaggcacatacacacatatgtttattgtggcactactcacaatagcaaagacttggaaccaacctaaatgtccaacaatgatagactggattaagaaaatgtggcatatatacaccatggaatactatgcagccataaaaaatgatgagttcatatcctttgtagggacatggatgaagctggaaaccatcattctcagcaaaccatcacaaggacaaaaaacgaaacaccgcatgttctcactcataggtgggaaatgaacaatgagaacacttggacacaggaaggggaacatcacacactggggcctgttgtggggtgggggaaggtggggagggataacattaggagaaatacctaatgtaaatgacgagttaatgggtgcagcacaccaacatggcacatgtatacatatgtaacaaacctgcacattgtgcacatgtaccctagaatttaaagtattatatatatatataatatacagccttatgaacatatatatatataaaggaaaattaggcaaaatagcattacttgaggtactcaatagcctggcagagcagacattaagggtaagagagactggacttgaatttcagtttggtacttgactttgggtgggtaattagcctttattagtcttgattacacatttaaaaggtttaataaggccgggtgcagtggcttatacctgtaatcccagcactttgggaggccgaggtagtggatcacctgaggtcaggagttgaagaccagcctggccaacatggtgaaaccctatctctactaaaaatacaaaaatgagctgggcatggtggtgtgcgcctgtgatcccagctactggggaagctggggcagaagaataacttgaacctgggaggcagaggttgcagtgagctgagattgtgccactgtactccagcctgggcgacagagcgaggctgtctcaaaaaaaaaaaaaaaaaaaagtttaataatgtccatccccatagggccattacaagaatcaacttttaaaaagtcacacattatcactaaaaaagcaaaatatttttccctatgattatagaaaataatgcacattgttgaaaaaaattcatattttgataaccctattcatttagtatggattttagaatacttagtattgttgataagttgacagagcataagatattcaaatgcccttttagagtgtaaagtctttcagaaagtcagaatttaaaaggagagagatattcagatataatctgataattctagagtatataggaaaacctaaaatggtttctaagtagaagacaccaagatgattttgactcaaagagaaaaatgatgcattttgggccatcttttcatggcattttatttcttgacctttttgctttactttagtagttctgactataatggtggaaactttccaacatttccttccatgcaaagtggatgtgcttaggacacttcattagtacttaaattcctgaggtcattcattgactgccatacatcagaaatagaaagatgggtgtccctacaggtatgcctttgacataaatttggtggttggctataaaaactggtggttattcttatgttttagtatgtaattcagattttataaagaaatagcatttagttttatcactattataattttgaagagtatttctgatttggggagcattttatgtattctttggatatttgtagtaatgccattttaacctgtcttgtttagaagacacagtatgctgccaaaattctggtcattgcataggagttctagcattctaattccatctaataggaggggaaagtcatgtgtggggtatatttaatatgatgactgtatgcctagtcagggcttttgatagagaatgggaactagaactaggcaggaagttttcaagctgaacatgaggagacagtgtgcctttgaagccatttgcctcctggagagagacacccagagggagagtgtttagtaaattaatccactgagccaacagactaagctgctgaattatggtcagactcaaatggatcagatgtggagaagcctgtatttgaactgctggccattaggaatggtgtttgttgctatgggaactggtgctaaggaactatactgagagactctgattaaaagggggagggggaatggagaaaaaagcctgagaggacataaaaataaaaaagcaatccagttgttgtaaaacaaggctcaagccacatactgatggctgtgaaccatatattcctatagagtttgcataaataaattcatgctttccaattaatttgaggagaataaaatattgccgagggactgttaatttctatgatatttcaggcaaagaaccaaagtgtaggtgccgttttcatgagaattttagatatgcttgactaggaagtcattacatcacatttatctgtttggatgtgggagacattaacagccttatgaatattcatggtatctggttaattaagttaattgttctgcagaagtgcttgcacttccaaggacattttttttttttttttttttttgcctccatagtttctccctggtatttcatcagtaattctttacatgaactgctacttctgtccttacttttttgtatttggaacattttagcagctctcaggaggaagtggtaggcaaagtttctggtagtgttaagaaaaataactttcaggctaattaaaatgtttaccttgaggtagaacatttatagcttttgtgagaacattaaaattacgccattgttatttatgtgagcagcatgttcttttggcatgtagacatcttttcaaatagagtacagtttcctgaaacaaaatgtaatccatctttcagattatcccaacaaaatatagaacaagctatcgttttgcaattttacatatactttctcataaactttccttttttcttcagagtgtcaaaaaccacatttaaagactaagatacagattaatgagtagtcaatgactaaaataattttctgacttctagtcatgtctgttatcactgccaacttctacagaattagagaaaagttgcaaagcctgagaagacataaacaatttttaaagccatctctagcattctaaaaaaattttgtacttgggcatacccaccgtacttcaaactcacagggaataaatggtctttattttcttaagtcatgatatgtgtcattctctattgcacatgacattacattatgttttttaatagcctttctagaggaatgcttttacggtctactcataattaaccatggtaatggaggaaatgtgtttcatggagtactgtaatccatcgataatcctaaatatctgactctaattatgtggcctcctccaaaatctttaccacaaatctgattgggaagcacaatggattgacttgtttcttccttttctcctgatccattccagatttattagcaattagatggtcaaagggcaggctgtagagggccacaagatcattggaaagaccttgataaagatccactgagtaacaggtttctacactacttgttctcaaaacttagggtccatagactcaccttgtgaacttgctaaaacagagatacctgggtcctccctcctccaaacacattctgagtccatgagttggaggtagaacccaggaatgtacgtttttaacaagctcccaggtaatgatgctgcttggaccatgcattccagaggagtttctcaccaagtcactgtgcatacaaaccacctggggatctaataaattgcagactctgaatcagtgtgtctggaatggggcctgagaggcaacattttaaaaataatatattttttacttccattaatactgctattactgttttaatacctattatccttatttttaaatggacaaaaattgtatgtatttattgtgtacaatgtgatgttttgaaacatgtatacattgtgaaatggctaaataaagataaacatgcataaaattgacataatgatcacatactgattttacattgagaacacttaaaatctcccttagaaatttccaagtatataatgcattgttactaactattgttttagcctgttctcatgctgcaataaggaaatacccaagactgggtaatttataaaggaaagaggtttaattgacttgcagttcagcatggctggggaggcctcaggaaacttacaaccatggtggaaggcaaaggagaagcaaggcacattcttcacaaggtggcaggaaggagaaatgctgagtgaagtggggaagagtcccttataaaaccatcagatctcatgagaactcactcactatcacaagaacagcatgggggaaaccacccccgtgattcaattactcctacctggtctctcccttgacatgtggggattatggggattaaaattcaagatgagatttcggtagggacacaaagcctaaccgtatcaactgtagtcactaggttgtataacagatctcttgaatttattccttttacctgaaattttatatcctggaccagtatctccccagtccttcccacccattagccccagtaaccactattttactcttcgcttttatgagtttaagtttttcagattctacataaaagtaagtatttgcctttctgtgcctgtcttatttcacctagcataatgtcctccaggtttatccacgtgttgtaaatgacaggacctctttaatgccaaatagtattccattgtgtatataaacaggctgattgtccctaatctgaagacttaaaatccaaaatgctacaaaattagaaatgtttgagtgccagcatgatgccacaactggaaaattccacacctcatgtgacaggtagcagtcaaagtgcagtcaaacctttgtttcatatagaaaaatattttaaatattatataaaattatcttcaggctatgtgtataagatgtataaaacttttatgtttagacttgggtcccaccccccagatatctcattacaccaacagtgtaaaagtattcccatttctccacagccttaccagcatctattgtttattgactttttaataatcgccattctgactggtgtgagtgtggttttgatttgcatttctctgatgatcagtgatatttagctttttttttatatgtttgttggccacataaatgtcttcttttgagaagtgtctgttcgtatcctttgcccactttttgatggaatttttttttcttataaatatgtttaagttccttgtagattctggatgttagacctttgtcagatgggtacattgcaaaaattttctcccattctgtaggttgcctgttcactctgatgatggtttattttgctgtgcagggattgttttcttgatttctttttcagatagttgtaagtgtacagaaatgctactgatttttgtgtgttgattttgtgtcctgcaacttaactgagtttgtttattagctctgacaattcattcatggagcctttagggtttcctaaataaataagatcatgcctacaaacaaaggcaatttagcttccgtatttatgatttgcaagccttttatttctttctcttgcctaattgctctggctagaacttccagtactattttaatgacagtggtgagaatgggtattattgtcttcttgaggaacaagacattgtttctcaactcatgagagtaattttaataagcactcaagtattgtcattcctgtttgacagtaggccgtattttgagtaacaagggtcacagcataacttgccttttggtgaatcagttggaaccagtttgccatttagttaaaataaacttttctttgcactggtattactagaagtaattgtgcttatttataattaataataattaaatatgcttattcttagttacctaaaaaattatgatattaatgacctcttggttgataatggctaagctgcctcagcttctccaatttagcaacccaagtacatatcagttcaaagtaacacaaattgaagcaattatgtatgatcacataggaatgcttctgattaacaaaatccagaggactggtctttgccttcataaccggaacacaccacatgcatggtttcacagctcttggctattattggacttacttattatattctttaattcaagaaaaattgtagcttcattcattctgttcttaataattttaaattctctttagcctcctgggaatgggaagggctagctggtatagtcccctgtatctcagatttcagttacacataaacattaaaggggcctgacttagggcgctctttgcctctgtggactggtggggaaaatccaggtgtgtcttaaattctaataatcatgaaaatcagaaatcataatgtttcaaatacaaatcttcatacatgggaaatacaattgaattaaacattttcttcaatgtaggagacatttgtcagataacagaggggattctcatttggctaagagcttacctctaagattcattaaatgtgtttagagcatattttttgtagtttgtagttattttatttttctgagttattatttggattattttctcttttatttatgtatgcatttgtcactgctccccagaggcacctcattttggcattgaagctaaaaacccattcattaaggttgggatggagtgggctttgatatagctagcatttgggaggtagaaaatagacattcgtgatcaaaaaagctgtaagcggttactataaactatttttaaatttctaagtattttaaatattgaacaaatgtgtagacatttgatgtgcatctatactgtgaataagaacttaaacttctaatattcacattaactttcctgattttataaattctcgtttatttttcatctgaacattgaagaatgacatctacataaagtaaaagcaaatgttagtttgaacacattctaccctaatagtgcatgttttaaaattgctttggcaggatctaccaatgtattggcacattctcttcatggagttcctcatgtgataactgcaacattgcacattataatgggtaagaattcttccaaagcagttcatattttataaggaaatgttgatttatataaggaaggccatcttatttccatcagactttaagaaaaggcaggttctttgtctcttagagtagagaaatgtttgactaaaaaaccaaaaggcaatgctttactatgtggattgcctgtcttttcaaaatacttgctttgtaaagagcagtaaatgaagttttattgtaatctgtacagaaaaaaaatattgtagtgtgctcaaaattataattttataaccagatgaagaacattaatgaatactccttaagtatatccaacactgatgtaggactgtaccaagactctaggactaggattatgttattaatgaaaaaacataaccagaaaaaaatttcagccagtagatgtctatagatattttattatccctattggtaaaaagcatataagctcaggtatatgtaacactaaactactgttaaatctgtgtttaccttgcctatctactttaacttcgtttctttgaccatgttttataggaaatagcaataagctgaaaaatttagtactctgtgtttcttcactagtacctgaacaagttaaaaatggtaattattgtagttataggtaaagggaactgaagagaaagtgaggatgttcatggtctacagtacctttagatattctcctataagccaataaatatgctctcttatgtttgctgttttgatacaagtcctactgtactcactgattaatatttaatgtaatattcaagggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaagtaagtctttttcttaaaccaaaaattgtatcccaggttcaatgactgttaataacaaatttcattacattttagggcagaagactgtgaaatatcatttttaccatttaacagctctgatgatgtgcaagaaaggtaggtaaaaactcaatgtaatacagataacctgtatctttaaagcataaaacattctgacaaacaattgatcagacttaggatctttggttatttttctaacatagtagtaaagaatatagaatcacagactcttacaggtcctagtaagcaaacaactactcactcagcctttttctctttttccttccttctttcctcccttccttccccctgtctctccctccctccttccgttctctttttcccttcccttcccctttctttcctttcctttgtttttttccctttctttccttttccctttcccttttcttttgagtgcctactatatgccaggcactttgaatacaacaatgcaccaaaaaatgaacaaaacacacagttttgtccctcgtgataattttggtctagtgtgtaatacaaatattaaagccatattaaagaagggttatagtctttaaagaaatagtacattattattccttataatactagtttacctttaaatgaatcaacacattatgttggcagcaacaaaattgtacgtttttacttactatctaattgaagaaagtatttaacatatataatgatgagttctctaattttctcatatttaatagatttgtgtgtgtctgtgtgtctgtgcgcgcgttatctgttttatgtctttgttttgttttctttcttttaggagggcacagggatctcccaaatctggtgagtcgaaaagtatctccttgagaactgtgccaggttctgttgacattttgttctggtgagggaaaataaccaatcactttcattacctttagactgtaatgatcaatggcaaatgatccagggtcagttcttgaatgtcagcattatggcaattccttgcctgtgttcagtggcacctagaggcttggcacctaataccaggttagtaagcatttttattgaattgttgatacatttcttatagaccattttttttccagggtatccaattaactgttggttagctagaaacttaacaggtagtttatctttgtatattagagattctaagggatttgtcatcacagtaggttgagaacaactgttgaactggaataattatcagataatcattgactatttaacgtcactgaggctaaaataatatttcctaagttttattgatagaattttatgcctactttacttgatttattcatttagttgtggagaacattatattaaatactgatatttcttgtgaatgtctttgctttccaactttaatgcaaacataaatatccttagcatgaaaatcacacatatgtatatttgatactgtattagtctgttttcatgctgctgataaagacatacccgagactgggtaatttacaaaagaaagaggtttaatggacttacagttccacgttgctggggaggctccacaatcatggtggaagatgaaagtcacatctcacatggcggcagacaagagagcttgtgcagggaaactcctatttttaaaaccattagatctcatgagacttattcattaccatgagagcagcacaggaaagacccacccccatgattcagttatctcccaccaggtctctcccacaacacatgggaattatgagagctacaagatgagatttgagtgggaacacaaagccaaaccatatcagatacttttagtcaaaagaaacatttcagttctatttaatgtgaatagtagtgcatatcaatctcctgcccacattttcaattgaataaaatatgagacatcttatatatatctttttatccatgggatatagacattccttctcttgcacattcttcttaatcagctgtccattatggggctgaaaatatttctttcctgaatccaatcctgtagagtgtaggagaaaggatcgtgagtgttgtgaaatataggcaataaacggggaaatattcaaagttagagaagaaaaaagagaaactgcaaacttcgatattgaaaacccagatggcaaggtcctcattaattacatctagtgctaaaacttcaaaggagtattttgaaccttgtgtgatttagaaattgagcctggtggttttccccgacaccttcagaaatcctagatagctgtgtgctttcataatgtagtttccctgactaaacttgaagacgtggctagctgaccaaggagctatgtttggcaggacttgagacaatgtttatctaaccctgtttgtttaaggaccttcttgggagggtagacctgctcttctgggaacaatcgattcatagctccttcaaagccactccataaatgttctgcttgactagaattccactgttgactctgcaggcttaatcagtattaatgaatttttcagagaaggatgactaattagagatttcttctgtggtttataatcacaacatgccatctttgcaaagaccttttgatcaagactcatttgaccggagatttttcagagatgtagcttctgatgattcaggatgattgaacaggagatttcactttcttctttttcccccaccatgataaataataatttatgttagaatatctcagtgcaaattgccagtaggaactaatattcttatattctaagtattctaagattaaatgtgttcatatatgtgagacatttaaagcagtgccagccatgtaagttgtgtttctatttcaagtaaatattgcaaagcaggcataggatagtgcttttaatgtttataaattatgcaattaaagatgcacagtaacactaccatgaacgttttggtgctgtttatttttaattgggaagaagaagcatgatggaaagcatactgagcacctggagtattggtgctgatgaccattttttctctgtgtgcctttgaacaaatcacttaaacttggagttgtcttttccctctacatgaaatgagcgaatgatgagataatctctaaggtcccttacagctctgacttgagctttcataagatactaagagctctttttttattttgttgttattcttaaattaacttcatgtttgcactgaaatcaagctagaagtcatttgtatgtatttctgcaaactgcattctatagcttgatgcatttgtgagtggctgttttggcactaaatcacacctctgaattttcactctcttatattggatggaacagttatgcaagattaaaatgttcagtcatttaactgaacatgtgtggcagcatttgttcactccatttcatccatccaaaggccactttgatttatttcatttcctatgtcacttagaccttctgtctataaataaatatttaaatcacactttagattttagaaaatgttgagctatttgttacacaacttgtgcatattaactcttctataatacatcttttaacaacatagtttcacatttagaatttctaattacattgtattttaaattatgtcttgatatgtgagtaggacgcttgatggtttgctttgtaaaatgctctaatgtaagagcttattgagaaggaagccagtgatttaataaaactcatttgaaagcctgcatcatttaaaaaatagcaagatacggtttatgaattttaggtaaacgtaacatggtgatttatctatcttgtccaatactttcagtaaacagtatacttgttataaggaacagtatgtcataatttttggtataatctcttagtaaatttcttgatgtctaatagaaatatttaatttcagattaaataatggaagtatggctcttataattgcccgaaacacttctcggccagaatttataaaacacctgaaaagatatgccagtgtaaaaaatcaggtatagtaaattctttttgttacttatttgcaaagctattaatcatgtagaaaaagatgctgcaagaattgacatcgaatcctgcctcataagaaggttttattttcttctgaatatattaatcttctttttcccaatctatttcatccaaattttgaaaagcatccgccaggattaatatagattggccttttttgaatgatgaattagtggttatgtatctgtaaccacaaagataaaataggaaatgtagtgttatattgcaatgtgaaataaattaaggataaaattccatactcaggctgttcttcagaatgaaaagaagtgaaatttgagagtttagccttcttgatattatggcagcagactttctaaagttatgatctttagatcttcctgacatttgtttgcatatctgcattgattgaaatagatctgtagatatgtatttaaaaatatgacagttttatacaaatattcattcaaaatgagaatatgtgaagatatacatttccacttaagtgatttgctttaaagagaaacagtaactattacaagccatattattttggcagctgttttgacctgattattaggaaaatgatccttgaactatgtgaatttctgaaattgtgagtctttgaagtacataggtatggttgtaaaaccctatagtttcacactttttctttttctttctttttttttttttttttgagttagagccttgctgtgtcacccaggctggagtgcagtggcgtgatgtctgctcactgcaacctccacctcccacgttcaagcgattctcctgcctcagcctcccgagtaggtgggattacaggctcacacctccatgcccagctaatttttatatttttggtagagacagggtttcaccatgttggtcaggctggtctcgaaactcctgacctcgtgatgtgtccacctcggcctcccaaagtgctgggattacaggcgtgagccaccacgtccggcccacacattcttaaaggtataaaatggtgcttggatagagttgggagataacagacgggaggaggaggagagtaaacccagccaatgactggcagctgaaccttgcttatgtaccttagccatagcaagtctctccatttttgcctcattatattttaaaactttcttaggccatcttcatgaagtttgatctgtcagtaacattatttgatcctcatgtattgaacaactaactgggctgcttaggaacttaaatcataaaaaattacagtcccactttctttatatgtcaaagtagatcagcaggtataatgtaggttgtgagcctacataacagttttatgtatgtgtttgggtggaatatggagatttattgattttcaaaggaatatatgccctttcacattttaataaatttctaaacattaaaaccaatttttaaaaaacccaaagcactatatattcattgctgtttttaagtcagaaaatagaaacaagaaaatgattttaaagcactcaaaattccatgttcctcaagattagtgtcattaccttggtagaattttttccgaatccttttttattaaataaatgagaagtaaagtaagtattaacctcattcatgtacctctatttgagaacttaaatagtattaacctattaatgtacccctgagaagttctgtatttattttggggaggtgtatgttgcacaaattgtttatggaaggtctcttttgaaattgcctatggggcaagtctctcaggcaatttttgtaaacattcttcttcttcatttttttaaatcaatatacctttcttctgattttaaaagcaatggttaccttacacataaagacagacatacagaaaataataaaaatctgtatcgataggaagacgttttctaagagataatattatgcaggatttatcatattttctcatgtactctacgaggcatatcttgcttttgacacaagaaacagttgcctgtgtgtgattcactggccttaactctgatttatttatcaactttcaaaaattaaaatccatgctattttttttttttttgcaaagaattctaaaatattttgcatagtgtatatagtaagaaagattgattcccagggtgactgctttcaagcaatgttaatttgatttgttaattatccacacaggtgtgtttatttaggctctttccttcatggtgacattaaaaatgtgaatttatataaattttgtaagattatgaaaatcagatctatgtaaaaatcatgtctactgcataattcatagcagtgctggtattcaggaaggaaaatgtggcaattcagtttaaggagagtaacatctgcttctctgaaccatttttaccaggttgaataagcgaatgttactgtataacactgtaaaatagattgaaaccaccatgtgcggagtggctcctgttccttccccatctctgtgtaaaattagatagaggctgaacactacccttcaaagtccttgcagctccatcctattgctttgccccccttctcactgtccacacttttctctttcattgtgaccatttttggtagggagtttaaaaccttaaatgtgagtgcttcccccaggatttctttgcagccctctcatcttctcaggatgccgtctcctggatggcctcattgcccctcacttttgaactgtctgaacatcatgcactcccaagggttctgtcatctcgtcttatctgcaggacctctgtcttcttgtatgctgaagaggttctgaaattcaccggcatctggaggccaacatgtctacagccgaccttatcttttcccctaaagttgttccttctgcgttgctctgtgcgggtcaatggcaccactttctacccatccaggttaccctgaactgttccttcttcctcattcctcactaccagtcccctaacttgttctgttggtctcctcttaaatgtttctaaaatttctccctcaccttaattcaaactttaatcctttcttgcttacagtagcctccttttggccttcaggttctctggtcttgtcttccatacctctttttagagaaacttttttctaagacacacattggatttctctcctgcttaattcttcagtgcctttctcttgttgtcagaataatatggaatatcctcagtctggaacacgtggcctttgtatccaggtccctgcctgtgttgcaaccccacctcttattaccaccctccaccacattcccagtgttttggcattttattcgttggctaaggttgccataacaaataccacagaaaagatggcttaaacaaacagaaatgtatttctttcatggttctggaggctagagctgcaagacaatgtcagcaggtttggtttgtcctgagtcttctctctctggctggcacatggctgctttctcacagcacccacaagtgagtggtctttcctctgttcatccccgatgccttttcctatgtccaaatttcctcttcttataaggacaccagtcgtattggatgagggcctaaagacatcattttagcttaatcgtctctttaaagatcttatctccaaatatagttatgttctgaggtatacagagcgaggatttcaatacaggaatttgagggccaaggggcatgatgttgagcacctaggagtcacactgaattctgtgtagttgcttgaccatggtttgcctctagttttgtaaatgcttcctctctccagactttcttctccaggctaaatcttatatgttctttaaggctcaattcaaatgggaagctttcccaacatccatagcctgtttgcctcctcttgtttcctctgttgaactccacacttgcaccatcatggcactcccctgtatcaaaattgtaactgtttacttctcctccccgtgccccaaacataccctcacacaggatactaagctcttggctcccgaaagtcccacttaacagcgtctgtggcttcacagttaaagcatttgaaggatggctagatcttcattttgtgaggagtgcacatgacaactgctgatttaagataatagacttactggtggtggctgtcaattcttgacattccttggcttacagctgcatccctccagtctctgactctgccatccttggcattcttctctcataaggacatcagtcatattggattaggtcccgccctaatgacttcatcttaagttgattctacctgcaaagaccctatttctaaacaggggacattcacaggtaccaggggttaggacttgaacatagttggggtggtggagggaaatataatttagatcataacaggcagttgtgtgttttaaatgaattatcaactaacatgaatgattatgtagataattctacaaggatgaggcatgtagccaaggctttatacccgaggtaggaggtctaacgcagttactgtcaaacagttttgcttggggccctctaattctgtacctcagtcacaacagctgatgccatcatatcatctactgtttaactgtgtttacagtataaactggaaagttggctggaccttggtatctacatatgtaaaatatgggtgttggggaaaatattagttttctgtcaacttttaaaactgtttcattgaggtttacatgtggaaaaggggaaaaactatgtagatgatgtttaattaggaatgtatctcatgtcatttttctgaaaactgaaatgagtagttatacatttctgctcaagttatttggctatattttcttaattatgtcagaaaatacatagtgctttttcagtatagtttccttaggcaaacaagaaaaaacgcaagttgaagtttaccttgcaccattctatagtggtaagtaaacagtgatcttgcagcttgtgtccattgttaaagtgggaatggggcaggcaaacaccttttaaaatccatatttgattggctttctcttttaaaagaagacatacatcccattttatcttcagaagtttagacttgcgttcttccaaattaaattccaagtgtgaaacttgtactagtttgctttatgtcagctaaactaattgacaagttgataatggattatatgtcttctgtatctacaggccagtattaaagattatctttaattgaaaaatctacagtatcactattttatgtaacttctcacagatatgtactatttgtcataaaacaagatttctaggtgctagatctaaaagaacccaaaaggctttggataagagattccttcttccaaaaaaacttggagatccctgttcatagtctcaaagctattaaaatgtcagcatacatgctgatatttacttgtgagagagggctcagtgaactttgattcgcgttagtagctagagataaaccaagtataatgattatttgtatttatttttagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattaggtaagtctatttatttcaccgcttattgtcaaccagtaaacataaatctaatattacaacgaaagctctcttctctgaactatcaaagcaggcagttggttagtttttaaaaaatcagtaaatcagggaagcataaagagacatgcacaaatttcaataaataaaaagcaactttacatttattcaactgttatgtagacccaaggcattttctttggttatgcgtgtctacattggctttctaatttattgttgtgcataaactacagataatgtctacaacttccattttggatttttaaaaatggatcaagatcttaaatcttttagtggagccatctgaatagtaaagtgttagatttttatccttccatcttagtttcctctcactcataattactgtaacatgttttgttcagtaatttgcttttattaggcctttacagagcattcaacttcccttgggaacaattttacatagcaactggtataaacaggtttaggaacctgcaaacgcattcttggtaggcattgtgacactcagtggttagaagaagcatgcaggggtgcccactagacatgggtgttctagaggcataactgactgttttacagaggtaatggagagcattggacaatcaaggaagtcagttaaggaggttttagagcaattattgttgttgatgatttatcaatcagaccttctcagttttctagattacagctctgttgggaatgctgtgtttgttatcaatttgtatttggcattggcattgtgtaccatacttattaggtgtatgtgaaaaacaacaaaataagttgatgaaataatgtattttctttacagattgcatccaagacttatcagtctttatggaggaagcatggaagaaatgattccaaagtaacatgtaattgtttctaaaagaaatgtacaaactagaattttaatataaagaaatgtggccatgctttaaacctgtggtccccaccctttttgggaccagtttcatggaagacaatttttccgtggatgggggaatggtttcaggatgaactgttccacctcagatcatcaggcattagattctcttgaggaacatggcactctagatccctcacataccagttcaccatatggttcgcacttctatgagaatctaatgctgctgctgatctgacagggggaggaactcagtaatgctccattgctctaacctcctgctgtgtggccaaacggatatcctaatagaaattgatgttactaacaattagcctctagggctttaaaagtcaagatgaaatatcaattcaaattctgtttttagatatcaattcaaattcttttttttacaatgtgtttattggacacacaaaaaaactttgcaaccatcataatacatcaatatttaacctagataattctgaaataatttggattctttcatttttcaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttcttaaagtggtagggttttaaaattcatgatacaagtaacaaagtaagttgataacaaatactattttgaactgggcaaaatctagcccaatatgtaattgtgttccccttgtatctgagaggcctgtgttggacaaccatagtactctgctttcactgtgctcagataacctgaaatatatagttgtttctgagtagttctgagtaggaaagaaccaaatgtaaatttccttagagaccatcctggagaagacagttctaaatcggggcttgatttttcatctatgatcctagatgttctcctgaaagaatgactagcctttttataacgatacaaagttttttaaaaatacataaatgtcataaagtttattcctgtgtatacacactctgggttcaggaggttttgtgcttacatttcactactcaaatgccttcgcaaatctcagaacattcctcaccatcactgcaggcctgtgaacagataactttcatcaattaggatggctggctagtggcagggacttcatataaagaaatctttcccagaattgtttttccacattgccttctaatttgatcactccctataacagatgttcaaaattcggccacagctctcttatgaaggcagagtcagataaaatgatattctgcaattatctagatcataagcataaaataaatattacaaaaatgattgtatttaaagaaattttttaaaatccagaaagtcatttaaaatagaacctcatatagtatgaacaaactataaaaatattttacatttca

SEQ ID NO: 11 - DNA, 145347 bp, Homo sapiens
  mutation 90904: c/t SNP in reverse strand
attgctatttgggcaacaatatggctccttcagaactggtcgagaatttctgtggtctttgcttgaccttcaagttgggagtttcaaatcagaggctttgaagtctggaggagttcgcagccattaatccttccggggttgtgctaaaggcgtttctagaaagagatcggaaagacccgttcagcacaggcccattgcatcttctctttgaaaacgcttgtctgaatcaagtatcttatacagacccgagactgaggggagcaagagcgcaggtccggctgtggcgaggtgtccaccaccgtacttgtggtcaatgcctggactagagagccgaggccgtccagggcgggctggccagggaaccagaagcgtccctggactggctgagtgagggtgccctttccagcaacccagtggccatggttaaaaggcagaatacaaccgtcaaagaagtccccagctcccacataagagagcgcaaaggccaatggaaccaaggcctcctcgcgagaactagctcgctttgaggacaagatcctggggatggaggtggggactgacgtagtgagagggtctggaggaacagtcgtagctgaaggtcaggacatgaagaattgcacgtatggtagggatagaatggcaggtacaacttttctgtactgaaggaactgggagaggacgatccggttagggaggttggggaactaatctcaacgctgcgtttacagatgaagccgcttttatatggcgtatatgtttgcttagaggggccgacggagattaggagaagccatcctttggcgccaatgatcaaagcgtctgccaaggagaagaagccaagggatgggcctttcagagagggcaaggagtcatgctgctctggatgccagtgtcaggacaagaaatcgaaaggagcgaggactcttcactgcgtgcctcagtctccccgcttctgcctctttcacctctgtcctacttccggcgcgaaagcaggccactcgctctgatctagacctagttaacattagcttttcccttccttccctcaaatcccctcccccctctatccccgtcccttctgccgcctgaaagggttaatctctcctgcgggtaaaaacaggtccgcggagtctctaactggcgacagatgggccactttcttctggccacaaaggggccggaatggagcgctccgcggcatacaaatgggcaggtcacgtggttccaggctcttggctggaccgggaagaccatatggcgcatgccggggaggaaggaggaggggcgggggtaggggtggagggtgaggggagcggttgtcggaggagggcgggagacgagcaaggcgtggggagaagtggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaaggtaattacagttctttcatttttttgccccagaatagaagcaataactgaagactgatgaacctacatattctgtatgtgtgcgtttgcgagagtgtgtatgtgtattgagaccagcatccccctccataattgcccataagtactcacacataatgagtcgtgtcactcaagtaccccctgcaggctttctaatttaaattttaaaaatttgggtttcttttgtggatagcataggagcttcttggattttttaaaagaatgcacggtaactatgattatctgctagtgctgattttaaagtcccaaaagcaataatgacttcactttctcacttcttacagtaagaaaaaaaaatctatgttatcaatatatattttgtgtgcatgtattttacgcacattgggagtgtcaagctgtgttttcagtgaatgaaagggacatggataccttgagtattcacaccatggaaaataaatcaggttcagagatagtttagttgagaggggggaaagtggagaaagggagagggactcactcctgctacctgttaccgctccagaggcggccaagtccccagcagccactactggagccagaaattcagttgttttactaaaggctttttattttccttactagaagcggcaacttcgcggttgccaatcgctgaccattataattactcaatcttttaaagggaggtttgaggcgaactttgaaaagccccaataaagagcgggcggccctttcaatgggctgtttattagagaggagccttccgcacctgatccccggcgcgtgggagagcgctctgcgccgcgcccccagccctcgccctgcagctagcgcttttgtacaaggtggaaatttagcggtgggccagagatggaaggcaagaaaagaaaggcgagggaggggtggaagaccctgtccacttttgttgccaaatgttacattgatggtgaaacaatttggtggaaactatttttcctcctttctgcatttgcttttcagtatcccgtcgatgtaatcttcttaaaaatcgctgccagtattagtaaattacgcaatggctgttcaacttaaatcgctaagtatctggaagccaggacagaaatggaagtagaatgtgtgattttacagcttttttttttttttatggagttgtgagtaactttgaacacatttggataaacatgaagtcgctgaaatgtacagtcatttccacacacattatcctgtcgggcaaccaccataaacacatttaagttaatcactaggatacaaacacatatgcgtgagtggtgtacacatatacatattcactaccctcccccagtcctgtcctcactcctacgtactagcggggcacacgcacgcgccattataaaacactgcatttaactttttctcagaggcattcattttgtaatgggcaggtacttttcgcaagcatttgtacaggtttagggagtggaagctgaaggcgtatctggcttttgaatatagcgtttttctgcttttctttctgtttgcctctcccttgttgaatgtaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaaaccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtgagagcaattgttgcatttcttcttaaagggattctgtttttatttttggggaaagtagttgcttttttgctgagttaaaaaatactaaacactatatgtagaataaaagaaaagaaaaaagtttaccttggcatatgctcttgtctgtttatcttgcacagggagtcaccagttctatgtagataatgaaaagacctaactgatatttcattatttggaatatgggactggacggcagtacaaacagtgtgtttttttctttgttttaagtggcttagcctttaggttttttatttccatttttaaaaatgattgttacatgttttcttctatttctttttttaaaaggtggattttaataattattaacaagcaagacataaacaagtatcctagcttagtttgtctatacatttaagatgtataaaacattactattttcttggtcttctgttatctgtacatttttctgaactaaacagttttatcttgcaaactagtactgtcccagaaaaatttatacacctttaggaagtaccaaagggaaatgagttaattaatttaaagaatccaagagaagtaacattttataattgttctattaacatcttgtgatgatttccatcatttttccaagaaaaagcataatggattatttgtactgaagaacacactatttgtactgtatttaggaaggtgtaattatttcctccccccaccctttggggcactattctgttgtttcatgaacacaactcactggaaaaacttatggatgattctgtctattgttaagtccacttcaaaaaaaaaaaaacagtttggcatttcttttcctctggatgtattgactgacagtcatgattcctagggaatatcattttggcacttgtgccctggctctactgtggtgctctgattactgtcattagtaactccattgtttctactctgattcgggtgccacattggatgactaccccccttcccaagcttgttcctttaatctccttctcattggtgatttaggggttccagaaagctgacctcatttagcaagctgctccagaaaaatgtgagtaatgtaatggacaggaacaattagccatactaataacattgccaatgaggctgcgtcaagctgtgacagaagcagtaaggaatacttcgacgttaaaaaaatgtttgagagcaatttaaaatatattattttaacatgttttctatcagccttcatcacatgacagaaatacttttaagttagtcccaactttatctaaaatgcagcaatctcattccaagtgaatcagagttgttattttggaatcaagctgttgctttctatatcctggattgttctcactgttcttactttaagagacataatactgatatgatacttgaatactaccagccttccagtgtaggaggtaatgaagtgagcattcagatctgatctaacctattaagtagctcaatttcacctgcaattaaaattagacatcttcatgcaaactaaaatctgttgctgtagtgaagagaagaaataaaagaatgccattttgagaattccagcttccaaaatagcaaacagggaaatctagactgtgttcttttgtaaggtagaaatgaagactaaaagttaggttttttttttttttcttcccattttgccaatacaacttcattctaaaacatagggattctttcagtcagtcaaggagtaactcacatgccaccatcttttattcaaaggcaggcacagatgttccttctgcaggggaggatttaatttatgaaaatgatattgtttatgcatgaatgaactgcatgcactctgcataacacatagcacttccatctgatcagagaaataccacagaaccagtgccaatgtcagaaacatattctacaaatttactcacttaaatgtttaatgaatatttggaaggcattttcaaaccataagaaacattttaaattatcttcttttatgaattcctacccatatttaaaagagactcttacagtttttgtaattggctaatgcttatacccagtttgtaagaaaagaacatattttactaaatgaaaaccaaccaaaaaaaaatgctggcaagtttggcttcactggaaaaaatatttcgtttagttttgctgtttaatgcttgtcatgaataatatttgggattctatctgtttcttcatcttgagccacgactattcctatcaaataagatgcttaggtatacttgtttaatgtgaaaatcctatgaatagttatttctagaaaaagctggtatgtaaaatcagggggaaatttcataaagatgaaattgggctaaatattgtaacatgcataattactattgaataggaacacttcacataacatattttactttatataaccaattgcagctatatagtatgatctatctacttttaatcattaaaacaattatatataaattaaaatgaaagattataatatcaagagtgttctactaattttaggtttataatatgttacagtaaaataccatttgaaataaattttgtgttctaatttatcttaaaatctctctgtttttacatttgaaagtccttacattcttacaaaattaatgcattttctgaaagaagctagcaattactaaaatgatatatggatcattagctaacagtttgaatcaagctgttttagttctataattatacaagaaatttaaagtgaaaatacctattaagcaattaataaaactaggtttcaaaatattggctaattttctcctaatgggaaatgtaaaatagcaaaactgcttcttaaactacacaaaaacctcctcacttctccttttctctctctctaacaccacttatttcctgaaaatcatctaaataaaatatttaattccagggtctgatgaagaataaaagagccaatgcaacatcttgtggaacaccaggactgagaactcttgttgttaccattgcaaagaggcgttctggcgtcagatgcacagtgatttgtatggtggcataatcattggctcctggccaggcattatgtttcagaggacactattgtcaagaaccattcaactagaaatctgcactgtatgcactcaaaagttgagatcatctgccttcctatgacaggaagaattctgtgctggcaattgactcatggactctcttcacatacactaaggcttggtccagtggctctgatggaattaactgtgcagccaaactagtggcattgacaagacagggccacagtctctggggacttcaggagaaattgctaattttaaaatgcagagtattatgttaatgctggattaaatcttcagatacattaaatgtggatttggccatctaagcattattatgttatttgcccagttaatttagaggtagatggatggtgacaataaccatctctacagatccacaattctaagagatggatccaattgtgaaatgatatggagagatagagtaagttcaatctagcatatatgaagtaatttggtaactgacttttcttttaacaagatcaaaagctaacctgctttacactttcatgtctaaggacagccaaccagagagatggcttcacacactagcccactgctaagtgcttttcattcactttcatatttcatcatcaaagcaccctcctgccttatttatagatggggaaacttcaggaagttgagatacctagatatttgcattcctgtcttcctttcttcattcaggtttttctttcattgccacttcctcaaagaagcttttactgattcccatttaaaatagcaactgacttcaactccaccaaaatcactgtattgcccctccctctttccagagcatttgcctatcaaatgttatcttatgtatttacttgtatagcttaattttaaactatctatctctaggtcttctgagcacctgagaaacagagacaaagttgtctcttctgtgtgttgctgttcctctggtgcttagaagacctagaggatcctcaataaatattaactttccaagggaactgaagagcactaatgtgatgctaaagcctgttgccttaaccactatgctataagtcaaatcagttgagaatggagaggaccacaaattattttcagtccagcaagtgttataaacattaattctataaaaagaaaacaattgaaactaatttcttattatattgcatggcaccaaactccccccacttcctttttgaggatcatgagttgtctgtcattgtttctttttattgatatcaattggttaaatataatctggaattggaataaaagaaaaactattataggctttttccagaccatgtatttcaatgcatattattttttcctttctgttcattattctttcagtaattgcacttgttctatttttagtgttatgtaaaattactgtagctcataatttctattttgaagggttcagtgtataaacttagcacatcaatactatctttttagtgttcgcgctcaatggtgtcagttaagagatcaccatcacttttggtgacgtcaatgaaggggtattgcaatgcttaagagaactgttaatccctttccactggtgtcactaacaattgtagtgcttgtttattcatagcaggtacgtgactaagtaatgttaacatcaaagcagaaagaggataatagagtgttctaaaaagaaaattcggtggttgggtgcagtggctcacacctgtaatcccagcacttttgagaggccaatgggggtggatagtttgagcctaggagttcaagaccagtctgggcaatatggtgaaacctcgtgtctacaaaaaatacaaaaactagtggtgcatgatggcatgcatctatagtcccagctactcgggaggctcaggtgggaggatcacctgagcctggggaggtcaaggctgcagtgagacgtgattgtaccactgtactccagcctgggtgacaaagtgagaccctgtctcaaaaaaaaaatgatttgagataacatcacttgtcattgtttgttaactgaataatctttattctagccagtgcctaaatacataataaatgatagtacaaatggatataaattataactaaacctaagtagtgatatttatcacaatatttctttactagaagaatttctttgttaatagaggcaaggctacttgtttagataccttaaaataacataagatttttggataaataaattaatgattctttgattctgactggcatattaaaaatattaagcgaagagatctttgcttcccaggttttattttttgtctaattaactactggtgcatttatattaaaacatattgtcaagggaaaacgtatatatatatatgtgtatatatggtgtgtgtgtgtgtgtgtgtgtgtgtgtgtgcacacatatgctatacttggttgagtagtatccccttcccttgcccacctctctcccaaatttatgtccatccagaacctcaaaatgtggcctcatttgaaatattgtctttccagatttaattaagatataagatgtaaattgatacaagttcatgctggattacggtgggccctaaatccaatcactgatgtcctgataagaagcagacagaacacacagacacacagcatacaggaagaatggcatgtgaaggcaaagacagagactggagtgatgtgtctacaaatcaaggggccccaaggatttggggcccacatcagaagctgggaaagagacaggaattctcagcttctccttctgaatccctaagaaggaatcaaccctgctgacaccttgattttaaacttcttgtctccagaactgtaatataatacatttctgttgtcttaagctacccagttgctggtgatttgttatggcagccctaggaaactgataggtatactaaaatctctaatgaattgatgttaaatatatataagtataggagagttcatttaaattcttctgaaaatgtcttcttaaacttttaatgatacagtatataacaaccagtatacgtagttggtatcgggtttgacatttaaacaagctgacaaaaaacagctgtttaataaacatctgaattatataaaagttttattgtttattattcatgtgaatgacttaaactgacatctacatttagtgaagtgtgaatgggcctagccaataaactatgggtaatttttttaaagtctcatctttgaactcacaaaaaattatcaaatatcagctattatgtattcttcatgtgaagaaaatgtcatatttatttgatttgtggattagcatatatattaatagagcttttgaaagaacaaatgtagcactttcccgatttcatagacactcatttaacacacaagttcatattttaaagtacataattttaaaaaaattctagtccaaatgaatttaagtgccatgacttctaaaaattctgtctctatttttgggttttataggaccttgagccagtactcttctggtgagcttaagaggctaagacttcacctttagttatatggggctttcatctgattatttgtctattttgattgctctaaatacaagttagtgtgtatttcatctgaatgtatttcattataagttttggttttatgtagatctggggatctgtcttgtttttaatcttgattggtctgtttgttttgggatagttggtactttcatttcttatgcttgctttctttttcattttgtgcccacctttagtcaggtgaacatcagtaaggaataaaattttatttttttaagccactgaaaaaatttaaaaaccacatcataactctgcctctgctgactgataaaaatgctaacttattaagacaaaatgttatgcaagaagactttattggaatagagaaacatcctttttatgtaagaaatatcaacagagacatgtgcctttcttgtgacaaatgtggtatgtgtgtggattagaggtctggaatgtggcagcatttcagtacttggaggggagaattagagtagggtagaaagatagacggggagcagaggatgattctcacccagtagaaagcagagtgaagaaagaaaggggaattgttttttgcattatattatttgaactgtggattaagtctttccataagccatccctacgcctctaagtaggttttattaacttaagctggtttgagatgggtttttggtcacacacaagaattgcctgatacaagagaggctttgattttgttgttgcttgctcatttttatacactaagatggagaaaaccctggacatagtgaagacgaaattgaggaaggtgttgggtagagtggagggtagaagacctgtaacataggtacagaattacattaaactggaaggacttatatccagatataggagtcagggtagaaagagagaatgttagcagtaagggtaacagagtagcagaagtttattcttaccaggtcctgttatgtgacagtggaggcatgttgaccttctgactaggggagttaaaggagaacactgaaggtttagaataatgtctctaaggatagaaagagaaagtttcatcaagactcatcaataatagggcagcagggcttagggccaagcaaattcagagaccatgatattatagtagtttgtagtggtcttaatccatctaatttttcagcattttctcaatggccaatacttagcagtggtagtgttttatggcatttggacaacagaagtgaaagcactggtaagagagacgttgaagtgaaacaccatggggctcagaaaagcagagttgatccatctggtacatgggcaaggatggtcctgaacaattctgcagtaagttggaagatagaaaaaatacctaacgaacttgtagatctgggtaaggagatttttggcagaatattgtaaggctaattggcttctcttaactatatgagatagggttttacaagggagagataagcgagcataatttagaagaactatagggggtcccaggcagactctctggctggaaaattattctgatagcaagaaattagccccaaagcaaagatgaaaagtagggtacttccaattaaacatgtcataagggcaagcctcaatcaagagtgtggctagaaggcacagctcacctggacaaaagtgcttctaagcatattaggagcatataccacaataacctgacttggacccaaagttgagagaggccagtctcaaaaaaatttgagggaattgcttttgcataatatgatactttatatacatatctgttacatatcatatatatcatattaaaaagaaaaaaaaccctgtttttccttccgttctttcatataacccttctgacaacaaatgtggagtttttcacacactaagcaattctttagttcttgctggacacttcctggatgtcctacaattcaactcgattctcacacaactgcccagagtcagtgcagacccgcagattaaaggcttagccccaaaagactaccccccactttagatgtcaatcacaagtctcaacttcatttacttctgaaggacgagctatacattggaggaaacccctctttctttcaataatttgctagaatggctcacaaaactctgggaaacatttacttatggttaccaatttattataaaggatataactcagaaacagccaaatggaatagattcatagggtgaaaaatgggggagaggcatggagcacaactctctcagcacctccatgtgttcaccaacccagaagctctcagaactccttcatttagggcttttatggagctttatcaagtaggaatgattcatgaaatactggcattggtgattaacttaacctccagcccctttcccctccctcaacattgggggtgaagctaaaagttccaactctgtaatcacagggtgagcttccctggcaactagtcccctgatccttagggggcttctgaaagtcacctcattatcataaactcaggtgtggttgaaagggatgttttgaataacaaaagatgcgcctttttcctttatctttctgagttgtttcaggagctagggacaaaagactaatactataacaacaacaacaaaaaattcaatttttgcttttatctcttgggaattacaaggattttaggagctctgtccagaagccagtgatgaagatcaaaatacatatttcttattatatcacaattcacacatgtacatgatatccgtaagataagtgaactacataaagtaagctcacaaagtttctgtaggagttttgtccatttacaaacagtttgtaagctaaaagtatctgtgacaagcctcagtcaatttagaagttcatttttccaatgttaaggacatgcctgtgacacagcctcagaaggtcctgatgacatgtgcccaaggtgatcaggctacagcttggctttatacatttagggagacataagacatcaatcgatacatgtaagatgaatattagctcagtccagagaagcaggactactgaaagtggaggcttgcaggtcacaggcagattcaaaggttttctgattgggaattggttgagttattatcttaagacctggaattaataaaagggaatttatcatgcagatgaagctttaggtagcaggcttcagagacattagattgtaaaggtttcttatcagacttaaaagagtctgttctaacagtctttaggtctcagtgttgatgttaatgctggtcagctgtgcctgaattccaaaagggaggagagtataatgaggcatgtctgagtcccttttcccatcatggcatgaactagtttttcaggttaactttggaatgtccttggctgagaggaggggtccattgagatggttgggtggcttggaattttatgtttggtttacaagtttaacattaaaagcctctgtacctccaatgttttatggacaaaaagaaggctgaaaaagctacttggctgtaatcatgggccatttcttgctgaaaagaagaataaaatggaggcagaaccaaaagcccagaggctagagccaagagctgctgagaatgatgaattagggaaccactctcagagagcagatctggatgtgagataggaacattttctttctcagggtctatgaaactggcaacatatgctctcctgaatttcagaattgctatggaccagtgactgtgatatgctttctatatttttcccttttgaatgggtgcatctatcttgattatcctctgtctcattattgtatgttggatttgtgtgggacgataacatgtgtttttagttcctaggttcccagaataagaggagcacactcaaagagcgacatttatgagatactggatttttcacttgatatcataattgggtgagacttgaaagaaagtgaacatattttgcaaatgggagggatgttaaccactgacaaccacacccacagggtccactgtattagcctatctgcaaagacggctgccaaaaattccttctgtccatatatacattcccttttttaatgtgactgtttcacctgccagcaactgaagggctttatttccatttccccttgtgacttgtttgactaacagcaagaagcaaaagtaatgctattccaattctagacctgggccttaagaggcatgacagcttctgcttttactctcttgaaactcaatgtcattttttaaaagctcaggctagactactcatcatgagggaccacatgaaaagagataggcccagctagtttccacccattccagccgctccagatgagatgccagacatgcaaatgaagccatcttggatatttcagccccagctgagcttccagctaaatgtaagtacattcagttgatacctcatagagcggaactactgagctgacttcatccaactcacagaatcataatgaataacaaatcattgttgctttaagtcaatacatttaaagtttttttgttatccagttgtagatgaattatacagcctggggggaaaaaggagatagcacactgttagttgcctcatcaatattcatccccaaattctttttcctttttagtaggtctcacctcccacctggaagctgaaaacacctttcccagtctctctggaagctacagcacaggcatgttgcccaattctaaacaataggacatgataggaggtctgctgggtgggatttttgaaaatatttttttttctggttaagaaaaaagaaatgcccaaggaaaacctacaaatgccccttccattcttgcttttggacattttttgggagagggtatgatgcttagcactcctgcagccatctcggggccaacaatagaatccttgttgctacctggtgatagtgaagtagaaagctacaaagctcttgatttcttttcttttttttttttttttaaattttattattatactttaagttttagggtacatgtgcacattgtgcaggttagttacatatgtatacatgtgctatgctggtgcgctgcacccactaactcgtcgtctagcattaggtatatctcctaatgctatccctcccccctccccccaccccacaacagtccccagagtgtgatgttccccttcctgtgtccatgtgatctcattgttcaattcccacctatgagtgagaatatgcagtgtttggttttttgttcttgtgatagtttactgagaatgatgatttccaatttcatccatgtccctacaagggacatgaactcatcattttttatggctgcatagtattccatgctgtatatgtgccacattttcttaatccagtctatcattgttggacatttgggttggttccaagtctttgctattgtgaatagtgccgcaataaacatacgtgtgcatgcgtctttatagcagcatgatttatagtcctttgggtatatacccagtgatgggatggctgggtcaaatggtatttctacttctagatccctgaggaatcgccacactgacttccacaatggttgaactagttcacagtccaacagtgtaaaagtgttcctatttctccacatcctctccagcacctgttgtttcctcactttttaatgattgccattctaactggtgtgagatggtatctcattgtggttttgatttgcatttctctgatggtcagtggtgatgagcattttttcatgtgttttttgactgcataaatgtcttcttttgagaagtgtctgttcatgtcctttgcccactttttgatggggttgttttttttttcttgtaaatttgtttgagttcattgtagattctggatattagccctttgtcagatgagtaggttgcaaaaattttctcccatgctcgtgggtaggaagaatcaatatcgtgaaaatggccatactgcccaaggtaatttacagattcaatgccatccccatcaagctaccaatgactttcttcacagaattggaaaaaactactttaaaattcatatggaaccaaaaaagagcccgcatcgccaagtcaatcctaagccaaaagaacaaagcttggaggcatcacactacctgacttcaaactatactacaaggcttcagtaaccaaaacagcatggtactggtaccaaaacagagatatagatcaatggaacacagcagagccctcagaaataacgccgcatatctacaactatctgatctttgacaaacctgagaaaaacaagcaatggggaaaggattccctatttaataaatggtgctgggaaaactggttagccatatgtagaaagctgaaactggatcccttccttacaccttatacaaaaatcaattcaagatggattaaagacttaaacgttagacctaaaaccataaaaaccctagaagaaaacctaggcaataccattcaggacataggcatgggcaaggacttcatgtctaaaacacgaaaagcaatggcaacaaaagacaaaattgacaaatgggatctaattaaactaaagagcttctgtacggcaaaagaaactaccatcagagtgaacaggcaacctacaaaagctcttgatttctaatgacatcatatgggatgaaccaacccaggaacagcctgactctggacctcttttaatgtcagaaataaaatcttatttgtaaaccactcttagttgttcaggttgttgacacaggcactgaagtgcctccaaatggtgatgaataatgaggcaaaagtcaaagacagcaagtctagtgtcaaattttttgatgcctatgggtaagaagttcaagaaagtgagctattttctttctttttaaaatttatttttatttttgtgggtatatagatgtatacattagtcagctattttcaatagtgagaagggatgttgccacttagtataatgcctttttcatagctatcatagaaaccatatatacatatagtatagaaaatgaggatagatttctgacttaaactgcctatttcatttgtgtgcctggttacacctaattcaagactctacaatacagcattgctagcaattactgtgagaatatttcaagctccctatttgctggaaatacatttcatttttttgttccaagtttatgaatattagaacctatctaaaaaggagcttttaaaaacttgaggaaaggaaaagggagggcctacttttcttgcctgtgttatttcttgttactgctgattgagatgctagagatcatattgggtgagatgtgtcttagaatacagctgagcaattcacttttaacagtttccatctgagtacaaaaaactggtatgtgcagaaaacttgatattctgacttggcgggattctaggatttgttctatttttttctgtaattgttgtagggacatatggccctgtaccttttgggcagcaggagccagaatagcaggaacattctgacaaaattcccactcagcatgagagggaagcagtccccttgatacactgatgatgtgcccacttagcattacaagtgtttgagaggtggacacaactaaaactcacctcactcaaaatatatattgacacggagaaagtaaatacaatttgctgttattaacctttcttctcaccattgagacatgttaaatatctgaaattaataaaggaattaaatttaaaaagtttacttatcatgcatttaacacatttattgagcatctgttatataaatgcactgtttcaggcacaagagatagagccataaataagcagattaaatcactattctcaactgaggtactaatctgatataagagaggagacagaaataagtaaacattataaatcaactacatacttttacatggtgtaaagtgcaattaagaaaatattattgaatagaggtcaattttggaatggttgggcagggaagaccttctgaggtgacaagaagttggcctgggcaccatggggagctctaccatggtgaaaagtgttccagacagagtagacagcaacagcagaggccctaaatgagaatgcacttggcttatctggagagtagaatgaaggccagtgtggtaggacacatactaataataggagaaaactgatagaaaagagggtttgagcaggtgggcaggaattggacaacatggtgtctcatatgtcataatagaagtttggattttattctacctgcagtgagaagttcttaataaaaaaaaaattctataaactggagtttgagaaagaactatgttgatgatagcataagccctcaatcacttgtcacataaactccaaacttcagcagagactcagggagatcaaagggactaccacaggattacccactggctaaaattcagatccatggcagttggtcctgactggaattagacttccttgtctgttgccctcattgcagtgggtctgaatgtctctgtcggctgtgaatttttctccctctatctgtggcactgagaaggtggcccagacttccagagtctgtctcattggcctattacttggggatttgctgcccttcttctggaagtttgggtatttgttttcagagcatacttaaaggcctcctgaaagcaatgttaacaatagcaggatatattttacagtcttctactcagacttggatttttaagaaccagggatggagactgtgtttccagatctagtcaaatcccttccaaacataaagcaacaaagtgccttttaaactaggacctgtactgtttaatgctctggaaacaaatacccaagcttcagccaaaggagggaaagctatgttcaggaagcttcctgaaagttttttgaaagcaattttcatgcattagtattttacatatatatatatatatatatacacacacacacacacacacatatatataaacatatatatatatacacatgaatcactaatgagacaattgatcttcaggaactaacgtgaaataattggggtatcttggtattattgttatagataaatgttgaagaagttcattctttcagatattaattgagcacttactgtgtactaagaactgtgatagatactggggatttaatggtgaacaagataaattctctgccatcagggggcttatattctaacaaacttaaaatttactgagtgttctctgtatttcagtattgttactaagtacactaacttagtggggaagctagacaataaacaaagaagtatgtaataagaattaatagtaagtgctgtaaagaatactaaagcaggttatggtagagagattaatggcagcgtgaagatgtccatgtttcaatccccagaacctgtgaatatgttaccttacatagcaaaagaggctttgaaaacataattaagggttatctgggcaggcccaatgtaatcataagagtccttatctaagacgggggacaaaggtcaaagacagaggaaaagagacgatttaaggatagaagcaaagaggagagatgttagactgctggctttgaagttggaaaaagtgaacatgagccaaaacaaacaaaacagaacaaaacaaaatccacaggtgacctttagaaaaggggtccccagtctctgggccatggaccagtacctgtctgtggcctgtttggaaccaggctgcccagcaggcggtgagtggtgactggtggacaagcaagttttaccacctgagccctgtctcctgtcaggtcagtggcagcatcagattctcatagcagcctgaatcctactgtgaactgcacatgcaagggatctagtttgtgctccttatgagaatctaatgcctccaaaatgctcaccccttcaaactgcccccatccgtggaaaaactgtcttccacaaaaccagtccctggtgccaaaaaggttggggactgctgctctagaagccagaaaagaggagatatattttcctctagagcctacagaaggaatatataggcctgctggcaccttgattttagtcctgtgaaactgattttggatttctgacctccagaaatgtaaaacaatgcattggttttgtttcaagtcactaaatttgtggtaattagatacagcagcagtaagaaatgaatacacaggtttacaggatggtgaattatggagggtgctcaggaatggcctctttgaggtggtggcctttaaacagaaaaatgagcaaagtgaaagaatgaaccatctggtggggagaaaagcattccagtcagagggaacagcaaaagcgaatgctctgagaagggattattcttctcaatgtgtttgaggactggcaagaaggctttgtgtgaatgagcaaggggaaaaagttagtaggtgatctcggagacatagccagggtccagattataaaggacctctcgccttgctaagcattttgactttattccaagaataatgggaagtcaatggaaggctgtgagcagggttatatgctctcgttattttttaaaggcacaatgtaactccaaaatggaaaattggctctgggctggaggtgccagcacaggggaaaccgaaagcagagagctgggttgggagagcggagactgaagttgtccagctgaggggtgcagaagtgcagactgcaatgacagcaggcagaaaggactatatgttctagacagaatggacaggatttgctggtagattggattgaaggcatgagacaaaggagacatggatgatatcaaggattttgatactacagatttgaaacattctgagagggacaggtttgtgatggaaaatcatgagtctggttttagatatgttttagaagcttattggacagccaagtagagatgtcaggtagggagctggacataatacctaaagttcaggagagtggttggagctggtgacatcatttgcagaaccctggatggtacataaagcacgggacagtgtgtggatagatcctaaagagagccctagggcactccagccctggaagaaggcagcttatcaaaggaaaaagaaagaaagaaggaaacacaatccttattacttccatcttcaggacaattcaaagccagtgtttttgacttcctggcttgagtgaagcttgaaaaatggcaacttgcccctttgcaaagctcctaaggagtagccattggcttggcctgtttgcactggctctgggtgagcttttaaaatgccagtgagctctaattgtgttgattgcctaacagctgtgaatacaagatgctgactccagaactgcaactcattctgcgaagggcaccgtccttttccctctaatgactgctgaacagagccacctgaagcctgcatggggtttagcagcagctgcacttctgctctaagaaatagctcactgcagtcagatcaaactgaagctcttccttgcttttcctcgaagcttgggtacttattgtcggagcattaaacagtaagagtcctagcttaactggtgcacagtgctttatgtttggtagggatttggttaggcctacaaaccgtctgagctaagaaccttgagaaactcctgctatagttagctctttctgtgactctgcagtgtgaccaggaatgaggacagaattaagaatttgctgcctctatgatagaactgtttaggcactagaacactggaactagatctacaaccctatgaatttaatttccttttcaactcccctactccttcttttcaatatgatgataatgatcttgtttaaaaaaaaaaaaagccttctgctttacttcccactctgctcctcttcccagggactcactttcttcttgactgcttccccattacaagtactcagctccctgttttatcaccctgcttagagcagccattatcagccttggctgaacattggaattacctgggaacttttaaaaatccggaagtctgggtctcgcctccagagattccagcttagttgtcttgagcgtggcctggacatttgggttttcaaaagttccctatgtaactttaatgtgcaaccacaattgagaatcactagcctccagactctctgtgttatcaaaattaatgagcagctgattttagaaatctcagttatcaggagaaaagggtgaacccccccagggctcttctccttttccaggtgacacttctttatggcagtgcgtgaaagtgaagccctgctgcttgtaatctccctcaagggagtgcaagatccaggcaaagacaagactgcagaggcgctaccttgggggaaagtaggaccctaaatacttacacctggaggcacttacctttaatactgaatttgtcagatgcaaatttgtctatgcaaaccagggccttatctctagcttcccctcaggggttttgggaagtgcgctactactctgaaacagggttgtaaagcgtcacctgtgctctccagggaaccctctggaaaggaggtggaaaaacagaggcttccacccttgcaactctaagtgtgttccttggccagtgggatccatcacctagtattttcttagatatgtggtatctgggggccagtcccacacctatgcaataagaatctccatttgaacaagatgcccaagcgattatatgcaagtttaagattgaggagggctggtttaactcgagggtaacgaaaagtacgaaatcgtactttacaggagaagctaggcggagggagccacttattcttcctcttgcagctgggtctttttgtggtgagtggcgaagcggcgaggctggcaggccagggtgctggactgggtcaggcgcggccccgcctccctcctgggtccctgccctgcgcgccgttgctgtggcagcgctggacgcggctagagctggggctgccgcgccctccacctccttctccaaaggcctccccggacccctggctcgggcccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgagtgcccggccccaagcgtcttcgcctccctccgcgcttcctccctctccccggcccaaggcctacacccacgagcttttgctccaccctccccttttctcgcctcccctccccgtgctcgcctcactgcccggacaggttaccgagtccccaagtcgccgcctcctccttcccaactgggaactcacgcctctcgccccatcccagaacccccagggattctttcgctacctagccttttcccgcctccgagaccttccccgggcaaacgtcacaagcagcttttgctcagagtctcagcagaaaatcttgagccccaaaggggaggtaatttacaaatgtgagaaggtcaactactcctcccctccaagttgaaaaagttttaatccattaactttgatggtacattgaaactataaacatctcacagattatgcctacacaagagttctgaatccaactctcattttgctgacttgaaaatgtaactccagagctttgggagtgtttctgggtttttttctgcccctcaccttccttgccattgtctagaattaagacttcttcaggctcggtctagaaacttttgatttttaatattgaccctagattattggatcacagttttgcgatgcttagttacgtcaagcggtttgcttaacgtttgccttttattgacttaaaattttagttacctaaaaaagttataatgctgtagtttacaacaaatacttcgagtctattttcacgtcttagtcaaatagccttatagacttaacagatattttataaagaccattttgcaagtcttataagtagactttcatatagtcttatttctaagtccaaactcgagaaatactccccattgttgaattagcttagatgtgagcggtgaaagacagatgaaatgggggaggaactacatcaaggttactctacttgcgaggagatgacttgggggagatggaatttggtattcaacctcttttagctaaatacaaatttatgaaattaaaaaaattgccttcccctgttggaaaacaagacacagtgtggtatttatgttacagaatagactcactgtcttaaagtcttgctcaaaagtctaacaaaatgaaaccaactagccagggattcagcactggttgcgattgtgaattctgcctgtgctgcatgtgccatgctcgctcgcttcacgaaaacagtctttgaccttaaagtgttttcaggtgttttaaaaaccaaggtgtagtattttcttgaaccttttaagttaaaagctagggatatagctatggaattatttgtaagtctttcaggcaattcgagttatgcaatatagaagtttataattacagtttggattagcccaaagagccagtttaacctacagtgcagctgaaatgctatagaattaaaatgagacattgtgcaatgagaggtcatacaaaccaatgttgcagtatttgtgtacaaaaaaagcaaacaatgacatgagaaaagaaatgctgttttatattgagtggtgattaaggtaaaataggtttaattagtgcacccctggcagtagagtttaaaatacatcttgacagatttgtaactttaaaggttgcaagtactgattctttgtttaattatgccctaaaaccatttggtggtcttttccttcatacaggtgtaccctttttctttgtaattaatacctggtattcaaaccactttgggcctctaaaattgggggcacagaagcctagagccttagtaagtacttctgtttatggaagaaaccaagagatgttttatttaggtaaaatatagccaggcgtggtgtgtccctgtaatcccagctacttgggaggctgaggcaggtgaattgcttgaacctgggagttggaggttgctgtgagcggagatcacaccactgcactccagcctgggcaacaagagtgaatctccatctcaaaaagcacaacaaacaaacaaaaacaaacactgggaaataagaaggagatattaagagatgatatatttaaatgttagaaatgctctgttgttgaataagcttagatgtgagtggtaaaagattaaatggaagagggagctacatcaaagttactgtacttgggaggacatgatatggtaggatgtggtggggggagagcatgtccattgctggttggcaagtgactggctgcctcagaaaaggatgagggtgggtaggggagatcactggagattattagaacatacgtatgttttcaagattgcttagtttttaaacctcatagtactttgttttcactgatgaaataaaatactatgtgatctttttctaattttccatcttgagtaataagcaaagacattaatgtattttatgaaggctctgactgccaaaattgggacaaattgatggtcttgttggcagggtaaatgagcataaccgtagtaattgtagttctttttattgggttcagggatgacctggaataatggatgtgttattacccttccctgtagaagtgaggctttcgaaaagaggctataagtcaatttgggaggcacaaagtatcagcgctttttggggattttttttttttttaagtagagaaatattttaaatgtgtgatataaagttatgcatgtgcttcttaagcacattaactcaaccagatccaacagctggtctaataactttttaattgtttaaaaaaatttaattgacacattgtaattgtatatatttatgagatactatttgatgttttgatatttacgttgtacaattatccaatcaaagtagttagttatccttcacctcacactttcattatttccttgtgggttagaacattcaaaagactctcttctagttattttgtaatatatagtattttactgttaaccatagtcaccatactatgcaacaaaacaccagaatttattcttcctacctagttgtaactttgtgtcttttgactaacctctctccatccttccttctcccctccccttcccagtctctggtaactattctaatctctgccttatctatatcaaccttttataatagaaaaagattctacatgtgagtgacatgtggtatttgtctttctgtgtctgggttacttctcttaacacgatgtcctccaggcttagcattcacaattgacaggactttattttttaatggctgactagtattccattatgtttctgtatcacattttctttattcatccattgttgtacgcttaggttgattccatatcttggccattgtgaatagtgctgcagtaaatatgggattgcagatctcttcaacatactcattttatttcctttggatgcatacctggtagtgggattgctggatcatatgatacttctatttttaattgttttaggaacttccatgctgttttccatattgactgtactagtttacaatcataccaccggtgtgtaagtgttcccttttctccatatctgtgtcagtacttattttcttttgtctttttggcaatagccattctaactggagtgaggtgtatctaattgtggttttgatttgcatttccctgatgattagtgatgtcaagtatcttttaaatgcacctgttgatcatttatatgtcttcttttgagacctatcaattaaagtcgtttgcccatttaaaaaatcaagttggccaggcacagtggctcacgcctgtaatcccagcactttgggaggccgaggcgggcagatcacgaggtcagaagatcgagaccatcctagccaacatgatgaaaccccgtctgtactaaaaatacaaaaattagccgggtgtggtggcacatgcctgtagtcacagctacttgggaggctgaggcaggagaattgcttgaacccaggaggtggagattgcagtgagccgagatagtgccactgcactccagcctggtaacagagtgagacttcatctcaaaaaaaaaaaaaagtcattattattttatctgttgaattaattttcttatatattttggattttatccctttgtcgcatgtatagattgcaaatatttttctcccattctgcagctgttttcactttgttaatagttttcttcaaggtgcaaagttttttagtttgatgtaatcttattttgtctatgcttttgaggtcttattttaaaaatccttgctcaggtcagtgtcgagaataatttcccttttttcttgtaatttcatagttttcaagttttacattttaaatctttaatctatttttatttttgtatatggtgagagggaggggtttaatctcattcttctgcatgtgaatatctgattttcctagtaccatttgttgaagagactgtctttttcccagtgcatgttcttgacatcttaaaaattcagttggctgttgtaggtgcaaaaatttatttctgggctttccattttatttcatgggtctgtctggttttatgctagtaccatgctgtgttgatatagttttatcgtatatttcgaagtcaggtagtatgatacttccagttttgttctttttgctcagggttgctttggctatttggggttttttttgtggttctgcatgaattttcagattgtaacatttctgtaaagaatggtgttggtattctgatagcaattgcattaaatccatagatcactttgggtagtatggccattttaacaatataattatttcaatccatgaacatgtactatcttcccatttattgatgtgggaagataatttctttcatcaaagttttatacttttcagtgtagagattctttcacttccttggttgtttatttctaggtatctttttttttaaaaaagtactataaatggaattgttttcttgatttttcacatagtacaatattagtgtatagaaatgctactgatttttatatgttgattttgtgtcttgcaactttactgaattctaacagttcttttgtggagcattttgggttttctatctataagatcatatcttctgcaaacagggacagtttgacatgcttctttctaatttggatgctcgttacttctttctcttgcccagtttatctggctagaactttcagtagtatgttgaatagaaattgtgtaagtggccatcctttccttgttattgatcttagaattgatctcgttattggtcttttcccattcagtatgatgttagctgtggatttgtcatatgtggcctttgtgttgaagtacaaactttccatacctaatttgttgggtttttaatcatgaaattatgccacattttgtcaaaggcttttaatgcatctattaaaatgatcatacagtttttgtctttgttaatgtgtatcacatttactgctttgtgtatgttaaaccattcttgcatgcctctgatcccagtgatgaatcgcacttgaatgtagcaagttatctttctaatgtgctgttggatttggtttgctaatatcttgagaatttttgcacctatgttcatcagggatattgtactatagtttcctgtgttgtattgttatctgattttggaattagggtgatgcttgactcatgaaatgagtttggaagtattccctttgcttcagttttctgaaatattttgagaggaattgatattggtttgttaaatgtttggttgagttcagcagtgaagccattcgtttctgggcctttctttgatgaaagactttattactgattcaatttcctcacttattattggtctggtcagattttatgtcttcctaacttaatcttgataggttgtatgtgtcggggacttcgttttttctatgttatcaaatttgatgaaacttgttgaaaaccaactctaaattttgttcatcttttgaaattatttttagtctctatttcatttatttctcctctgagttgaattacttccttacttctaccaactttgggattagtttgttctgttcttttttttctttctttctttttttttgagatggagtttcgctcttgttgcccaggctggagtgcaatggtgtgatctcggctcaccgcaacctctgcctcctgggttcaagcaattctactgcctcagccttcctgagtagctgggattataggcatgtgccaccacacctagctaattttgtatttttagtagagacggggtttctccatgttggtcaggctggtctcgaactcccgacctcaggtgttctgcctgccgtggcctcccaaagtgctgggattacaggcatgagccacaatgcctggccgattagtttgttcttaattttgtagtgccttgaggttcatcattaggctgtttgtcagaaatctgttgtcttttttgatatgggcatttaatactataaacttacctcttaaaactgcttgtgctatgtttcgtaggttttgttatggtatattttcattctcacttgtctcaagaaaaattttaatttcctttttaatttcttcactgacccattggttgtttaggagcattttgtctccatgatttgtgaagttgtcagtttttctcattgttgatttctagtttatttcttttctttctccttccttctttccttccttccttccttccttccttccttccttccttccttccttccttcctccctccctccctccctccctccctccctcccttctgtattgctttgtctcccaggcccaagtgcagaggcacgatcttggcttactgcaatctctgcctcctgggctcaagcaatcctctcacctcagcctcccaagtagctgggactacaggtgtgtgtcactgtgcctacaggtgtgtgtcactgtgcctggttaaatttgttttttgtttttgtttgttttgttttgtatgtttagtagagatggctttcgccgttttgccatgttgcccaggctgttctcaaattgctgggctcaagcaacctgcccaccttggcttcccaaagtgctgggattacagccatgagccactgcacctggcctgatttctagtattataacgctgtggtcagtaaagatacttgatattatcttaatcttttaaaatttgttaagacttgttttgtggcctaacatgtgatctctcctcaagaatgttccatgtgcatttgagaagaatgtgtatctgcagctgttggacggaatgttctgtaagtgtctgctaggtgcatttggtctatggttcagcttaagtccaatatttcttgatctctctgtgtgtgtttgtgtatgtatgtctagataatttattcattattgaaagtgggctgttaaagtctcttactattattgtattggagtttatctctttaggttgaatatttgctgtatgtatctgggtacttaggtattaggtacatgtatgtttataattgttatatcctgttgttgaattgatccctttatcatattatgaccttctttgtctctttttacagtttttgacttaaagtctattttgtctgatatgagtattgctactcctgctcacttttggattctgattgcatggaatatctttttccatttcttcactttcagtctgtctttaacggtgaggtaagcctcttttaggcagcatgtagctgagttttttttccagtcctgcagctactttatatcttttcattagataatttatttacattcaaggtttttattgataagaacttatttctcccattttgttacttgttttctggttgtcttgtagattctcagttcttctttctctcttgtttacctctgtggtttggtcattttctgtggtcctaagctttgttttccttctatctcttgtttatgtatctgttgtaattgctttctttgtgggtaccatggggctaacataaaaagtcttgtagttataataaactattttaagctgatagcaagttaactttggtcacataaaaatactctagacttttttcctccgccatccctaatttatatttttgttgcctttatttctttagtatgtgttccctagccattgtagctgttgttgtttttgaccagttgtactttaaaccttcatctagaggatcgacaggtttacatagtaacatgatatcactggggaattctgagttggatttatacatttacctctattggtgaggtttatattctcacatgtgttcatgatagttatcattttttcatttacagctgtagcactcctgtaaacattgcttgtaaggctggtgtaggagtgaattccctcagcttttgtttgtctgggaaggcctttattctcctccaggatagttttgctggatatagtatcttttgtccttggccgagactcgtttttttttgttcttttagcatcttgaataaattatccctttctctcctggcatacatcagtaatttaatgttactgatgagaaatctactgatagtctaattaggattcccttacatgtaacttgatgcttttctcttgcagattttagaattctctgtcttcaacttttgacagtttgactataatgtgccacagagagaatctttttgggtttaatctaattgggaatctttgtggttccttcatctggatgtctatatctcccccaatatttgggaagtttttagctattatttcattaaataggttttctgtgcctttcttcaacttttctccatctgccagttctataatgcaaaaatttctttgcttagttttttttaaactttgggttatttcacaaaacctattttcagattttgaaattctttcttctgcttgatctggtctattcttgaagctctcgattgtgtcttttattcactgcattcttcagatttctgtgttttaaatgatagatcttgttttaatttctcattttataactttcctgatttcattgggttgtttgtattctcttgtagcctgctgaatttttttaagatcattatttttaattttgtttcaggcattttataaacacccttttctttggggtctgttactagagactcactgtgttcctttggcagtgtcgtgtgtccttgctttttcatgtttcttgtgacatctgcacatctagtggaatagtcacattttccagttgtatgcagtagctttcacagggagagacttttcctgtagatgggtcctagagtgttggttgggtatggtacattggctttggtttggggtggattcagtaccatggtctctgtgtagtttcgtcagctgtaatcttcacagcaatgtctgatttcctcagtggcctaggctgcaggagtttttgatggtggtatagttttgctagggacaggcatgtcatgctagttgtcaggctggacacttgcaggctcggagggctgacaagctgtcttttgggctccccagggaagagaaagtatgattttccagcttttcttctatgtttatttaaaactttgttgtctggctcacagtgttctttatctaaagtctagccagtggtggtggtcatattgcaatcattattacagcttcagactttctagaccttttccattttagtgaccttcagccttcattcgcttccattcatgaccacagaatagatgtagtcatctctattgaaggcaaacccatcccatctcttcagcttcatctagaaatttgtttcatctgttacactttctttctttggtttttagccttcattctctaccagctctttcacttaagcagagatatgttcaagactctcccattctaacagttccctgccttgatcctacaagcttttctctttagctgctaccttgctttttatttttatttttttctcacttgctctgataatctcctagaaaaattggcttactctgaccatctccattagttcacctcttaattattcttcaaccatctgagacctggctttgttctttctctactgaaactcttcaggcagagattagcagaagtcttctaattgctcaatgaagtggaaattttcagtccttattttctgtatttctccttcatttgactttgacttaactctcttggtttttgtaataccaccagcacctagtttatcagtctctcatgggaacttcattctatctgcctgccaaatggtggagtcccaaggactgtggtctgatctgctgttcctcattacatgctttctggtcagtattgcacactgtggttctcatctaccatcatctacctccagaagtgccatatatttagtaagtttacaagaaaagcaactttccttgctccgtagactaactctgatcttttgttccctatcatggttatggaactcactaattattcagcatcagctgtcagaatgtttaactttgctatttaggtttgtgtaagttatgggacaataactaggataactagaattagcttgtagcttatgtgggttagataatacaattgcatatgtaagtagtgaatattttggcttaataagtgaaggagtatttaggaagctatctggaatgttatctaagtcaggattctgaaggtaactctagcctcactgtcccttactcactatttctaaacacccaccaatcctgcctactttatttacttggtatttctccaatctgccatccttctctgtccgaccaatcactaccctagctcaggccttcaaagtctctcacttgacctactccttcacctcctttgaacctgtgcacaaatgttagcttcttagtaaggctttctctggtcacctgtataaaattcccatctgctacatacttcctggttccctgtattgccttatattcctcagtggcatttatctccttgtatactatataatttctgatctctgtcctttctattaccaccccacttcaagatggcaaggatttgtctgttatattagtgactgtcctaataggaaaaaaaatggcacatttatattagagtaacttgagaagaatttttaaaagtcagtatttataaagctgtagatatagagatagtgaagtactcttgggactagtaatcattgggcaggtgataccatttttaagcccaaaagggcatagtgaaagagcaggtgcctgaacctggattcagagagactatgtagaggaggccactaggcaggagctgtggcctttgcctcagcttggctgattacctcactaatcctcactaatcctaaattacccaagttccttcttttctggcccatttcacagtccaaagccaactttaagccagagggcaaggggagcacttgatgcagtccatgcagtatggcctcccagtgaacagggcaggtggaggatagaaactaaatctagatggaggagagggaagatattcagaatatgttttttctttactgtcagcaccttgaagagtgcctggcatatagataatatttattgaatgaatgaatttgttactggtttactggcctcatgaactttagttttgcctattctattataacttggtgactacattcctatatacttgataccaactcctcattaactacaaaggcagtattcccctctccccctttttaaacatcaaaactcttttttaaaaaaaattcttaaatgaatcgccagtatataacacataaaagtatgggtgccttgattggagtggtgggtaaatgatcctgagtctgtctgtttgggttccctctttgcctagcaggaatgtgactgtcttgtttaaagcccactgaagtagaaaacaggatgagagacacactcttcaacatggcataagatttccatgcttggctcctgcctatctctgcatcctcatttctcagtagtttcctcatattttaccatcctgtaattgaaagaattacaaaactagttctctacacaagctttcttgctgttccagctgctgggaattagcttcctttgtgcttttttttatttgaatgattcatgtttacattcattaaaattaatgaagattcattacagttgttttctctttaggcataattggatctcctatactgagacattgaatgcaactttgattgtttttttcccccattatatgttaagctccttgaggttcttttcaactttgcgttattccaggatttctatcgtaagagttaaggttcatccacttctctgatgtgaggttcatggcaggaaggttccatgttgctcagctgcagagtagaaaatactgagcagggcttaaatagattaggatgctgccattataatataaactgtgtttacgaaagagcatcatcaattcagaaaatatctttttcattgactacagtggtgcctgatgatctttctattacaatcttaaattatggtcattttaattatagaatcatacatgggtttatttatgttaaaataaggtaattatcaagctagctgtgacctatgagaaaaatcctgaagaaatgatgaagggatcaggtgactgtttttgaagtcaagtgtgaaaggtcagaccactctgggtcatgggaccctgccaaggcagagcaggtcaagtgctgtgcccagtggggccaacccccagtatggtgccagggactgggtgtgagaagtcaaaaattaagaatacacctcagaaaggggacatggacagatgccacagacttatttgcgtatttcatgatttagcccttagcttgtgctgatactggatcagatattttcagagttcagtattttcaaaagcatcgctgatcacctgttggcattgttttacatctcaaccaaggaaaaacttttgggacatctgtttaacaaggggtaagcttttatttgaaatgttcgattaaagcagaagagtcaggcatttttttgtgcctccccaaagaaagatttgtttactgtcctgtgtgaataaatataatgtcattatttcccgtaaaggaaaagctgatggggagagtaagtaatgggtaagattaggcaatgttaagctcatatattagtatgtttaagagtgatcaatttagggatctctgtgacagagatgccaaatgctcacagtgctatctcatgttggaaacatgtgtctcctccacttttcctcagtcctctgaaatgacggccctttagggattgacagatactatacagatttctgtgctgatatgtgatttgtctaaaacaaaagtttcacaaaacaattcttaccattgccatttaagagtcactctgatatgctctgtttccattgcaaacaaatgctcattatgatttgtgaaattaacttcacaatttcctaatggataacaccttgaagtatgaaaagcactacaggatcttttatagcttccctcctccagctctctataatctgctcccatctgtggtgtaggaaagatttcagcagtggccgctgaaggccctaagatcttgtctcaacagatagcaaggtgcataacagactttggacaggttgtttaacatgtctgagttactgtttattcactggcaaaatgaagggcttatattatattgtctctaagtactatcagttctgaccacctatgaactttcattttaaagaaaatacctatttctatggcctttaggcattagggaattttgtcaaattaaataaatctcagtaaggtttgatggtcaatggggcccactgtctggtgtgtgtggaggggtgttgtattttacatcaggaacttcagagccctcatgaatttctaattagaggaaccacctgggaaatataagtcaaagccctttgctcgccttactcagctttagggcacagtgactagaggtgggcaatcgctttggtgtaggtattgtcattggaaaggaagaaaccattttctggaggaaaagaattggttgaggctagctttaagcagctatttcatgatggacaaaaggactagctcatccattcttcattcgtttctctgtatcctctatcaaatttctgagtaaagattttatacaatgcttgattagcattcaaatagtatgtttcaaagattttaaaaaaaataaaactaggcctttgaatcataattatggcttataactctatttttcatatacttactatctcaagttacaaatttcatgttatgtttttttcaaaagagtattcctgccacaactcagagctcagctgaattagagcagtgactagaaaatctgagaaggctgagcttcaaaataaggtctggaaagtgtttcttattgttacaagagagtcaaaatgattttcttgagctttaagtttatgtaagtatttacttgacacttagcagtttaaaagataatgtgcaaaaatatgaaaatgagaaaaaacaatttcaaaacaagagttggtgattacgtgagacttagtagagcaaagtatattctaagtattaatctgtctaagctgtttgggaacagatgtacgtgaaatggataccgggtgttctgttgtgtacaccccaagtgagacatctgttggtagactgtgtggtcagaaataatggaagcaggggttaaaccccaatatgacctattactcatgtgaattattgaaggactaattactcagtaaaacatgatgctttgattcatcagtctacacgttaagaaaaaagcctctttagaaaaaaatttagttctgtttctaagctgtcaaatttgaggaaatttttaagatgtatgcaaagactcaaatttccatagtaactgcaaatactatctgcttataaagttttaaaatgttttgacaggtctactaatttatcataaaaatagcctcaaaagttttagctttttgttagggtaggttgggtctcacagaaaacaaatgtagagtgaattttctaaagcagggctgtccagttagacttcctgaaatgatgggagtgcactatatctgaagtgttcaatacagttaccaccagctacatgtggctattgaacagaaacatggctagtgtgactgagaaactgaatttttaattatatttaatttttattaatttgaattcaataactgcatgtagcaagtggcaactgcattgtacaacacagctctgacacatggagagttgaaaatgtttgtttactttcttcccaagttttcattttagtctttgtttctacatagaaaggaagatatagcttttgaaaaatgaacctgaatgtagaactgatatggttatgcaatttgagctgcctatttaaagataaagcaactgagtttagagatttcaaagtggcagagtcctttaacatatttcgtgggctggccacggtagctcatacctgtaatcctagtactttgggaggctgagatgggaggattgcttgagcccaggagttcgaggccagcctgggcaacatagcaagaccccatctcagggaaaaaaatatgtgtatatatatgtatatatatatatatatatatatatatatatatatatatatatgcatacacatatatacatatatacacacatatattaacatattttgtgtgtacaaaaaatatttttattatgtgtagattagttggttactagtaaagttgaagtcttgtctatagaaatcattgtatttttcatggtcattgtgatacattgtttgaactgaaatttggcaaattcaatctgtttcttactacaagaatagtacatagatttgaaatggtaactctcttagtctgtgtactctgaccctgtgaacgtctggagactaatgttattcctaaatatgctatgtccacatggcagcatctgaaggcaaacactttttaaaactgatctacttttgtggacccttcctctctctctttcctgcatcccggatggggccctctggggctggaactggcacagaactattcccctaggagtgggttcattgaagccaagggacacacaaattgagaatcagatagactggaccaaggtcattaaaccagagagggcaatccagatggggttgtccaaagtaggaagttctgaagtgaattgcagaaatccaaacatggcaaagctaaaggaatagagaaccagggcaatggatatagagaacagagcaattgggtatgcaggaagatgctattgcctagactggatgtttttgtaccctctgtaatttgagaaaatggaccgtccttgttgaaatggtcagggatgtagtagataaattcattgcagttgtgtaatctcagcactagaatactgatcataaccatatcacttgttatcccacctagcctgccacttgattgggttattagattacatttcagacattgacaagtctacaagcatcattaaaatcctaaacacagacttctgaccgtattcctacccaagttttagaagcactatgccaatgacgggggtagtatatgctgagcaggtgagttttgattgtgtgtgtctacatgtgtacgtgggtgtggtgagcaacaggaaggaactctcagccatgactctaaatgctcttgtgttggccaaaattggtataagctaggaggagaaacacaaaggagagagaggcatgaagttgaaggacattaaaccatttgcaaacttttggcatgcaaaccagaatatgaggaaacttagtgtaatgggtgactgaattcagaggtagacaggcaatcaggaaggtataggcaccaaaaatagttaccattggtgagcgtttttgtttttgtcattggcatggtgttatgaacttatgttaagcctaagggtaagtctaaaataatgtaccagctggcatcagggaattcccatgtacattcctagattttcattagaaacagtgttctggaaactaccactgctgctacacagcagtgcccagtgcttgactgaaaatagtgaacacttagatttgtttactctgccaggttctgtgctaagtatcttatcttgtttaaccttagcaaagaaactatgtagtctagatagaatttttatccctagggcccagaggtgttaaataacttgcccaaggtcataccagtaatttcagttgctggggttcaaagctaggcagtctgactccagagcctgcactgtccccatttggttatgttgcttccccagttaagcaagcaagagtctatctgacatctgagttggtggtagtaaagcatcatggtctgaaccaaaataataaaaacctttgaaacaacattatctgacttctttcaggcttttaagacagttccatcatcaacagcttattccatttctctggccacttccagtttctgaacaaatgaagaaaatgggagtgataaattggagtttttaacaagtttttttaaatctaattttttttatggaaaccaccaaacatacccaaatgtaggaataattatgtaataagtcctcatgttcaaccctaagaggggtgaagctctatgtgacccattactgagtttaaacagttttcaatttatggccagtcttatttcatctatactctacccacatcccttcttcccctggaatgattgaagtaattcctaggcatcatataatttcatctgtaagcatctcagcatgtatctctaggagataaagattttctaaaaaatcatattactactcttcaaatttaaaataatctttatagttttacatatccagttagtgtccagattttcctgatattttctctattttttaaatatgtcaaccttgaaatgaggtccatattatagctgatggctatgccttttaaattttctcatccacagattcttcttccttttttttcctttcaatttatgttttgaacaaactagtttggcctatagtttctcatgggcaagaataaccttcagactgggatggccatcactctgatacccgtaaaggggatgaggcaggttggggaagggagagcctcagaccatgatcagatgtcacaagatttttgcttacctagggtgaggacttgggaaaaagattgcccattaggagtcctgccttgggcaaaagtggccaaacttcagctgtgctgtcacaggctgtgggctgccttggaaatgtaggacctcaactcctctgaagttgaggtggagcttgagggtacgaatccctggtggccattataatgactacactcattgggatggcatggcaagttcatcctcaaagatggatcctagcatccaccatgaccaatgaggtttttttattgttatgatcactataaactcaaggatttaaacctattaaatgtttttcaattcacagcaatgattatttttactgatcttcaaattgtcacattttggatttttagaccaatgggagccccttcatcttgacttctgagttcttttgacattcactcagctgtctgatagcttccctgctttctggaatggcaagatattccaggttcatcttgaacatttcatgcttgagatatggaatcaagctcatcatcagagggtcctggttccttttactggatagtggtattagagacctcaatttgagaactaagcaacatcattgctaaaacttcccctatgtgtaccttgttacttaggtttttcaaagaacagagctagaaaatatgttgggtttttttgttttgtttttaaagaaaaaatgtatcataggattatgctgatacttccaattcaagtgcaggcctaagcttttcacattgtctcttttctcctacccttaaagtcctgattcctaactataacaacatcattactcatttgctttatcctgcattatgtagacacaatagagtaacaacaccaatgctgccaatcaaaagtataattactgaaacccacttaagatagtcctgcaatttttttttttgttcatagagtgtacactactagggaggtgtagtcaaattactatgttttaaagacacttggaataattcatatctgtgaagttatacccccaacttatttgttttttgtattattgtttcattttgcttttgatgtttaggcatttcttttttaaaaatcaattttataattacgtgaaatacttatatggttccaaaatcaaatctactaaacaaactatattctaggaagtatagcttttatgtttcccttctatgcttttccttccttcctgtaggtaggaaagcttatttgttcctcaaagctctgggttgttcttttattttatataaataaacatgtgcatatattcttttcattacccccacagtacccaccgtcttaaacacatgtacaatatatgtgtttttctaccttgatttctttcttacttagcaatatgcccagaagttcactctgtagcgctttacatcagcatcaaaatccattatgtactatcgtttattgacctctctgttggagaaatttggattgtttctagtcatttttgttatcgcaaatagtggtttaataaaaaactttactttccgttttttgtttttcaatgtgcttttaggatagatgcctagaagtgagattgttgagtcaaagaataaatgtgttaataattttgctcaatattaccaaattctttcaaaagggttgtgcaattttgctttttaaaatcattattgtataagggcatgtatttcctgaaaatttctccagaagagtttattgccaaactttaaaaaaacagcctgatacataataaatgatatctcagcatagtttaaatttgcatttttcttgttaaatcattcatgtttttactgtagtcctcctaacatttagggagcaccaattatggggtctctagaaggttccaggattctgtaatcaatttgacatgatttctgtcttcagatattcacaatcttcaggaagatatattgacaaaagaataactacatgatctattttgtgtgcaacttagtacttacagagcattataaatgcacatggaaaaataggtaaaggagaaaatcattctctgttgggcgggctgagggggaagtcaggaaaagctacagagaggttcgagggtaaactttaatgtgggccttgaagtatgatttggagttagcaagacagacaaaggagcaaggaaaccattctagaaaaagaaaattttgaaaaatctccagaaaaggatgctttggcctatttggaaaataacattgtcttatttatgggggagatgacagtgctttgtttttagtcagtagtttatacaggactttgaatagcatgcaaggaagttggcgtctcaacctgaaaattgaggaaggtgtgacaaaggctgggcattaggtgagatcaagtatttctgtttttttttttggtaaattaggtagcaggatagattataaatgggctccacactgaggagcccagtgtgatggctgatccagcagatcagggggcagtggctgcaaagctgggagaatggcaaggtaagcctggatgcaagggatattgtcaaagacaaaatttgggggatgtgaggcttaaaagggaaataaataatggtgatggtgagatttctagcttgggcagtgggatagatagtagacgctgcgcaaattcgtttttaaatcagcagaatgagaagcatcttatttgaaatatattctaccaaatcttagcatcaaatgtgctagtgactagcaaaatatgtaaacagaagggaagtagcttgaaaagtacacaaactggagaaattgctcctgaaggactgtaagttgaacccttttaagcctaagatctgtatttcctatgagccctaggctctttccttgtgtatcctgtttcttattagagtagaggctacttaaaaataatcatagtttaaagcgctctattttcagaaaacattattcattagatgttagtaaataatgtaatctttatacattcataatatttctgcattattggagtgtaaaaagtcagtgaaatagtcatttgtaaagatgtcagtttttatctgtggaaaatagctgttcataccattttaagcttaaaagttcttcatttacttcttaaaatatccatgttggtattattttgtctaatacaagtaattaatatttaccccaaattaagcttttaagtttactaaatgttacaaacataattcaaagcactgtttagtgtccatctgtgcaggaaaaataagatcaatacaattgagcagctgttagcatgtattggtttccttatattttaagtatgttttcatgttttgaaggtgtaaagggatgacagtatgttttgttgtggttttcatcatacagataaaaacttattacagttgaaatcttggtgaacataatacattttaaaatttccattcctcacccatttatctagatatttagacacagtaaaataaataacatggatacatttttgtcatgtgatttatgttttttaaaaagtagaaataaatttctctaaaagttatttttattttttaaatttagcatttttcatatttgaggaaaaaacaatatgtcttggtaccctagcttctgaactaataacacacctgtcattttacaggttattttaatgtttttcattgggatcaaacctactctggaaatatctcatgggtgagctttatttttatgaaatgttcttggcacttgaagacctttgtaggtacatgccagactcatcttacatccagttcttctgcatggaaaatatgtgcattgaaattctaagtgccttttcaaatttgaccttcttagagaataatatgagtcccaacaattaggaaaactatggaatgccttttggcctttacttttcaaagattttcagtcagtaatgtttaattagcattcattgtgtacattgtccttttttgtgtgatatggctagttccaaaggaatattctagaagatctcagccttctgctattgaaggtgataatacactactaagttatgtgttgctttacattaaaataatgttgcagcagttacttattgcttaactagcgggtataggacatcaggttgaaataactgattttgaagtgaagagttcttgtttatatcttaaactaaccaagtatgttcattaactttgagaataacaatgatctttttcattattcttgagtagactggataaatcagaaaacccatgttagaggtccctgtaaaaacttcagtcttatttggtaagtccctttataagagtttcaataaaatcaggtaaatttaaactctgaaaattctacgtactgtctatcatgttcaatttactgttaaccagtactatgcactggaaaaaatttttttcaccttaatgagaccactggtcattactgctgctactgatgctcttttgtctgcacatactgttgcaacataatgtgttgtgcatttgatacggatattatcatattgccataaggagctgctattattttagacaccaactgattccatgatagtgtcagatttctttaacatatgcttatgtttttgtacaaatgaccccaagaaacatctgctagttttgtggtggtatctactgtttcttttttagaatttgacctgtcagtcactttttaacgtgaatctacaatatttgagttgtattcctttctcgtttttatgctattgatattaacaaaattgagtcagttttatggcataattcagagagaaaccgaagctgtctatggatgttattttaaaaatacctttttcatgatgattgtgcctttaaatttttgtcattgattgacactttaaaattgaaaagtgcccttttaatggatcctttaggttccaaaatcttaagttgaaaatttctgtctattggtcctgaaagtactctctgaatttgataagtatgtagtagttgtggtgtatccttggtcagtttatatcctgtgctaattgctaatcttacttagtttctttgatgcgtgtgtgaagacaggcaaagaaaaaggaagtggaatttctacaaaactgtgaaatctttactttatggagactagagaaatttctaagtaaaagaagacactcattctattgtagttaggatcccttcttttacttgcttttcatgatcttgactgaaaagcaacaattgagatttccattgcccgacgctttctcttctgcttttctttttgtttctcttgcatttttaaagacagctatttattcaaaaacaatatgaacttttatttattggacttaaacctggaacatcaacaaaacaaagaacaaacaaaactacctttccaaatttattttattagaggatgctatcaatacaattttgtattatgttcacacttgataccaaacctaaacccaagaaagtgtgtcctgtgttacagcctatccctctgtttaagataataactagaacaatttacttttattttctactcatctgctttctgtgtatcagctgttgtcctccctcagcctcgaagcatgtcatcatttccatctccgtgctcattcagtcatccttgctgctcttagtcccctttttgtcccttgggtgacttatgtcattaggacaaccttctgtccccacttggctgaaactgagctgaggcccttgccagttgcattaggtgtggcacctttcatggctcagtttgggcctctgtgatatctgtgtgccttctactccaaactccattctgccagaggtggcagggtgactggaagctttagtttcagtgacaaaacccaagcgtggctatgctgagtgtctaagtagctttcatttaggcctgaaataggagagtcaggcgcctctgtgtcccctgagaaagagagatttccctcagctctctgggcccagcactcaaccatttaagtcagctggttagtataatttccctaaattgtggtttagtttccctatgagtaggactggagtaggaccaagtaaggaaagtccctagtgacctttctgcctcctgaggagcaggccatttactttgagttgtagcttcccatctgtctgtccccactaccctatccaaggccctggaggagccacaggatgagggaggagattcatggaaaagcgccttcaggtactgggtatgtctggagtaacatttaaagtttaaaagactctttaacaattttcctctgatacttactactgcctatacttgtttggttttagtacagtaagttttgcctatcgtgggggtgaagaaaatagaaatattcccattaactttgtatggtgcttggtatgacaccctgaacaggtgcacccgtaattgtttacttgatgttctttttaataagtcaattatatcatcggaaattgaagaatagcaaagttaatttgtttaatcattctatgggaactcttgcatgctcgttcactagaggaacattgcgtttctcccttaaaggacaaggctttgttttgtttttaataagacacactctttataattaaaacaaaatcccagtgttaagggatttctgttttaaataattggatttctttcctttgttcctctaatccctctatatgagaaaaaaatctaatggtgtcttaggataaatatttttagattaaaaagttctcttaaccactgaaatttaataatacttctcaaagtttatggatgatatagaatgtaatgtaaggttgagaattttagatttggcaaaggcaaagatacaaaaactagtgaaaaacaacaaactggaaacacttttaaaatactgatgtatttatctttgcaataaattattcagaaatataaataaactcactatttacatagttttatttaaatttgtcctcaaaatactaaatttagtactatatattttcttctttcagataaatgctttcctgaaaatggtattttaatatctacagatggtttagtttaacaatggttggggtaaaaatgacatagggaaaagcaaaatgtgacagcccagcttggttacctttagagaaactcagaataaactctattcccatttccttctctttcccctttccatactcgagagcccttttctgagactcttaagtcatgtttgggccttggagaggataaatagcagggtgggtggtaaaaggggagagtgctttgcttgaggcaaagttttcctccatatgggaccttcctcaagccctcccttcaaaccctttaaatgagagcatgagctcctaggacagaggtcatgtggaaagcagcattagcatgaaggggggtgctgtggaggggtgtaaggtgcaaaaagcagcattagcatgggggaaggtggggtggaggggtgtaaagggaatgagatgtgaagtggttaaagggccatttttctagttggcctctgggctttgatgaaccttttccagtgtgcctgtttctccacttagccctgggctaatcttgactcttaactttccaggtgtgtatctatgctgatttctcctgggtttggaagctctgagaagctctggttctagttcaatcacaagacttttaaagaaccagaaaaataaaacaattttttaaaaagtaatgaagaaaagacttttaaagaaccagtgaaaacctgggagtaaaaatatagaagacttgagaaatttcatctttacctttcaagtgggcagcatgagaaattcttgtaaatggtgctttcaaatcttacacaaggttctcagttacctttatttgtactccctagactgtattgcatcccttgctatgttgactaattcccacctaaaataattcaatggcctcccaatataatctggcattctaattaataagctaagaaattatttggtttttcactcattggcgttaaatattcttcagtgcccacatttggaaatattggaacacagaaatgaaaaaagatacaatcagtttctctgcttgccatgttttccttgatatggcaatacgacaacaggtcaccctttgaagaaaattcagagatgctaaagtagaaattaaaactgaagataagtcaaggcaggatagtataggagtctgctacagctgccatagcaaaatactacagcctgggaggcttgaacagaaatttatcttctcacagttcttgaggctagaagtccaaaatcaaggtgccattggggttggtttctgaagagggttctcttcctggctttcaggtggccaccttcatacagcatcctcacgtggccttttctttttgcctgcatggatagagatctctggtgtcttccttgtaagaacaccagtcctattggattaggaccctatgctatgacctcatttaacctaattaccctatttaaggccctgtctctaaatacagtcacactgggggttagggcttaaacatattttaggggaacacaagtcagtccataacacgtgatttgctatagttttcctttacctaaatcttttccaaccttgagagtggattttggccaggtgtggtggctcacacctgtaatcccagcactttgggaggccagggaaggtagattgcttaagcccagaagttcaagatcagcctgggaaacatggcaaaaccccgactctgggggggcagggggagtgggggaattagctgggcttggtggcgttcacctctagtcccacctactcaagagggtgaggctgaggctggaggattgctacagcccaggaggcagaggtcacagtgagcagagatcacaccacttcacttcagccctgggttacagagtgagaacttgtctcaaagaaaaaaaaaagtgggttttattcttccccttaaattcctattaatagtgaggtgaggcttcttgtgttttttttttttttttccaagacaatggttaatgtgtgattacttaaaaatgatatataacactaagaaataaagaattgttaagtgagaaggaacatattaaaatggcttggaaagatgggtaattttttacattttaagtaggttttctcaactctaactctgtggaacttggtcaatctaatcagtctaaatatagcacaaataataatagttatatggacaggagaaatagtagccctcaaagatagtgaaatacatctgaatatcactaacaatgtcatgaatttgcttgttctaaagttttctgaaagtatgaattcataactgagtttttttttttttgcctatgactactaatgtttgaggagagagtagtgtcagaaccacccccccatttattacatgtttatttcatattttggtactgaaatcagtgtttattttgtgtcttcctgataaatcttgccaataagtaattaccttccatactgaaaagttcttaggattaccaggttgctgggggcaaccttaaaaggccatgcagaacattgacttaggtggctattaccctgctttattcaggtctgagcatttactttcctactacaatcagaatactgacctacatttaaaagtgcaacactgccctgttatctaaatccactgtgttcctgagaggaaataccagaaaagagggcaccaatattatttttctgctgttcttgatcataagtgattacctttttttttggttaggcattctgcttctgaaagataactgaggttgaagttaatagaactaagattcttatataaaatcataggaaagataattttcaggattattgaatcatattgaaaaatgatataattgtgttaaaagataaggactaaaatgagttaattcaatttggaaatagttaaattagaatttgcttctgtttttgatgaatactgctttttgaaaaatcttctgagtatttaagcttttactactctagtcattctctctaaagtagacatagaagcgtgttcttatcttgatttggtaaggctctgaaaatgcaaagcaacagatgttgtacccagcataattatatgtatcctggaaacacatctttattgagtgggatttgttcttggggaaacaaaaatttggcaaacaaaggacattaacttgctgatctcagcagtaattacttgggttagattataataatcttgtgtaggtggtaactgcatgcatatattacaaaatctaattctaaaatacgtacattaaaaggaaaatgaacttgcgcaaactttagatcatgtatccccttgaagagcagaaaagatctcaatttcattatttgaaagttgtttgaacagctttttggaagaggtttccaggattccaaatcctaatatgtgtattgatactgaggctttggactaatctttgggggttactgccttttttatgcccactgaaaatagagcatttcaaacaaatgaactgatctctgatctttaagcatgccagtaactctttggaacaaatccatagttatttttaccaatgactgtattaaaacagtactttctgtattatctcttccattccaaggccattttaaaacaccctctttctcttctcccaataggtaaagtacgacagagctccttaggactgggttatggagaattatctggaggtcaatttgagaaccactgtgcaaaccatttcttaaataagtagctacaaggttgtccttacaaaaatttctgaagttgatggtgttgcgttttggagtctgaagcttaaataagagtttgtcagtggtcatggtctaaatagctgattactaccaaggtcatctaatttttttttaacacaaaaaaatgttctgagcacaaatgaaaccttcaggacaagacatttatgttttgagaatgttcttaaatgattcctgtcgtgtatcttattttacatatcttaatgatcagcatgtattttttgttgttgatgatgattttataaatgtgctatcacctagtttctaattcctaacagctccttcatcagtagaatattgctgtagcacagttttgccatctgttaagaaaagatggtgactaataagagtggcacatttcagggctggtgtgctatcgcaacatctagtgttttagtactgaggacagtgatgtatgcagtgttccttacagccatggggtgtgggaatgttttcctcttcggcaaagtctgtgtatttctatagctgaactctcaggatccagaggaaaaccacaagatgatgaaaccagatgattgtcatcaaatttctattccccactacatgattattagttttcgtcaaaagaaatactcatcctatcctgggttggaattggtaaagaattttgcattgtgactaggacacctaaaagtttttaggatgagtacaaatggaatttgatagatttccccaaaatgtttgggaaaagatttattcctccctaggaacagcaagagtagcagcatcacatgaggcaactcctggtaattttttcttcttgctcttatttcaatgatatcttttcattcttttctgtatctctcaatttctatgtttctcctcttaatgtatcctgtaaatttcttagtagaacctttttactaatgagggtttcctagtttgctttaggaggcactcaggatgcccccttttgtaaggcagtaaattgaaaataagaacttggtgaaggtccacgtgacggttagtttccattctccattgtaccaaactgctacagggaaagaaccatatttaatcaacctcaaatcctcaatatttaggtcagaaaacacttggcatagaagagacactcaaattttgcagctaaatagattattgatagaaaatatgtttcttgcctctacaagcaatatgaaaccaatacaatctctaaatatcttcagactactaggggcaaatactgtattataagaataattcttcagaaaggaaaatccagctactctcatatcacctctctatgttgaaagctagggaagataaactggcttccagccagtgagagtccatgtggacctagtgctggctggagatccctaatccaaaggcaagagccagatactggttgtctgctgaaaatcagaagatgacctctctggtagtaaggccagtgactcatccctgcatcttttatcctcttctgatttgtataaggatctctcctttttccccagtacccactctcaagaattgctttcctttttaacatgatcataccaaaatgtatctaacagtaccttgatttcctttctgaggaatttagggagcatatttactttgtcagactcattagaggtttggcttcttggtcgggttcttaaatggacaacttgtttgggtgatttggcagagaataggagaagccagtcccctctgatagagcaaacctggggagctgtggttgacccacctgctaactgtcctgtacaattaggcatgtggcatcagtgggtgactgaccagagccaccatctcaatggcggctgttctttccttcctgtgccttctcagatctcttttttgttcttgttactccactatattggtttttcttgagtttttttcaagcaaatatcattattcacttctactgcagttcctctgttgttcgctttttctcttagtcttcattgttttccattttgaacattcagagatccatcaaaaaaagtaaaataacaggaagggagaggtaaacaccagtcaaatgaagtattataatagtgtattactatactctttaaagtaattgaagggtggttttttggggtcagaatatctgttagaatttggaatttgccactcttgagactggggcaagctatttaaactctaagcttatctgtccttcctcacaatctgtaaaatgggatcataataatggcacccagtttatggtgtagtgagcattcactgacacaattaatctaaacttatttgcactacatagaacagaatttttgtctattaaacaatatagcgttttaggcatgaaagaaactttagattaaattaaatatcatttttcttaccacagggtaagtttctgttttgtttgcccctgtttctctaactcctagaatagtttccagcacatagagattaaacaaatattcgttgaatgaatgaatgcatctattctaatcctcttgttttaggaatgacccgtcaggctcaaaagtgaaagcatttccctcaagattggtgacagagttggggactaaatctaaggctttctcttcctacaccagtgtcctttctgagaacacgatgccattttctcaatatttgtttatttatatggtaaattggtaggaagctgtgtggtactataagaggataaactttgataatgaggtatacttgctatcaaattctaacattctcatttaaaacatggcataccatttgtcttctacattttcatatgtaaagtgaggtgatttctaccttatagaactattgtgaggattaactgaactaatctttgtagagcacctggtcccatttattttttttttttgctcaccccaccccccaactttctagctagataacttatacattcactctgtttttcattccttcttgaatctcctgtggccagacttgacccctgtcactctacagcttactcgtcaaggtcagtcctcatctgacttgacctactaagagtctgacaagtagtcacactatgctccttgatacagctttcttcacctaccttcttggatgtcattcttttggttctcctcctaccccattgggctgctttttcccagtctccattcttgggtattctcattttcccatgtctgtcctctgacttcttattgtctctgtttctgttttctctggttggaccttctctagtttctggcttcaaatactatctaaatgctcatgtctttcaaatttgtaactctagtctagacctctcctctgaattccagttttataaatcttctacttaaatattagaggtctaataaacttctcaaacttatgttctacaacaaactccacattttctcctgcagcctctaaatatgtacctcctatagattttcccatttcagtaagtgggaacttcattattctgattgtccaaaccaaaaacacttggagacttgctacattccaccctttgtctttcattctacatccaacctatcaacaaatcctgttgcctcttccttggaaatatatccacgcttgagcagcatcattgtcaccacttggtgttatacactctcatttctcacctggagtattgtatttctcatctggagtagtgtctgtccaacgatgtcccccatcagtctgttctccatgtagcaatttcgtttttgtttgttttaagattgggtcttactttcgccttggctggaatgcactggtgatcatagctcgctgtagcctttaattcctgggctcaagtgatcctcctgccttagcttctccagtagctaggactacaggcacacaaccacacttgactaatttttttttttttttaacttttactagagatggggtctccctttgctgcccagtctagtcttgaactcctggcctgaagtaatccttctgtgccagcctcccaaagtgttgggattataggcatgagccaccatgtctggcccagatgttaattttaaagtgtacattagagcacatcgttcttctgcatgttcagcataaaatccaatgtccttaatgtagtctatattaccctacatgggctacttgtgcctgatccctctactcttatgtcttatccctctcctgctttctcactagcaccagccacatcttaccgttccttgaacacaccaagtatgcatttgccacaggaccttgatgcttactgttccctttgcccagaaacccttggaaccagctatgtgttaaaattcagatatttactgattttagagagctaaaatggggtatatataatatattacataacactcacagctggtttgtggtagcatttcataattaaataatatttctgaatgaaacattaagaatgcccatgctaagagggatgagtaaagactcaactctcattgtcagttcagctgcagaatgaggtcagctcaagatttgctgccaaatgacttaagaaaaaaatgtttttggagctttggggatttcagaattgcagatgagagattctagacccgtacctacacagcatgctcccttattttgttccaatctttgttcaacgattatttattgggtagtcaaggaagatctctgtctaaaaggcttctctgtgtggaacaagactggcatgtggaaggtttccaattaacgatattgaaagagtgaagctcaaatcatttttcactcaaatacatactatttagaagacagtggccagtttaagaataatcattattggaaacaaagtactatttgattagggatagttaacacaaacacttattagtattagggatatgtgaaatacttaatggatgagtcatgtgctgacataaaacccattatccattttagttcctggtagcctaactggttgaactctgttttattgatctattattgatttggcctgtaacttcaagttacattttaatgtaatttcatccttttctgatcaccttgtgtcttcaagcatttttaagcagttgatagatagttgaaagatattatcactatttcaatctaaaagatattatcactattttaatctacttaaaatttttactacattcattttaagtatgacttatggaacgaatcgaaaatacaagatagtgaaaaacttgtgaggatcacctgaaattttagcattcactttccttacatagaggaacttagtctctctaaagaattatgagtaataaagtatcataatgatatttgtcttagttttggttaagtgtactccacaggagaaagttaggcatgagcaggaattattgtagtcccacattctcaaacagttctccagtaagaaagattttatgtgtttccagaaatcattttcctcctcttcagagctttgggaccataattgtatttaaattgctaatctgttttaaggaatcataataaattgtttaacatttatattcaatcaactttgtaatttgtataaatttttcagggtgacatttgaacaatttttaagaaaatgggaaatacagaagtattcttagttttaatatattttaaaaagatgacatgtgatctactgactgaaatccttcaatcatttttgtttttctccccaagattagatagaatggatgtgattttatttttaatttgcattatggagagtacttttggggggttttatgaaaaagacttcatttattttgttagtggtacttcagttgcataagaaaatgttcttttaaatatagtggtcatttgtgtgcagccttcaagttagcaaacatgcctttgagtagtcactatttttgaaggtctttatatctgattgcaatggcttatattcaatagtcctcctactaaatgaaataaaaatggatgcctcttctgccacagaggcacaggtggacatgttggtagcaagccccatgcggtgtgacacatggcacagcccaacatgggggcaaagagcatgcggcttgagctaggagtcactttatggctactttagtgtagatttgtgtttttctgtggaacagccattattgaagacatttatatagtatgatgtttgtttttcattaaatgctgattgtgatttcttaaaaatagttaagacttgattagcagaacctatttagaagccagagttcccctgcttcacctcttgctatctatataaatgatatttttgactctgtcctttataatgttggcaccctgtgcatattagatgtaatcagggctgaaaggaaacttgaatccatctggaagcaataaacttttctaaaagactgcacagtgttatttaatcctgtgacttcttactgtgagtgaaattaaggtttgatgcagttgtgtcacatcgtattgatatcaaatttatctttctaaaaaaaaactgacagtattacagcacagaggagaagatggcttgctgtaatcctgtaagctattttacattgattacatgctacataatgtacctaagtatataaaatacttgatctagaatgtttatgttttctccaaaattttctcatcaggtaatactttctcaacttcacctttagttttggcttcttatcatagtactaactatgcggtagtaattgtgttatgatgaaaggcatggagaagaaattataattttaaaactattataaagtggagacacacttgtataattaccatctatgtagactgccaaggtataaacatttagcttattttagtatcagactctttgaatcaatttaaggctttttcaataaaattggcttcctctaatttctactccaaaatggttaaaattttgttttacttcaaatacgttgtagggtatcatatttcatgtgactaggagcctaaactatatcagctgactggcataatttgtgaattatatgtgtgtttattaaaatttaaagtttttattaagacttacaattttattaagacttaatttttttccttacattttgagtaagtccaactgaaaataacttagagacttaggaaatttgactacattttataagtaatttccttgtaatttttctttcttgtggaaacaattcttactgatttacttaactcttttttcaatggcaaaaatgaaaaccaaatatatttgtcaactatattcttttaattgtggaaatgaaaggttcatatcccccatttgcctagcatattaaaaataaacatgacctttgtcttgaatgttgttaacttggattttaaaaatcaaaccaattataagctatattaaaattgcttatcaccttccctttgtcttcagtaagtctgggcctaaaaatactcatcatatgaataaataaagttttacaaatactttttagaacatcttgaattatatgtgtgtttgaagcttacttttggatgttcggtcaacaaggcttctgacagtttctttttatcttccctctattccctgccactgtgcaccccaaagtgatccctgaccacagtggtcccattgctggcatcaggaaggtagactgaggagttcaggtatcctagaggctgttaggtgaatctcttctacctctttcctggtcctaggaccactggacacttcaagtaaaaataacaattactttaatctctcaggtaaagtttcttctcccttccagcaacacagatctgcctgtgccgagttcaaatactctgaactttcaacagttgttctgaatacttttttgtcatcttatgatcaaatattgagagcattgaggggataactgaatgggcatggtataaaagtcagacttttagtgtttctaagtagcagaaccctttggacaatttagagggctgtgcgatatcctcaccgtgactgctgggaagtaatgggatctgacctgcagaggtactaccttggctgacaataatgacaaaagtgagagcaaagtacatatgactatccttgaggtcctcaggaaaaaaagagtattagtgagttgaactgtatgtaagggtctttaccaataaggaagcccatgcccagacataatccttacaccctggcaatagaaaccatcattgtggtttacatctcatcctgttcctacagtccagcaagttcaggccacaaaaggtttaagcactttttcctttgttctcatagcaacagttgcccatggaggttcagttacactaatattaacattttaatatacacaaagaagtgcctcgaatgtagtaggtattcaaacttgttaaatgaaagaagtaaactttcagacttaccttgaactactacagttttattctttctctaacctctcccactactaccatcttaaaaccaccatttaattagtattttataacaagttattaaaggctttcaaagacctttgaaccttcaccctctggtaagttaataacttctgatatgcgattaaatgtcaactgagtagtagtgggccctaagagctcagagggactgagaaatgaaggttattgtttagaagagtggctcaatgtgcttcgacagttggttaatatttgaaaagactagagtcaagaaagccttccatgtgctaggaaatgaaggagcaaaggtccagaggtggaaatgtatacagtgtgattaagggattttctgattgatagtaaatacagtcaataaaaaacttttattggaagcctagcctgtgtttgaagcattaagctaggtgctgggatacagagattagagatgaagataatgatgaagatattgttgaagtgaattgctgagaagctggagaaagggccaattaccataatctgaggctcaggaggaattggtgcaaagatcatctggtatgatatatatgaactgtatatacaaactgatctgtgtagctgaactgataatgccaaaaaaaaaaagactaggtttttgattaagatgaatccattaaggtcatgttttctgttggtgccattcttggagacctcccccaaccctatacatttataaatgtttttcctgagggactgagatggaagtggacatataaaaggaaaggtctgggcaaatacataagtaggtagtaaaatcaaggaacaaatgatctcaacaaaattgcccttcttgaaatgaatgaaaatgatgaaagccaatcacattgcatgatgaacttggggtatagaatatgaaatatttaaaattgctttatttcatgatgtttcagatgtagtaggaacttgttgcatagatggtgtaaaaacaatctagtaataaaatcttaggtatttaatacaaggtgaagaaagatgcaatgcataaatcatgccattttaggcttaattttcataaggctatgcctgtctttataagactatataccaggagttctcaagctttttggtcttggaacccttttatactcttaaatcgttgaaaaccacaaagaccatttatttaagttataaccattgatatttgttgtattagaaattaaatagacattaaaaatatttactatttaaaaataaccaaaaagatgggcatggtggcccacacctgtaatctcaacactatgcgaggccgaggcgggtggatcacttgaggtcaggagttcgagaccagccaacatggtgaaaccctgtctctactaaaatacaaaaattagccaggtgtggtggtgggcgcctgtaatcccagctactcaggaggctgaggcacgagaatcacttgaacccagggagatggaggttgccgtgagccgagattgcgccactggactctagcctgggcaacagagtgagactctgtctcaaaaaaataaaaaaaataaaaataaaaataacagtaagttcattgcatattaacataaataacatatttgtattaaaaataactattttccaaaacaatcaaaaaagcagtaccactcttctattttaaattttttcaaatctcccttttctaaaaaaaaaaaaaaaatattgtgtaagtttaaggggtacaagtgcaattttgttgcacggatatattgcttagtggtgaagtctgagaatttagtgtatcttcacccaaataacatacgttgcacccattaaataatttttcaacacccacccccttctcactctcttgagtctcctttgtctatcattccacactctgttcctatgtacacattatttagtacccacttaaagtgagaacatgtggtatttgactttctgagttttttcaactctggcttaatagaagacagctgaaatctcagaatgcttcttcatccagtctgttgtgaatatgttgctttgattcaagtatctaaggaaaatacagttttacacagatgtgcagctgaaaaggaaacatcttttaatatgttcagataattgtggatattgtcctttgatactatagcaaaacttatcaagtgctaatttcttaaaggctggttataatttgaaatctgaaaacatatctatttaattgtagtttgctatttgaaaatttattggtctgtcttgtactttgaatggatattttgcccacgtatgattttataacatcctgtattggccttttggaaaatttggtttactattatacagtttctaaatgttgataatttttattataatatattttaaaaagtctaatgtcactgccagtctcatcagaaaattctttgagattagaaagctgttaagatcatcatcacacttacaagttttacaaaattttaattttactcaaaactttatattttatcattgacaaagctctcagttgctttgcttagtgactgactcactttgttcattttccagaaagtgtttaccaaatgctgctgcctcaataccagagtctgtattgtcagttgatctttcaagtaaaaagtggtgttctatgaaaaacagctagttcagctgcgactgaaatgatataagtgtttctcctggagcaaaccaccacttcgatttgtagcagaaatgctgtatgtatactttccattgttattactcataacatttttaaaaatatactcaagggtggagatttttttaaaaataagtgttattgcttcatcaagaacagttaaatgaaactggattttttaaactgagtttgagttaatgaagaatgcagcaattattagtaaaatttggtgctccaccttgattcatactgacactccaggagttttacccactatttcttttgtacctttagtgcaaatgttaatatggtaggaatggtaaatgacatctttagtattattataaaaatcgtttttaccctgtatactctttgagactacacattgagaattgctgatgaaggtgttttaatttatcataagcactgaaaagatttacttaattcaccaatttctcctgaatatttgtttatataaaacaagactatgtgtatacacctacctttttattaatggtagagatctaggaaaattaatttctaagaactagccaggatatttggaatgtgaataaatcatatatccagaaaaaagctttagaagattgtctatgattgaaagtcaaacagctctcatttctattatactgttctttttcaaagaatttaccaattttatgtggtatttatgattaaacatacaccatgtaatttaacatttttaatgtcacttttacatcataggtattaaagattagcatttttattgtctgtattttaaagctcaaagaataacatttaggctgggtgcggtggctcacacctgtaatcccaacactttgggaggccgaggcaggcggatcacgaggtcaggagattgagaccgtcctggctaacacagtgaaacaccgtctctactaaaaatacaaaaattagccgggcatggtggcgagcgcctgtggtcctagctacttgggaggctgaagcaagagaatggtgtgaacctgggaggcggagcttgcagtgagccaagatcgcaccactgcacttcagcctgggtgacagagtgagactctgtcttaaaaaaaaaaaaaaaaaaaaaaaaatttagatttttgactgtttcattgattcatcttagacttcacatgaaaatatctgtatatcctcaaatgcttacattcttaagaagtatctcagccatttacacatgatagaaacaactaaatggaaaaaaattgcagttggaaattcactattttttatttgatccgataacaatgtgacatttgcgattggactgtaattttctgtctttctctctgaaaataagttcaaaaatttccctctaattcttttactagataagaagcctacttcgttgtaactcttgatatatgtatgtatttaggaacttaagcttttctgctaataaatgttatgtcataattcttgaggatagtattatattgtgatgggttttcagtaaactacaggagcagccctatttgtttaaaccctagtttaacctgattattaacaattaaattgtgttttcttctaacaattaaagtgtgtttaaatttattggtcccttgcttcacagatttatctcagtatgtggtgtattcaaacagaattttgtatttttaattaggggattagataaccaattctgaagagccaaaaaaattgttagacatcacattgcttaaccatctaatataccataagtgtgtgtatacactatgttgtgggagccatctatcaggcaggcctgtttttcaggcagtattttaaaaagtggacatgtgcagaaactgtgagcacaattagcgccaagcagataaatccagctctaatcctgtttacggtctacatcagacagatgtgccaagattgatttagacaagcccgaggcttacagtaatatttttaaaagtgccattcgctgttctatttttgttaaacctttgctaaatattcttaagtcttgttggttttgctcttcttattaaccaccgtaagtaacctactttaagcaggtcccgctttgctctcatggtgacaaggtaacctgccaggagaggttatctttattccctgtaattaagttgacttttccccccaaaaaaatacaacaataggaagtgggtgctgaattaaataaatagcatgatacccagtagatgtatacttaagttccttgcaagaacagatggtccccagtatctctgtaagtaatgtgagaggacagttaatgttctgaaacaactagctataaccagtatgatactaatgaaccagtagatttcaaataataaaccacatgccgccaagcaaaattatatgtcattcataaggatttaattatcataacttgcaaaaaagtgtcaatagatgatttctatatttttatctactgatatcaaatatcaatttatgaatagagtttcacttcatattttttaccaataaaggtatgttttaacattaaggtagaattaaagttatatttaaaatacatgccccaaagtatgtggtgatttttttttaactcctcttttactatactgtctgtatgtattgggctgtatatggaaatgtagcttttacatacaattaggaaaacaattgcttttatttctagcagaaacttgtactataacagaagtggctagcatgggaatcagagtagttatcttgtagatgacaactgaagcagacataaaagatgtaatattttttcagcactcaaaaatttataagtaaaattttataaacaaaaagcagtatttttgtgattcatatggaaaataaaatgagtctgagtcattcttaaggtgataccgtaaaggtgtatagataagaagtccatttttaaatatacccaagacaacagttttttctctcagtatggtttgttttcccttttttctctttaattatgtttcccataagtatttgtatattctaagaatgtccaaaaaataaatgttttgcagtgggggttgaaaagaaagaaagacctttttagatttcagctgatcttatcagatgatctctagaaccttgaaccttcaaccttcactgaagttagctggagggcttttcacctggaaacctgagaaacctcagaagccttctgctttagctctctctcaagtctaggaagccagtggcctgcgaccccacagagccagctggtccactcctcatataagaacttcggtaacaatacaaagacatagcaaagcaccatctaatctgataactcattaaacaatatttagatggctcaagactttaaataaaaacattttaagcttgtttatagaatactaacaagttttattcccaaagactatattcagagtgagaaaacaattttccttaaaactaatattatatacatgttcatatatgttaggaactagttatatgcaaaatcaagtgactcttgtgattagaactggtcacatttattcatgtagcataaatggttaatattgccaaaatgagtaatagatcagattttctatgtgagatattgacacctgagagatttacagtgtttcactgttgtgaaaaatggagtgctgaagaacatttgtctattgttatacatttgtaaaagaattcacaaattactaatttcaaataagaactaaatatttcttctaagcctatagtttttctttttaatttcttctaagcctacagtttttctttttaatttcttcttgtaacattggcaaaaagaccattcgtgtgaaaacctcagattttgatctgtacacaaatgcaggagtagagattggaagcttgagctggaaaagcaggaaatactgctcagagccttacaaggattttcagaattttcactgttgggtcctcctggttgctgcagtctaacctcgcatctccttgaaggcagccccagtttctgatgaaatactcttcagttaatttatacatatgctgtcttgctgttttcctaaggactgcaggcagaactgtggttcacctactgttttaaatttggctagatttaaaaacagatgatctcacttatatgtggaatccaaaaaagtcaaacttatagaagcagagagtacaattgcggttgtcaagagctgggggaggggaagcaaggggatgatggttaaaggtataaaatttcagttagacagaatgaataagttctggatctattgtatagcattgtgactatggctaataatgtatacttgaaaattgctaatacctgaaaatcactaagagactacgtcttaaatgttcttacaacacaccaaaaaaaggtgtgaggtaatgaatatgttacttagcttgattttaatcatttcacattgtaaacgtgtatggtactgatcttgtacctcatttcattttccatatgaatcagaaaaatactgctttttctttataatatcttatacagcatagatacaatttttagtggtcaattatattgtaatatatacataaatatatatgattttcattggtcaattatactgtaataaaacagcaaaaaataaagttgtaattaaaaaataatttggaagaaaaaattagcaagtggttggagattgaggaagatgggaccaataagtcctccaaggagagtcatacattagttttttttaaaagtccattattaatcttataatatttaatatgtttaatttcttgacacttattaatccaattaagtatgagaacactgtggataaatctaaaaaccttaaagttgagtaaaataaaccagatacaaagaagcacatactttatggttacatttatatgaagttctagaaaaggcaaaacttagctatagtaaaaaaatcatggtcctgagggaataactagagagtggtatgagggagctttctataatagtgggaaaattctgtatctttattgggatagtggttatgtgagtgcatatacttaaaaaaactcatggaattatgcccttacaaatctgtaatttttgttggtaatttataccttaataaaaaacaaaacagatgacagggttagtgattgtttccttgaagaaggtctttacatgggtctgttgttaacgagttgtagtaaaaatcatccaaaatgcttggattcaaatcttagatctgttcctaccagatgtgtgaccacagacaagttacttacattccgtcttcagtttcttctcttttaggaaaaagcatctagtttttgttgtagagattaaattagataatacaaatgaagtacagagaacagcgtttggtgtgtaacacatgttcattattagctacccttattttttagagaatggaaatttttaaatttaaactaatcaaactattttaggataagcaagtgaaacaatctttttttcaatcgatcacagaaatattttcactgaagacaaattagacatttatataagcaaactacagtgtcattaccattcaaattttcatatgcatattcatgcttacatgcatatgaaagcattacacatatgtattctataaatatatacaaaacagtaatggaaatgtgctgtactattttgaacatctttctagtcagcccggcattttatttacttttgagacagggtctcactctgttgcccaggcttgagtgcagtagtgtgatctcagctcactggaggctggaggtcctgggctaaaggaatcctcctacctcagcctcctgagtagctgggaccacaggaaagcaccaccatgcccagcttatttggtttattttgtttgtttgtttattttttatttttttgtagagatgaggtctcactatgttgcccaggctggtctcaaactcctgggctcaagttatcctcctgcctcagcctcccaaaacactgcaatcacaggcattagccactacactgacctctacattttaatagctgagtagccttctgttatatgaatatacttttttttaacaaaaccaatactccattattgtacatttaggttgtttccaagtttcactcaaataatgcttgggtaagtaagtatttttatttattattattatttttttgagatggagtttcactctgttgcccaggctgaagtgcaatggtgtgatcttggctcactgcaacctccgcctcctgggttcaagcgattctcctgcctccacctcctgagtagctggggttacaggtgcacaccatcatgcctggctcatttttgtatttttagtagagatgggatttcagcatgttggtcaggctggtctcaaactcctgaccctgtgatccgcccacctcagcctcccaaagtgctgggattacaggccgtgagccaccacgtctggcctggataagtattattttagctaaattgtgcatatttattcccttagagtaaattcctggaagtaaattgctggatcaaaaccaggtatattttaaagaattttccttttctacattaaaaataattataattctgattacaagaaaggaaaattatggagcttcataagaaaaaattagtctcatatttcatacctcatattgcatatttaataggtaaccagtgttaaatttgttgtgtgttttccactgggatttctttttatctcctttaataaaagcaggatcagatccctcagattactttgtaacttgcttttattctactttttcatacctcttagcatgaatgtctttccagaccagaatacagagatttcacttactcatttatgagctgcagaagatgactatgatttattcaaccattctcctattgaagagcatgaatattgcttcagatacttttgttattataaatattagtgcaattaacattttaaagtcttttgatacatattcccaacttgttctccagcaattaccatttttgcattcccaccagcactggggctacttccctttagttgcaccatcatttagcattatttttgatcttgtgccaatctaaaaggcaaaaagtggtatcttgttgttttaatttgcatttctttgattactaattagattgaactttttcatttgttcattggtcaatttgcatttcttcttttgtgaaatgcctgcttgggtcttttatgtactttaccattaaagtgtttttcttgattaaatagattatgtaactgtcatatgttgcaaatatttctgtccatttggcctttgcttatgactttttatgagtctttaggacttttgaggtctttattaggtattcaataattttaatgttaaatatattgatgtctgtcttcctttgtgtcttacggcttttctatttaaggttacgtaaatttctaatatacaaatattggtgtatattatgaaatagggccctatttttctttacaaaagattagtcagttctaaatcatcctttgctatttctagcggcgcttagatgccaccattatcacatcagtgaatttttaaatgtgtaattgtttcctgatctattcatttctctattcctagatacttctattgtaatagctttaccaaatatatctgatagggtgtgtactccccctcattacttcatttatttatttatttatttagagacagagtttcagtcacccaggctggagtgcagtggcatgaacttggctcactgcaacctccgcctcctgggttcaagggattctcctgcctcaacctcttgagtagctgggattacaggtgtgtgccactacacctggcaaatttttttttttttttttttttttagtagagacagggtttcaccatggtggccaggctggtctcgaacttctgatctcaggtgatctgcccttctcggcctcccaaagtgctgggattacaggtgtgagccactgtgcctggccccctcattgcttttaaaacattttcttactgtaatatatttattccaagagaattttcaaatattttatgagattccttgtccattccttacatcaaaaaataccacggagattttgattgaagttctattataagtagttacttggggtggggggaggggggagggatagcattgggagatatacctaatgctagatgacgagttagtgggtgcagcacaccagcgtggcacatgtatacatatgtaactcagctgcacaatgtgcacatgtaccctgaaacttaaagtataataataaaagaaaataaagagaatactggcatggaaaatatgtaatcttggaacttgttgtatctccacttattcaatcctttgtctctcagtagattttgaatggctctttatcccacacgagtctagaatcattttgctaagtttattcctagatataatatgctaattgatatgggaattttttttatctccattataccttcttcttgggtgtagacatatttgtagccagcttcctcactgcatattttttattaggcctaatggcattaagtttattattttggattttacaaaaaaaattatgataacatctttaaatagttagtttcaactcctcctttccccttaaatccatcaattactgtcttttatttcactttccttatgtactgactagaatgcctagaataattgaatgctatgagtaataataggtattcttgccctgtttttggaaatccttctggatttcagtaagtgtgatgttggcttttggtttagtatctttaaatttgcaatttacaagatattttacattggaatagtcattgagttgttaagtaaagcacaaacatgttaaattcagactgaagtacaggacttcaatgaaaagttaaaagagtttatttcatcactttcattttttctttccctcagtggctgtttgtcccctccccccaccccgctccatcccccagcttccttcctttgtgctcttattgttctaggtttgactacataaaaagagactctcaatttatatgtgatacaagaccataactaatattataaaattagtctagaagaagttatttgcaacctatataataagggactaatttcaagattatttgaaggactttaaagattggtaagaaaaaaatagacaaccgtttagaataaggcaaagcatgtgtagaggcaactcttaaaaaaaaaaaagtgagctgggtgtgatgatgcacacctgtggtcccagttactagggaggctgaggcaggaggatcacttgagcccaggagttcagggctgtagtgcaccacagtcacacctgtgaataaccactccattctagactgggcaaacataagaagactctgtgtcttaaagaaaaagaaatgaaaagatattcagtttcattaattgtttgactagctgatttttggaaaatacccacaaatataaccaagcctacaagttattttaaggtgggtaagagatacatcttatctatatgcattcacctatgtgaagcggacacccagtaacacccccgtgtggaagacaagcttccttaaacttcacaggacagtatttcccatgtagtccatcatagggtgaggatttttcaggacctttggtaagcctgcttgctttcattcttgagggtagaggaagggtgcaagacttccctggtctctcccaagcattttggggaccctggccataagcctacttgctcaacaggtgcaaatgactggtaatatgctgaccagatgcaagtgtaccaccaatgatttgctgtgactgagtttggtttcctttgcatatactatccagctttttgtttctaatatattcttccttaagggaaccaggacttcttggggaatccagatgagcttgaaacactgtttttataagagaagggctgttttcaaaaacatctatagttcgtaacaaaggagttagattgaagggactctcactgttcagtctgtgacaagcatgagtgttaaaatggagacaagaattttagttaattgtaatgttgaatttgtaaaaggctataacttcataatatgatcaaggggaacaagcaatctaaaatgtgttaaagtagcattttcaaagtgcggtccagggactctcagggttggtgaggtcacaactgtttttataatattgctaagaatgtatatcactctccttctctccaaggatacggtggagttttccagaagctatgggatatgtggcgatagccttgccctaatggagtgtgtgctttgtgctttgcatttttgtcctttaaaaatgcttggttttaattttgaatacaataattatagatagatataacctacataaaccaaagttatttgcggccctcagtctttaagggtgcacagtggggcctgagactaaagagtttgggaattgatgttctagagaaaagtcagtcttactgatgagggttaatcaattagtatttactgaccgggacaggacaaaccattcattttataaagacacacagagcatttcactaaaatacttttactctgattaagtggtgattttagtaatagtaatgattgtttgattttctgatacctgaaggaaaaagagcctgttgaattgatactttgagggtgttgagttttaggtcactgggtgactgtagaaatggaccaggagaagaactgaaacttgagccttctaagaaatagaagaccaaaaaatgtttagtgttaccctatcccatgaccacaataattgagaaaaaggcctttccgttccctcttccctaccctcccccttctcccctaccctctcctcccccctcccctccccctcctctcccctaccctctcctcccccctcccctccccctcgtctcccctaccctctcctctcccctaccctcccctccccctcctctcccctcccctctcctcccccctcccctccccctcctctcccctcccctccccctcctctcccctcccctccccctcctctccctccccctcttctccctccccctcctctccctaacccctcccaacctttcccctccttctctgtccccctccccctccctccctgtcttcctcccaccccccactccctgtcttcctccttgtcttccatcctcccttccttcctttccttcctgtctttcttttcctttctttcctttttcttctttccttcctgtcttccctcctctccgtctgtctccttctccttgtccccttctctctgtcttgcctttcctttccttctgtctttttctttctttctctttctttttcactcttcctttttttaatttcccttttacttgccttctctctttcattccttccatgctttcttttttttagtggtatgtatactttgtgagcaatcagactatagcttgcagaatagttgggagaggccaaaaatgcccctgagaatgcaagcaaggaacttcttagtgagcatatgaacatcctcactccaatcggaggataacattgttcatacttcaaggactaaaaagctgagagagggtctctgctttctgttacttttagcactcgagtcatttctgcatgtatttctactgattactttttctcctattttggttcatatgttttctgcttctttgcttgtctagtgattttggattagatgagtgacattgtgaattttactgtgcaggatggctgaattttttttctattcctgtaaatatttttttggcattgttctaggatgtagttaagttacctggaaaaagtgacatccttttgagaggcttgcttttaagttttgttaggtggaatcacagcagtctttagccagctcactaaggaccaatactcttctaaatacttaccataatgtcatatgaatttccatgtttttccacttcagctggtaggaacacctgtgtcatctctaagcattgtactgttaattcttctagtagttcttatctggctttgtacatctgctgatcaatactttcagctaaagtctcaaggggacctctgcaaatctacagtgttcactgttcagctttctcttctgtagtaaattgcacagtgaactctagtccccttagccttcctgaacccccagttctccttaactcagggagatcaccaggccccaccaggattcctgtatctgccctgtgacctggagattctctgcaggcaataggttggggcggtcgtagggtccactttgttttcctcctcttcggcttcactgtcctgtgttacctgatgtccaatgtctgaaaactactgtttcacgtatcttgtgtgcttttgtagttttaggtgaaaggtaaaactagtttcttattattccacattggccaaagcagaagttttggaagtctttttttaaggtctaaaacacttctactttgagagtcaattgaaatggtcttttccacaataattattttctgacctatggtttaaagataagtcatgaaaattttatgccactatttttttttaagtctgattatggttaaattcagggggctatttcctcctagattgacagagtttataatgtttcctactcacaataattgtacttctgcttcctctttgcatgtgttactttaatgggaatgtatatttccttttcgttaaggctgccttcaacaatttgtcataaagtcacttctgttagtgaattctattttttctgttactttactctatccttagtaccaaagagctccttatgtgacaccaatttattactaaaatgtcgctttgtttatgttcttggaattcttcatacattgactatcctcagatgtcgaatgttgtaggcctgtgtggcagggactctcttccatttattctatttttaatctaattcttgacaaaataaacccaatttttcttttcttcccctttccatctcacgtagggactggcataaagggcaatccataaaattacaaatgatgaatttttttggttttaactattattcatacatttaagatatggtcacaatttttatttcttactagtaattcattttattttttaacttttaggttctggggtacacgtgcaggtttgttatataggtacatttgtgtcatgggggtttgttgtacagattatttcatcacccaggtattaagcccagtacccattagttatttttcttgatcctctccctttgctcactttctaccctctggtaagccccagtgtctgttgttcctttctatgaaacacaatggttttaattggaaaatttatttttttttcaggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggtaagtactcctcatgggaaattttaatcagcccagtttccttgatatacatgattaatctagacatgttttgagtaaaaacaactttagtgatgttgagatagtttccttctgttcctagtttttgtcgtgagaaagtgttgaaatttgctaaatactttttctacattaattgagataatcatatttttccctacatcctgttaatgtggtatcttatattaattgattttcatatgtttaacatccttgcattccaggaataactccccaatggccatggtgtataatcttttaaagatgctattgaatttggtttgttaatattttgttgagtatgtttgcatcaatattcataaaacatattgttctgtagtttttctgtactgtttgtctgactttggcatcagggtaatactggcctcatagaatgagttaggaagtaactcttgaatgactattttcatgaagaagcttcaataatctgaaataaaatacttaaataatttagttcacctgagagttgtttttagaagcgtatttatttttctattaatgtcttttttgaactatataagaatgtattctccttccactcacacattgatggcaagtgtgtatttgtactctgtggcctgaaaataagatttttttgaataatcttaagaggccatgctttatactctggtaattgagaattacctatttcacagtagctttttctaaaggttaatttccagagaaaagagaacatgtttattaggatatatctcttaatgaattcagtgtatctgaaatttctaaatgacattttcatattttgcatactaaataaaattcataagtacaaatataatgcaattcataagtacaaatataatgcaatttggatttctagaagttatctagttaaaatatgatcttaggatttattttttttgtcttagatttatgaatcttgcttgtttttctgttaattcatttcttcttgtttgctgcatcagtcagatcagagtagaggcagcttgtatagttgatggcacagtttagggttagatggcacaggatagaaatgggtgctagacaaagagcagtcacagaggcatgttagaaatttccagttccagcatcattgatgaagaaaaccatgaggacccaagttgatcaaaggcagccagccaataaagctatgctcatgcgagatgagctgaagtgacattacattaaaattggaagaccctcttactaagtggctccatgcttccctgctagcccctttgggacttccaagaagacttggttatttcaagaagacaagaacccacagaggctgtagtttagtttatctctctggaaacatagagaatatgtataattaaataaaagcactttaatagtgaatcctttacagtgttatttgaaatttatgtcaagtgatttaaaaagtaaaaatgaaaattaataatttcagtggaagtaaattgattaacatgaccaggaatacataaaacttgcatggtcttgtctataaaataaggatatgtcatttaattaggagagtcaaagctcattcttgcgcttaaggtctgaggaactcttctcccatggggcttatgaagggctacactgaggcaacttcctcaatatatctcagccataaaaccaagagaaagtaagaagcagaggacatcacaacaaagctcaattcagtaaaagcaattttataggagtagagggacttgtcaaaaacaaaaacaacaacaaaaaacaatgtccaaatatttattcagcttaatgagtgatgtttttgtttgatctagggttaaaatctagacaaattacagagatgaataaactacatatcctttagtctaccatcctctgaaaatgttactttttgaaactttgattttgataagagctggaggcactcagggagtcattctctggcatggtctttgagtacagagtgattttgctgattaaaagcaaatagattgacttttaaaatcaactcatacaaacaaactgttaaaatcctctaatgagagtgaagaaacctaaccaagactgactgatacattactgctccatctctgcaccaaagtggactcagggaggcctgtaggagatgccaactccttatcctactccccacaaagacagttcttggctatcttcatcagacacaaatgaatggttgaggctccaaagctctctaccaattcttgtgttacactggcacttttaaaaaattttgtttattttttatttttaaatggagtctcactctgtcaccctggctggagtacagtggcgtgatcttggctcactgcaccctttgcctcccgggtttgagcaattctccctgcctcagcctcccgagtagctgggattacaggcacccgccactacgcctggctaatttttgtattacttagtagagatggggtttcgccatgttggccaggctggtcttgaactcctgagctcaggcaatctgcccaccttggcctcccaaagtgctgggattacaggtgttagccaccgcacctggctggcacttctcttaaaactaatatctcaagaagttttttctttaagaatcttctttcaattgcaggtccatgtagttctggtattcattaaagtgcctatcccaggggttttggtatgttgtgtttcaattttcatgtttcaatttttttgatttatgcattaattttgttttttcagaattcaggtgcaggttgtttagtttccatgtatttgtgtcgttttgagaattcctcttgttcttcatttctaattttatttcattgtgacctcagaagacacttgcattgattttgattttttttatcttattgagatgtgacttacgactatgtggtcaattttagagaatgttccatgtacagatgtgaaaaatgtatattttgtgttgttgggtggaatattctgcagatgtctgtcaggtccatttggtcaagagtctgatttaagtccagtgtatacctttgttagttttctgccatggtgatctgtctggtgctgtgagtggggtgttgaagtcccccactattattgtatagctttttttccccataggtctagtagtatttgttttatgaacctgggtgctccaacattgagtgcatatttatttaggatagttaaatcttctggttgaattgaaccctttatataatgccctcctttgtctctttttgatgttgttggtttaatgtctgtttcttctcatacaagtatagcaacatctgttcttttttaattttctatttgcatgctagatctttctccatcccttcactttgagcccatggttgtcattacatgtgagatgggtctcttgaattcagcagaaggttaggtcatttaaaaaatctaatttgccactttatgtcctttaagtggagcatttaggccatttatgttctaagttaatattgatatttgaggttttgttcctatacatttgatatttgtgtattgttaagtagttgctttctagtttgaattgtgtaattgctctataagatctctgagccttgtacttttgtgtgcttatatggtagcaagtattgttcttttgtttccatgtttagaactccttggagtatttcttgtatggcaggtgtggtggtaacaaattcccttagtgttttcttgcctgggaaagactttatttctccttcatttatgaagcttaatttggcagattatgaaattcttggctggcattttcttttttctttaaggaggctaaaagtaggcccctgatctcttcttgcttgtaaggtttctgctgagaagtcctctattagtctgattggatttcctttataggtaatttggcccttttctctagatgcctttcatattttttctttggtgttgaccttgcatagtctgatggactatattccttggggatggtcatcttgtatcttgcaggtgttttctgaatttcttgtatctggatgttaacctctctggcaagattagggaaattttcctgaattattgcctcaaatatgttttccaatttgcttacttcttcctcttctccatcaagaatgccagtaagtcataggtttggttgctttacataatcccatatttatcaaaggctttgttcatttttcagattctttatgtttgtctaactgggttaatttgaaaaggtggtcttcaagctctgaaatcttgtcttctgcttggtgtagtctgttgttaaaacttccaagtgttgttttgttttgttttgttttgttttgagatggagtctcactctgttgcctaggctggagtgcagtggcatgatcttgactcactgcaacctctgcctcctgggttcaagcgattctcctgcctcaccttctggagtagctgggattacgggcgagtgccaccacccccgactaatttttgtattttttagtagagacaaggttttgccatgttggctgagctggtctcgaactcctgaactcaggtgatttacccatcttggcctcccaaagtgctgtgattacaggtgtgagccaccatgcctggcctgcttccaagtgtattttgatgttccctttagtgaatttttcaattccaaaagttctatttggttttatcttaatatggctatctcatgtttcatatcctgcattgtgtttctggtttatttgaaatggattttaaatttctcttggctctcactgagtttccttgcaatacatattttgtttttttagtctgtcatttcaaagttttcaacttggttaggatccattgctatagagctagtgcaattctttggaggtatgaagacactctttttgtagtgttggagttcttgggcagattccttcttatctgagggagctgttgattcttatttttgaatttcctattggttgggcgggacttaaactttttttttttttccccttgagggtatgactatggtgtatgttgtgtgtgatcattcaactttgtttctgggtgctttcagggggccaaggctctttatggattccttgggcgtggtagctttcttaaatgctgcttattgtagcaatgtattggatttgtgagctgacactctatctcatgtggggctgagggtgcagaagtctcaggaagcttattttgtggagtagtgctaagcctttctggtagtgggctttttatttgatagtacagttcaggctgcaatccagtagatggcacttaaaaaataagaaccagcttgccctcagttaggctgatgtccagtagaagcacctgtcctgacaggggagtgacaggaagagattctgttggtgtgtgccgaggcctttggggtcgctggttggggggagatagggggaggtgcactagctcctcatgcaggaatgtgatctgcttttctatcataccccatcagagggctcatgaccttcagttcataaagattttttccttgggttcccagccatagtctgtctgtaggttatgcatatgcccctctgaaggcaaccaccaaaatggtcttggggcagagcctcttcccccagtctagggcagacaactccatgacttgtatgtcctccattgctgggacactgctgctctgtgtagggatggggagttgggccccaccctttatgtaagcctaagtggcattctcactttcagcaggggtggagccatcttgaaaaccatgaaaaactctttcttcgagtacctgtgctggcccccagtgggaagaaccactgctgcgtcttcaacagcgtgtggggtgggagggtattgccacagatgaccccctctccatatccgttccttgacatggtgttgccccctttagcgattggcactgtgcccacctttcctttgtcccaaaggggttttggcaagttgtgtccctctcccttataggtggcctacactaggggggttagatctctagaggttccatagctccctgggaacttgctggccccctgggcttttcaaagtcagaacaggttatgaggtatgtttgctggggatctggtgctacagagactcaagggtagagaatccctgggcagagcagaggcccaccactggtgcacaagcaatatggtgaccaccatctcagtttgtgtctgaggggagtatgggaacccctgcaggagctggccacccagttctctatccctgggaaattcctaaattaccaccaataacattgccctgggtcacaagggtggggccttgaattctttgggggttgatctctgccagactctagctacttttcctttctgcaccccagcttcttcccatgggcactccaaaaggtcctggctctctttccccagttttccattagaaacttgtccatttgacagtaactttgatcttctttctaagaagagctggcatccaaggtctgtggtcagctatgttggaaaaaagaaggagaaaaaaactagtttgtattaaattctgaaagactagtggcactggttaagtctttaaaggattgttaacaaaagaaaatctttttaaaccaaactcctaattttatcagaattgtaactgaaaatataaatgtatgaaaacataggtattatgtaaaatttgctcaataaaagaataggaaaaactactatttatcttggactgatagcatgttagtttgagatttgaaccctttctactctagtaagtagtggtgggaaaaattcactgtaggagtctgcagacataacaaactatcattagactgccaagacctccacataataaagcaagcagagaatgtcaaataagtatgtgaaaaatgatcaaaaaagagaaattgaaaatataaatagggtgctattaaaaaaggatagcatttatgttatgacatatgtacacatgaatatcactttttagaatttcatccttcttaggacttattcctgagtccgaggattgagaggttctgataaaataagtctcagtgggttccaggcatgggctttctttaaaagtctctccagggattctaatgtgttgccaggaccaagtaccatggacagccaagatctcatcagcacagtttgattgaatgaacttatgtagaaccctgaatgccacacttaaccaaagaaacctttccagggattaattataggtgacagaacatgctatattcttattaaatattattaaaagttaagcaatacccattcctgattcatgtaaaattctcacttattttccaagagttttactgtatgactggtttatgggatgcttggaaaaggttgacagacatggcaaaggttcctgcagtgtttctctttgtccatcaacagccctagctcataacctctaccctttcagctaaaagcaattagctcttcagaagtgattcattctatttatacttgggataagtaacatcaggcagtcttccctagggcttctcacgggccctggtggcatttttattctaagagagggttatatttttacatgtaattggtcataattatactaaaaacaagtaattggtgtcttatacaagaaaattatatttctgctttagtcattgacagagtatcctgagaataagagttaagaagtatattcattgtcatcttatttctgatatatttcaaattcttttgctaggaagaagcccttttgactgtgctttgtgtaacaaaacttcttcggagaaacaatttagataaactttgtcagatcttatgtgattatattcaaaatgctaattgaagattctctaaacattttcagtaaaatgttgaattgttttcatgctgttaaataagttaacatgtcttcctttactaaagtcattattataaaaatgtaaatcctaatgataatagctgatgtttattaagcatttagtaggttccattttttgatagcaacttttatgaattatctcattaaatcttcataataatagcatcaagaactacaaatatgttttcatgtaagaagggaaataaaattatgagttttgctgtgaggtttgaagaatgaaaacaatgcatgacttagaaaatagtataattaagtgaattttattatcattatcatctcttagtttataaatgaaaaaactaaggcttacataatgtaaaaatcagttaacaaggttaaacaaccggtagatggtagaggaggagctgggaataaatctgtacatgtctgaatctggagcaggaacccttaactgatgtgtcattctagcaggtcatcagttactctacaatacctattaagtatactttatttactgtgtttagatttatagtagatttagactctactgtaaaaacaaggacttcatacacctgctagaaagtatccatatcatcttgtttgaaagttgtcccgctctagtgttcttttctaatcatgatgattcagaactccaaactcttgaagcagggcaacccgtagggtcagcattcataatttctcaatacttaaaaaagtttcctcatgactgttgctattattgagatttctcaaatgtcttggcctgaattgggtgtgcactatgaaaaaaaaaatggcagacatttctttttgttaaaggaattttaaaaacacatataaacacactgatttgtgacagattaccaggctttatgtttagcagggtttcctaagcaaaacacaaattctgtaaatctacagaattagataaaacattgactcaatccttagatgagagtataatggattatcacttaataacttctgtcactgaaaataaatgatgtaaaaagtaataaagttctactctcacagtatgaataaataggaaatacataatactttaaattaggcaacaaatcattaagcccccagcattcattagactatcattaatgataataaaattgtgtggtatttatacagatattatatgtaactccaggaattttgttataattgtgtatgaatatatttgttgtttgaggcaggtagatggatatttgcagcagctatgtgctgaagcattctggtaatagttttcaaatcaaccatttttttctccttgtcgatcatctttaaagcaaaagcaccgttttttactatattttttgaaaaaaatacattaggtgtaaaattatatattttgaagaagttcactttctgtttttactagtttcacacctttgttattttttcagtggaaggagcagagataggcaaaggcgaagcctgtgtgtgtggtcaggttcctgggcccttcatagcatctgatgccaagctgtgttctcttttgtgtcattgccttcccacttgctaattacgtgacagagctagggacttccctctgtctagaatgccccccatctcttgtttgcctagtgaaatctggtttgaagttcaaggtctgatacaaaccaggtgatcctctgcaaaactaactgtacctgagcaaaccaggcacttactcttttatatgttcctggcactgctgatactctgatagaaaacatcatcacttaatgctaactgtgggctcacaaaggggatacttctactgtaagaagactgtaactcttcttagcacagagattagtaagtacttgaaacagagtttcacatataataagtgttcaataaattttattttttatttctaacacttggcacactgcatagctcagtaaatgttggtgaagtgaactgagtattctccttatctattatgtggtaggcattattctagttgcttctgttataaaccaactcatttaatccttatcacagcacttttattgtggtcaatattttttaatcctcacagatggctaaggaatcagcactctgagagattggttgacttgctttgggtaaggtgcttataaagtggtagaacaagattcctatccaggccttctgattcaaaaatacattctttttttttttttttttagtagtgttttctggaaaggcagggtataactgactatgctgtgtatttgggactaagtatattattgtcaagtatattaaaaatgtcgcaacactggaaaggagtccatcaatgggctatgcaggttgagggatttgtagatgagaaactgataaatttggttagcaaggaaagccatcaagctgtgaaccctttatattggcaaaagagagggtcctttgaaatctaagggaacagaactttcctgttctccaagtttggagcagaataggtaagctctaggcagtctaatgcccaacttttaccagtggtgttttagttttttttttttttccaaaaggaaatgatggaattctttatatacttctgaattgtctatcttttcaaaaataaaaattttcattttgcagtacatacagaatcaaaagactttcaagtcctaactccacaaatgtttattttgaagctctttaaactgtttaccacggatattagtaaatctgtcagaaatgaggtgacttacttatccttgtcccaccagatatgtgggaaggatgatcacgctagatagcatggatgggtcctctatttatctctttttacttgaatggaaaacacatcattcagattaatcaattagtcattgtgactgatagaatttttatatggataatctgggtttggtccctagctttaccacttacttggggtctttatgtcttctatggtctcctatctgtaaagggaagttgataatgccaatctagctaggttactgagatgcttaaatgtgtaatgtatgcaaagcagcaggtactcaataaagggtaactcttactattattgtatagctctccaggtatgtattgagcttctatagaatccatagccccaaactctttagccctttgagaccaagattaagcattgtctttccagaggagagggtgagagagattgccattatactaatagaattcatcattatcaccgtcatcatcatcatcatgatttcttggtgtgtcatggaatgtactgtgtttcacattaccaacagatgttaattttcacaacatccctgagacaagaaactatgattacattttacagataaggtcatgcagctataaagttgtgaaattgggattcaaactcaggcagtctgtccccacagtccatgttcttaacccaccatgctctcctgacacttgaaaagttaggaggcgtactccatagcctgtaatgttgctgcagagagaatctaattttaaatccagtgaagcatattagttgctgtctttgatatgccattcagattgtgctatccttatgatgcctaccttggttgtatatgtaactgggcgtcaaatatataaatactcaaaaagtgataggtgccaataaaatattttatagttaatacttatgtaatctgtgttctctgtgtttgagggctggttctaaaatactgctctatatttgacttctggttaaaacaataaactttgctcatattagttatatagttgataccattctcatgttgctaacatgtctgtaagtaacagttgaaattgatctggcaattttagagctgtcagacccaggagatgagagaaacatttaaaatgtttataacattaaatcagctgagtcaagagagagaaagagaaagatgattcagatttcttgtactggtggatgtaagtgcttggaactgaaataaaggagaaggtgtagggagggagaaagataaagaagtcttccctttatacaagttgaaattgagttttctttgagatatagaggtgaagacattttaagaaacttcttaaaactctctaatgtggcttttcaacctgtttccatcaatttggcacatctcacttttcggcacaacagaatattctaggtttatctcacaccttccttgccccagcccaggaatcagccatttctctaagaaactcttgtttattttggtggggaacagtattgggaaaccaacatctgggagctaaatatactcctagtggttaggaggtcataccttgtagactcttgtagctgacggagttaggacatatttattagaaatcataagtttatattgatcttgctaggatctatccaatcctacaagattcttccctgtgtctctcctttgtatttgtgtatcctttcttccatattaagaactgtggctcccaacaacaaggcatgtgcccatttgcccaatcgtatgatgtataaaaactactttgagaaaagtggcagccaaaccactaagaaaaataaacttgctgaaatgagttcaagatttattggcagctctttttttggcccctagactgaaagtatatatttcaagtattgtgttcaaaaattatttgggttagctttttccacctttcataatagtaatattatttacttgaaatacagttggctttgtttctatattcagtttttttctctctatcttcattaatttcattatatatatttaatatgtaggacattaacatgtttccaaaagaagaaaacactccttcctgtatcatttccacctcatctctcttaccccttataggtaaccaattgcactggtttctagtttatcttacttatattcctatttgaaaagttacctcatatatgtatgttttttaaatttttatacttttttacacagaaagtaacgttcagtatgtactttgccactttccttttaaacttaacagcrtatactggaaatcactccatatcgtgtcacagagagcttccttatattttttaatagctgtataagacttcattgtgttgtctgtaccatattttattcacttccccatgtgtggacattttgactgtttctagtatctgcaattactaataatgctgcagtaaactttgtgcatatcgtaccttggtaaatttctagacatagatttctgggttaaaggttaagcacatgtgtagttttgttagatattgataaattcctttccatggggtttatatcatttttaaaatatttaccagcaacgtataacagcgtccattacttcaaagcctcaccaacagattgtatgttttaagtacttttatgttttagaatttttccaatgcgataggtaaacaatggtatatcaatatagttttaatacattaaagttcagcatcttttcaagttcggctagtctcagggctattcttaatatcttgtgaattatcttcatattattttcccatattccataatacttttggttttttttcctcctcaattctgacaagttctttatatttcaggaatattagccattttatttgatatgttacaaatatttttctcccaatatataacttttctcttataacgatttttttttcatgaaaagtttttaattaaaaccttttatgggcccaggtgcagtggctcacacctgtaattccagcactttggaaggctgaggtgggcagctcatttaaggccaggagttccagaccagcctgaccaacacagtgaaaccctgtctctactaaaaatagaagaacattagctgggcttggtggcacatgcttgtgatcccagctactcaggaggctgaggcatgagaatcacttgaacccagcaggtggaggttgcagtgagtcaagatcgtgccactgcactccagagtgggcaacagagtgagactctgtctcaaaattaaataaatatataaacaaaaccattatgggccaggtgcagtggctcattcctgtaatctcagcactatgggaggtcaaggtggttgaatcatttgcgccaaggaactggacagaccagcctgggcaacatgggaaaaacctctctctaccaaaaaagaaaaaaaaaaaaattagctgggtgtggtagcatgcaccagtagtcccagttactcgggctggtcacatgagcctggggaggtcaaggctgcagtgagcagtgattgtgccattgcactccagcctaggcaacagagtgagaccatttctctaaatacatacatacatacataccttttgtggagttaaatttacacactttttctttattggctctggcttttgcattgtagtaagactttctttacactcaacttatagataaattcacccatgttttcttctagtacttgcatagttgaattttagatctctagtccatttggagtttattttttgtatggtagaaggtattgatcctattttttcccaaatagttgttacccagttgtcccaaaacaagttattgaaaagtccatctttgtcccagatagactggaacaaaatgaattaaagacttaaatatgaagatttttacttgtgtatcctttcttcctagaaagaaaacataggcgtaaagcttcatgacgttgaatacttcatgccattggtctggcaataatattactattatgaaaggtggaaaaagctaacccaagtaacttttgaacacagtacttgaaatatatactttcagtctaggggccaaaaaaagagctgccaataaatcttgaactcatttcagcaagtttacttttcttagtggtttggctgccacttttctgaaagtagtttttatacatcatacaattgggcaaatgggcagatgccttgttgttgggagccacagttcttaatatggtagaaaggatacaccaatagaaatatttatatttaagtctggcaatcatttttaagatgtgaacttgaacaggcaacaaaagcaaaaataggtacgttggattacatcaaacccaaaagctcttcacagcaaagggaacagtcagttgagtgaagagacaacctatggaatgggagaaaatatttctaagccacacatctgacagagggttaatatccaaggtatataaagaactgcaacaactcaatagcaagaaaacaaataacatgaataaaaaatgagcaaaggatctgaatagacatttctcgaaagaagacataccaatggacaacatgaaaaaatactcagcatcactaacaatcagggaaatgcaaattaaaaccacagtgagatatcgcctcacacttgttagaatggctgttatcagaaagataaaagataagtattggtggggtgtggagaaaaaggaactctagcccactgttagtgacagtgtaaattagtatagctgtgatggaaaagagaatggaggttcctcaaacagtttaaagtagaactaccatatgatccagcaattccacgactgggaatatatccaaaggaaatcagtatattgaagagaactgtattttagtgattattgcagcattgttcccaatagccaagataagggatcaatctgagtatctatcaatggacaagtgataaagaaaatatggtgtgtatacacaatgggataccattcagcctttgaagagaaggaaatcctgtcatttgccacaacgtggttgaacctggaggacattagctgagtgtaataagccagccaccaaaagaaaaataccacatgatctttcctatatgtggaattttaaaagttgaactcaaggaagtagaatagaatggtagtgaccaggggtatgcgataggctgagggatcaaggagatgttggtcacgggatacaggatttcagttagataggaggaagaagttcaagaggtctattgtataccatggtgagtatagttaattataaagtatacttgaaaattgttaagagtagattttctgttcataccacaaaatgataagtatgtgagataatgcatatgtaaattggctcaatttagccatttcacaatgtatatatatttcaaaacaacatgatgtacatgataaatatacagtttatttttaattaaaaattttaaactctctaattggtcttcaacatatagtacacaagtcttttcacgactctttataatggaacatatgttcttggaatgctaaaaattattttttttggaggccctgcaaataactaaaaatttatcttaaaagccacacctaattacttacatatgatccagaaaggatactttgaaaaagctttttaattgataaaatcattaaggtaaaacatattcataaaagtgttctctaataattttataattttctagttcatgaaggattaaatatacaactatcatttgaattggattttttatgaggttaattgtatttaaatgctaattattttaactaattttgtggttgacttctatgtagagtagggaaaaagaatttcctaaagccagttacgtatatctctttttagtctggatttttaattaggaaaagtgatatagttaaataggtctactctatagcatcttctaaaatgagtaaaaattcattatatcaggataaaaaatgataaagatatatggatgacacatttggctgaatttttcttcttcgctgttctcttgctctctatttaaatagtcttagctcttttatcatttaaattctgaagtattgaggtgattattccggcagcaggtgattctgctaattactgttcagtcagttttagctattagaaacagagatatgtttacattgctgggctgcatgtaaatttagaagttacatggctttgtttttactttgacttacggcattaaaattattttcatctgtgtatgtaaagatctgcatctataagcttttgtggataataaggtgaaattgatgcattttaatataaattgccaatataaaatatctctaactcagacctctactggaaagttgtcaaatcttatgtaggaaaggcttttaccatcactgttacacattaactgggcatagtttaatattaatagctcctgagacttgtggttaactgaggtttctatttcctgtgtttgggttttatctttgcaacaacttggttgcttttctgtgtaaaatagtggtgaatatacacaagagtatgacaaggttctgggctcttaactttgatgaacaccatgccatttccatcatgctgcactcaaaacagcacagatgtgagtctgggagtggcgtccctgccgctctcatgagcctttgtttggagaacaccctgattaacccccacccttcacggttcattgactcactgatagatcaagtttaaactagtatatattagcacatttgttaccaacagaggaacagttggccattctgttttacattgctggttcattgcaaactggcgtgctaaaaaggtctgtactctagagtatgaattgggaagttaccaaaggactgagaaccaagtcagttgcatattaatgttgaattatacctatattttaatcttggattgtctacttgggggatgcttacactgttgtcaagttatgaataagtgataattaccactttgaaattcatctttttttttcaaggagtttaggggatttaggtgtctcaatatagctttcatattaaacagtttgtcataattggatgagagcagagcaaggtcatgactacctgatgccttgtgttggagcattttaaaaatgttttccagagagttatttgtacctaatgactttacataagtccttacattatactttatttctaggtcacctaaaaatgttaattgtttagtcaagagggttaggatgtgtgtctgttttctcatgaaaaaaattaagctgttccctttttatcaattttcttgcaatctaaaggcttttttttcttaccttcctaacctagtgactaaggtcatcttattgttacagttcctttcatgggagataggtttactgcatcatttggcagtttcatagggtgaattttgtcttggcttcatctttccttactggttgtcatcccctgggccacctgcttttttgcattttcctttctcttgtgagatgatgaagctctgtgccccgatggggatgagagacagcactctgagttcaagtctaggataaggcaatgggcttgcttttcaaaacaaactagtgtcatacgggctgctgctttcaggtccactgtctgattttatcactgatgacttgtttctggaaggcaaactgatttaagttctgagcaaaagggtcggtgtttattttcaatgctactattaatttagagttttaatttagaaaagattttttaccagttctcaaatatgatttttctattgactttaagtttgtagatataaggagtagacatgagatagagactgaattgcttttttgtttttaaaacttggcagtaataaggggttgcttgttttttcatgctaaatattttttctaagggatctagatacctatcagaaaacttaactttgataactctggttctttattaagtatttttgtcttattttaggaattaatagaaatagttgtaattttagacttcctttataaaataccaatttaaagagaagctttttgcttaaatgattgttttgcagtgttgtgcttttgttttctttaatgcagttgaaatcgcagctttataacttattttttaatttggggtttttaaaagaatattagttatttatttatatttattgggcacctactgtgtgccagacactattctaggaactagtaaacatagcagagagcagaatcatgaagttcttgacctcaaggagcttaaatcctagtggtagagggggaattcaaaaaaatcaaataaatgtatttctattatgtcaagtgatggtatgtactaccaggcaatcagatgaaaatatttcctcttctatacacagtgggcaaggaaggcttcattgactgtggagttttagaagaaagctgaaagtaatggggaaagagagccatatcgatatatgaaggaaaacatggtccaagcagaggaaacgaaaagtgcaaagaattgagcaagaaagtcatgttcaagtggagtcagcaggggaaagagtaggtcacaaatgcggctgagggtgggtcatgaagggccttacaagctttgtatgagtttttacttttattctgaaaaaaacaaaaacaaaaacaaaaaaaaccggggagctatttggggattttaatagaaaagtaacataatttccttttaaaatggatatgtggccactaagtggagagagtggtgtatatatgagtggatggaataattgatacaggcaagcaggagacaggttaaatgaaaaatggattaatccaggcaaaagatggtgacttaaattaagctgggagtgggagagatggtgagacatgcttagactttggattcatttttccagatagaactggctgacagagacatgtcatttaccaacatagacatggcagattttttttttcttttctgagacaaggtcttgctctgttgtccaggctggagtgcaatggtgtgaccatagctcatggaagcctcagactcttgatatcaagtgatcctcccacctcaacctccctagtagttgagattacaggcatatgccactgtatccagccaactttttttttttctgtagagacaatatctctctgtgttgcctagggtagcctttaactcctggcctcaagcattcctcctacctcagcctctcaaagtgctgggattataggagtgagccaccatgcctggccaatatggcggttattaagaggataagtcaaagattacatgaatattctgttatgaaaagtgtcaaacatatagaaaatataaacagtattccagtgggcacccatatttttatcaccttgattctacagatcttaacatttttctgtatctgcttcaaacattttattctgccaatgtgttctaaagtaaattgttgatattgtgatagttctctccaaaatgctgcagtgtgtagctctaaaaatagatatttttcagataaccaaatatcattaacctgccaaatcaatgaatgataattgcttattaacatttaatacttggtccatagtcaaattctccatattttccataatgtcttttatagttaacttttaccaactagtgtctgatcaagaatcattcatttaactaattacatttaaactgtaacattacaacatgttttttcgtatgttttattctctctgacattgacttatggaagagactagattatttgtcctgtagacattttatcatacataagagttactaggagagctctgattactagtccccactctcagaaattttgattcagttgctctttccagtgagctgctggtgatgctggactttcattctgaagaccatactttgagcactactgctgtaccactatccgatggcttctttgtgatatcgtttaacttgttgttctgttgcctgtatttcctctaaactgaattttcaatctaaaggcttactgagattcatgtttgatactttgggcaagaatacttcataagttctagtgcttaatgttaggtagcacttaattctgactatttcactattcatgaggctaagctaaggaggtgacagcctgatccttctattgtaatgtttcatgtgaaactactagataatttgttgagttggggggtgggtagggaagagatatctagttttcaataaatatttcacctaatggttttaacacacattgatcatccttgcctgaactaattatttaattagggatggcaacatggagactttctaattcaatctttttttttttttctaaatgaatggccttgtttttatttttaaatggatgttacttcgcaactggggttatttgattacccagaaatatagcgcatattaaaaaggtaggataaatgcttagttaactaattaagcaatttttaattaccagttttcacagtaaggcactaaagtttctgacttgagcaaagataaagtggaaagataaagtggtcgtttagtgagatgggcaagactgtggataggtagactaggtttggtgggaaagtcagaatatcagttttgaatatgttaagtttgagatgtctattagaaacatatgttgacgaggccaggtgcaatggctcatgcctgtaatctcagtactttaggaggctgaggtgggcggatcacctgaagtcaggagttcaagacgagcctggccaacatgtgaaaccctgtgtttactaaaaatacaaaaattagctgggcttggtggcatgcacctgtaatcccagtaatcccagctacttgggaggctgaggcgggagaatcacttgaacccagggggcggaggttggagtgagccaagatcccgccagccactgcacttcagcctgggtgacagagcgagactccatctcaaaaaaaaaaaacatatatatatatatatatatgttgacaatatttcagttgaataaaataaaatattctagctattttaggtagaaaggcattttataccgatactactactaaagggtaagaagatatgactgtagtacattaaatatgctgatggcctacaactgttgctgtgttgctttttcctcttcaccacacatatgcagcctcatgaaacattttccatgaccagcacactgaaggaaataaaaggaacctagtttagagatggttctgcatgatacaacaaaaatgagctgctaaagcattacaatcccactcaagagtattcccccatcaaatagtggggctggtattttaatcagttgatactaattgtcaaggtgtgatggccaagggattgatgtttatcagtgtatggacagtggttcagagtttggtgaattagtcgagttgaaagagaaagattggtgacaaagatgtatgaggtggaaagtatactttcacagaataagaacagaaaatgagatttatgtttttttgtaaacgttcaacaaagaaaattcattcagaggaggaaataggtaggcaagatgccctattctacagatgttagtcagcatcactgcaaagcaacctcagggcttatgcagtggacacttaaaatagcactggtgcagggatgggagaaataaatggatttaataagcactgctgcttaccaaggttgattgaattgccactattgccaagtgttctacctgcaaacagatcaaccttgagccctggatatggcaccatgtcccagagcaaccagccagccacctggtggcaggttgattgcattggatttgctccattatggaaggtcagtggtttgtcactgctgcgatgaatgcttactgtacgtttggatttgcattccctgcccaccatgtttctgtcagcaataacatggccttattaaagccttattcaataatatgacatcctatataatattgcttttgatcaggagactcattcacatcaaaataagtgaggcaattggctgtcaactacaggattcactggtcttaccatgttcctgttgtagcatattgtattctacctggaagatgaaaccttgtgacattaaagtagtttttagttccataaacataatacaggggtctatgaatcaagaagtggaggtagaagtgttgtcttttacttcacatctaatcacatgttcaaaatattttttcatcttgcctctgcaactttgaactttgctgacacactgaggttttagtgtgaggaaacaatactttcacatgggaacatgatagtcgttcaattgaactggacatttagaataacctggccacattactgaactgtataactgaaacaacaaatgaaaaaaatgaagatgctacgctggcaaagatgattaattttgattattgggagaaatagtattgctactgttaggaggaagactatatgtctagaaactaggaggaaacctgggttgcctccttgtagcagggtaaaatgagtgagtaccttgtctaagaaagggaacatgaccaaactgaacccagaagacataggaaatctaaacagatcaattaacaccaaagaaacgggcattttttggtacttctaaaaaagtaccagactgatattttcacagagatgttcgttatacccttaaggaacaggaacagaaaacttctatactatttaaactattttagaggatagaaaaggaaagaaaactccagattttatttatagaacttgcatgaaattgataccaaattctgacaatgcaagttcaaaaaggaaaactagagatcagtgttacttatgtcaaacagctcttaatagaatagatggatatggttatcaacatgataaatatgtttatcacattttaaagcctacatggagaaacatttgaggttttcttattctagaactgacaggaatgtcctttattatgagcactattagtcaaatttttctggtggaactaatgtaagtagactgctgaagaaaatgaatggtatgaacattggaaaggggaaattaaatgattattatttacagataaaataattgttaagctggaaaatccaagtgaataaagggaaggcctacaattaagcagttaaggaaagggctaggtatagaaatcaatagttttgatatatgcaggctatagccagttaggagatcagttaggggaaaaacacgttgacagcagcaacgaaaagctgataaacctagaattgttcaccacttatcttaaaatgtttaacatggtactgagggacacaggagattatttatgtggaaaaacataccatgtttctatacagaaaaattgaacatcacaaaagtattatttgatcttaagataatttatatttaatgcaatctcagtgaaataccaggagaatgtttttaagctagacaaacttatttcaaagatcatatgtaaaaataagcaaaaatagatgtgaaaaattctttaaagtaatgagagaccagtcttattgactattaagtcattataaaactataatgtttaaaagatggtactgacatatgaatagatcagtggatctcagatgggcagtgcagaaagagatccaaacacatacaaaaatttagtacctctaaaggtggcatttaaaatctgtggggaaagatggattttccaatgaataatgttgggataggtagatagccatctggaaaaaatgaaagtcaaatcccaactttttaccttttatcaaaatgaacttcagatacaattgaaaatataaaattgagaccataaaagtattagaagaaaaatgcagtttttaagtctcaaaaggggactcttaaatatcatacaaagcccagaggccataaaagagatgattgataaattcaaatataggtccgtgtaagcgaaaactttcagtatggagaaaacataagttattaaggcaaatgacacactaggaaaagcatttgtaactcataacaagcctagttttcttactgtgtaaagtactgccataattgacaaagaaaatatgaagaattggcaagtgacatacatagaaagttcatggaaaaaataactcttaaacatttacaaaattttacaacctctcatgaaaagagaaatggaaattgaaattagagtcacatacagtatttcacttttcatttgtcaaagatcaaaaagtttgaacatactgtgggtttatgtttataaggatgtaagaaaacaggcaatctaaattccttgtagagtgtaaattggtagtaataagagaaaaatttactgaatactttgtgccaggtgcttttctaagcactttacatttaattatctcaattaacttatccagaaagtaccattatttctgtattacacgtgaggaatttgaagaaaagttagacaagtaattcaaagtcacacagttaataaatgacagagtgaagatttgagaccatttcctttttctcaagtgtccacttttggtcgcaactctgctgtttctgtagtgagtgatttaacactatatgataaaaccttaagagtacgtactctttgatccagtgattctacttccagaagtttgtccattttgcatcaaatagatggagaatagcattcattgcattgttatttgcagtaaaggaagattggaaacaacctgaacatttatcctcaaggactcatccatacaaaagaattgaagtaaattcatccagatgaatatgaggcagctttagatagagtgagatggcatcctatgtagtgatatggagtcatctttaaaatacagtaaaaggaaaaagcaagatacagaatagcatgtagggaagctgctgtctatgtgaaaagctgtagaatatacgtgcatttttgtatatgcatagaatattcctagacaaggacaaacatggtggttcatacctgtaatcctagcactttgggagactgaggcaggtgattcacttgactccaagttcaggatgagcctggccaacatggcaaaaccccatctctagaaaaaatataaaaattagctgggtctggtggtgtatgcctgtggtcccagctacttgggaggctgaggcaagaggattgcttgagcctgggaggcaaaggttgtagtgagccaagatcatgccactgcactccagcttgggtgacagagcaagacaccattcatctctctatctcttttctctctctctctttctctgtctacacacatacacatacccccccacacacatatatatacacacatatatgtgtgtgtgtatatatatgtgtgtatatatatacgtgtgtgtatatatatgcgtgtatatagatacatttctagaaggattctcaaagtgatatcagtgattgttgtgcaagaaggaaactagatatcagtgaatgcgctaaataaggtgattttgaattctgtagcatgtgtatgatttacctatagagaaagcagtctagcatgagcgtgggtttctcaaatatagaatgtttgcagtgaggtcacttggtgaaaagtatagccatgtcagacagatgtaggttcagattccaggacttccaggactgctgaaagggaaaggggctttggatctccttcagctccaggcagcattgctcctttcccagctttgacattagctggagggaagacaagttcttagagctctatgtgcttgggacaagaccccttccccctactgccttactcgccaaccataactgctgcaaacaattcttacctcttccaccccatgtcactgcctaaaacccttcatcacctggcctcccatgcctctaagtctctgtacatcccctagcctgatactgtccccaaccctcctcaactccagacaccattttactctaccctctggaattgtccattattagcaaaatctcctttattttcaacctcctttctaagtatttcccccacattcttgttgtaatagagacacagctttcccaggactgtatagctttccttgcagtcctctaaagtggtaactggtttctctgccatacatttcataccactggtcctggagatattgtcaatatcttaatgtcttccttccatctcacttaaattttgagaccataattcctttttcctctcttaaaagttctcagtgttgaagctcaatccattagatacctctagctggcactactagttgcagtcctgtgcagactactgagtcattttctttactccctgaagacttaaactctatcttactctcactctctctgacattactcctattaaaatgttatgtttctttagctattctttcagtttttggtctcctctccttcaacgaggatgatttctagaatgttggttctcaaaatgtggcccctttgcagacatcgtcagcacctgggaacctgttataaatatgaatctgcagaccacaccccagactactaagcccaaaattctgggggctggagcccagaatctatgttttaagaagcacgtcaggtaattctgatgaatatgccagttccttagatcttgttattgtcattactgacaactttctctgagaccacaatttgaatctaccaatttttcactagtactcacccatcttaagtccttactttccccttaccagccagacatttgaatattccttgactcttctctttcacatactatatccaaagagtcaacaaatgctgtcagctataccttcaaaatacatgtagaatctaacttttaacctccactgcagtcacttcagtccaagcacaaccatttcccacctggagtattgcaactgttcttgtttggtggcccttggccctactttatctactttccgcaaagcagccagagtgtttctttcaacacctaaggttatatggcttcattgattgaaattcaccgtgcttcacctctttctctacaaaagccaaagtccttgtaaatgcctgtaaggctcgagggtgatctgaccttccctggcctgtcgtgtttcggtaaaagtaagctgagtctttcatagttaaaggacagcaatattgtcctgcatgatattttaaaaacccaatcaagaatcacacattgcatttaattttcatgcctttagtctccattaaaagtgtgccctttgtattaataattggagtgatgagggacagagtttaagaatatataaatattttgtccccaactgactgtcactggatggctttggcacccattggtgattcttacctgaatcagtaattattgtgatgactgaaaatagtgatttttctcactgtataattcttctatatttattaattaccttaatattatcctatagaacagaatgttcccttctcatcttttgtttgtttagtgtcagtattactcatgaagttgggtgtttagaaaattcaatgttgtataatactgttattattcaatattgtattttctcagtttgagtcttccatctgcgtcctttcatgtaaatagtataaagatcagtaatagaggaacatagagtaaagtgtgagcagagaagccttactctgagacaaacttcagagaggtgaactctgttgctgattaagaaaggcttcactgaggaagtgttgtttgaagtgagctttgaaaagtcataaaattttgacaaaagtggggatggggtggagcttaaaggaaaaactgtctgaacaaaggaaggcccggcagactaggaatttggcaataatacagtggttttggaccttgatgaggaagttgaaatggaacataaaaaccctctgcatttagctccatttatttgctcaggcagctctcactgcctaaaattttcacccctgctgttttgctcaggggtgggatgaggggtaatgagggaggaaattttagggggtgaaaacagcacaagccaaaaaccctgctcagatactcccttctcttgaagccttttccagatccctaataagaattaaccaccctctctcacacactctgttgtactttgtccttctctgttaaccagcctctgtgttttgtgctgtctgtatttgtggatacatcttcctcctttaaagcacgaatcatatcttaatcccttggcccttcttcccagtacttagcacaagtgctcaatacatgtttctttaacgcgtgtaacagaggaaggcgaggagagtgagtgggattgggagcaggaggattctgaatgtcattttaaggggtttgggctcgctcttcaggcagcaatgagccatagccgcctttgaactgtgcagcactgaccagagctgtgatgccaaaggatgcagtggaaggggaggacagccagcatgcctgggcatggtccccaagtcagaggacatcagtgggagaagggagaaggcatggaagcaagtggctaccatcttatgaatctgagcactcattcaaaggtggcaaggaaaaaggaaggcattgagcacggttttgaggtttccagcctgggtgattggaggctgatgcaggcttcttaccaaaaagggccctaggcagtttcaccaggaatgtttaaggagtttatcatgaccctatctcttcctcgtctaaaactctccctaaaatcaaaacagtatgtcctgttgaaatactttattgtatcaaatataatgagaagtaaaatattctctctacttgatgtatgaaacactgacttcttgtagtggacaattttcacttgtctttttagtaatggtttttattaaaaatagatgttaataactgcttgtttaatctttaaacgtggccctctgagagcagcttaccgtaaaagaaacggttgtcagctttctttttgctcctcagtccctcctgccccttcctaacaacagaaaatttgctttgcacctgctccaactgggttcgaagagataagcatcttgcaagcccagaaaattgtagtatcaaatctcagccccaactgtgaggcagcactatcattgaatccctgctgagaggcgttgctttcccaattcccaaaagagttctttctcccctggccccttttcaggcttgaactctgaccgaaaccctctttttaactcccagcatgcactgcacttggtactgacactgacccatccctgcttcctctgttctgcactggactcatcagtaggtcaggcgttggtagccctggggtcactggggtgcccaattccaataatgagcacatttagctaaggagaggaaatgtacccttctatttgttacagtccattgctttttttccagaaacaaatgctaaaagaacatttgatatattgtggtttggtaaatacacatagcactgcctaatattcacaaagttgcctcttttttttgcatcttccttcataaattaaatatattgttctaactcatgatttattttaagagggatatacctatttcacagctaggaaaatgttttcaaataaagttatattcagaatactcttgcaagaatttcaaataaaaatagcaaatactatttaaatgcatataacattctaacagacttgtgtgtcattttaaagggaaagaaaaaaaatgatgacaaggactttacaactttgtctttaaaatttcttcttaggctttccaaacagaccgaagtcattaaaaatactccttaacccccaaagtcacaaaaaagaagctacccaggtttattatgagaaggttgaacctctgttgaagcttgcaggaataaaaactgatgtaacaagtaagtaattttcagaatataatttcaccatctacaaaaacatacaaaagcaaaataatctgaatttgtccttaatgcaaacttgggaaactacttgtaatatctatagcatttttacgtcttcataacctactgcagccagctcgagggttataatttaattatttttgttatttttattagaatattaatattttctctttagaattttttcagatattttttcagacttaaacaattgttagatataattacaaaggaagctgtatacttgtttacatcttcatggagatgtttgctacttacacgttaattttgcagttaggcaagaaattgattttttgctcacttatatagttgatgtctttccatggaattcttccttgggttgttttcgttctgactctgacccctggtggttaggtcaaaactaagcactgaactgctggttttattaatagatgaatttagagatgctagaagcttaaatttgttgtctaaactaagaaatgtacttaggtttgtgccaaggaaaatagaaacttgttaatgctaaacttaatagatgattagtaatatcctttttgatttttttaatttggtagtcacatttctttgtttctttgagacttattttcgtatggtggggaactgagtagaagagtcgatgctatggagaatcgcaaccttcctagctttatttctatgtggcttcgctaacagtggaaatttgcaataaattttaattgatgaaaagtattataaaataagcctactcaggggacaagcccagagtgcaattggaacttcctagtcccagttatagattcctagggaagggattcacagtgatgtggctttactcagctgtaaacaaaggagataagtttcaagatgttaataatatcattgaaacctacacctagtgatctgatggattgaggtagaagaaagttcaaaaaaaaaaaaaaagcaagttttgtaggaaggtcagcccccatgaaatgtgcctataactatagaggttcgagagaaactaccatgaaaaactcaagaggaatttttgaattaaaataaagttatagtgaagaagttaacctttatgtttgtgaccttcggcttatttagaggtgatttacaagtaaaagagaaaattcagatttatgttttctttctactgaagatttccaaagattggctgaaggaaaagtttgagatttgtattagggtgagacaattaaaagttgaataaacatattggcatactcaatgactattttgttcattgcttttacatgtgaatactacaaagcagcttaacatggatattgctatatagcattcacttcaggaatctcattgtatgcttgctctgtgttcaacatagtgcaggatgcgagatgaataagctatcatacttggatgactttctacattattagagattcaaaaaaatgcttaaaaccattataactggggtatacataaaagaactttgatgtctcagaggtgatattttgatcggaagattcaagaaaagcatttgaactaggcagtttttaagaggcagacaaaaaatgagggaaggaagtcaggctaacaggcatgtactgtaaaagttgggagggggggcggagagagagagtgtgtgtatgtgagagagtccatgtgtgttacacccatacatctggagagtttgtgccataactttgctctactttcctcagtttttacattatctgaaatcttactctatcatcataaaatagctgccagtgaatttcatcctttcttattaatatccagtgggatggggagaggtgtgcatatgtgtgcaagagagacccaacatgctttaatcctgaagatgaattaaaatttccttttttaagtttgggcacagatactgtattagcgcagtcaatctggaataatcatttatttaaccatcaagactcttcccaggggctgaggacagatccccttttcctgatgactgaaatgcctcagctgaatctggattctgttagggagaagaaagggcaaaatgacttctaggaaggctctcaacaatgtatactacaggaggtataattccaggttatggatggatccttaagctgcactcagcagtttactcatcgtgtattgatccacagttggtgtaaatttttttttatcatactgttgcaatctggtttggcaaagatgactccaccagcagaattaaaattaaaaaggaagagagaaaaagagattggagacaagaaaactgatatacaaggcctgaactaaggcagaggaaatcatctaaatgtgctttccttcttaattgtattggagacaaaactattatgttctaggatttttttctctaaatttgtaaatattactaagtaccatatttaaacataaaacaatagaatattccgtaaagcaaatttagaatttacttacatttgtgcagaatggctaattattagctgcctaacactcctcctacaggcaaatttataaaattacatcatttgcttataaaaccattttagtatgcatattggctcaatatttatgaaaaatatttcttgaataaacctgtgaatatttgaaaagttttagtcttcctgcctatcttacagtgttatttttgtagttgaaataatatatttgaaactttgtatattatactacagaaaggtggtcataatactgttagtttcagtttcaaaaattatgtcatagtaagatcgaattcgtactttatttgaaagtatatggaagagtaaagcagaaagaggacatatcttctgcatgtccagtgggacattgttttaatgtatccttgtgtgaatgggtgagtccaaatggaattggaattacaaaataaaccctatatgatgagttaattaggaaatagtgctatataaatatgaagtataatatgaagaattacagctagatatatacactataaggtactgtaattttttcataaatttattttaaaaatggatcttaccacattaataaaaacacacttctttcattttgggttgtgctgaaatcctaactacttctgaatatagatcagcatcttttgaaatatttgtgctaaagttgcatccccactctgctaccaccaccaaggtagtatcttatctaatagcatcagaaaaacttccgggagaacctggaaagaattattttttcctaattacctattcgtacacaaatcaaagaagagtatgaacgataagcccatgctggcatatgatatcatttctcttgcttctgaaacaaagcaagttttagagattgtaccattaaaggtgtgacagatattttgaggatcagagatccataggataattcatagtacaatagagtgaaaaagttaaggcagcagagaaatcagactgaaaagaactttcgaggccatatggttcaatttttctccttgtgggtggagcacaggtgtgtggcactcaactttggcttggccacctacactagaggcagagtacgttgttactggacaatactgtttgacattcttatgaatgttcagagttactgtacctttgggcagattagaaaaggcacctcctctgtgctgacttacaaaaaggtgccctttcttccagactaattcatcctttgcttataaaaccatttcagtatgcatattggctcaatatttatgaaaaaaatatttcatactttcaaaatattcatatttcaaaaatattcagcccaaggtcactagattcagcctaaagtcatttgttagattgcaaatccgtcattcccgttagccaagtacctttgtgctaggcataaactgtacaaaatgagaacttgtcagctgacattcgcctctttgtaatttttatgtactagagttaatgttatctcttgtagtaatatgaaataaatgtgccccatctattgtataggagtcattgagatatttgaagagagatatcctgtctgcccctcatctcttgttcacgataggtacttccatcgccttcagttactttttgcattaacagagctgctagaccttatcatggtcattatcattatcatactcaaagacatttatctgaaggaaaccttgatctctgccagctcagggctcttgggagtgcctagtcaccagataattttacctcctgggcagagttgtcaagaaagtggtgtttgttatcattttccccttctttctcctaaaatcacgcttctaacatggctgttaacaagcctcttcatagtgtttctctggttgtttatggctctacttgaagccttccatttcttggaaatgcctcttgcctttctaaatctcacccagcagaaagctaggccatctaatgaaactgtgtcacaaaagattccagtagcctgaggcatcactccttccaattttacctgcattttaatacaaaatctgaaaagtaaatgttcatgcatcatatctagctagagagaaagataattctgtgtaaaagattctttttgttacctcttaaataattgtgggtgtatatggccagtcctgttcccagcattcagatgtgagttaggaagttggaactttatacctggggacgatgaagactcactaatggggtatatacaaaaaagtgatatgattaaatatgtatctgaaaatggttattctggctagagtgggggagaggtttgagggagacaagataaaaggctattgtagtacaggtggagtatcccttatctgaaaggcttgggaccagaactgttacagatttaggatgtttttagcttttggaatatttgcattatacttaaccacttcagcatctctctaatttgaaaatcatggacacaggaaggggaatatcacactctggggacagttgtggggtggtgggaggggggagggatagcatcgggagatatacctaatgctagatgacgagttagtgggtgcagcgcaccagcatggcacatgtatacatatgtaactaacctgcacaatgtgcacatgtaccctaaaacttaaaagtataataaaaaaaaattaaaaaaaaaaaaaaagaaaatactccaatgagcatttactttgaacgccatgtcattgctccaaaatttttagatgttgaagcgttttggattttagatattctggttacagatacttaacttgtctacacatgaaagatatttagtgatcagatcaatcagctaatttagggaattagctgggagaaatggaggaatgctatggcataatttaaagacagaaacaactggccttggccatggagtggttctggagagtggaggaaagggacactctagaaagaagtcattttcctgtcttggggtagatgatggaacacaaaaagaacaatatatttgagagagaatatatttgaaggtatacataatggattctgttttgagcttactaactttaaagtacctacaggacaggaaagaaaatgacatttcagtatcatatcccacactagaattttatcaccaaaccaagaaatgtttccttatgtccaaatcaaatctcacctgattttatttcaggtgattttctcatcaacattgaatatcaaccttaagactttcttgtcttcctgaggaagttgcatttgcaccaaagaggggagggggaaattcccagcagtgagaattgtgttcaaagacctgtaaactgtgaaggcttcacatctcctatttagaaagagcacaggttggcaatctcataggaaaaggcaaatagatgaaagaagaggctgggttacattttttgaaattacatttatctagcaatcctttctttgtttgtttgtagggggatgatttgaatctggctgtcactgattccagggcccacaatagcctgtctaaatacatatttggtcctttctactatatttaaatagtaatccagatcactctttatccttttgcctaacattgttttgtataaccacctattacttcatattataattcattatttcattagcatatattgtctatctccagaatgcaaattcctgaggccaaagactaattcattttgttcattttgctaatatattttatagatgtagatagtcaggttcttttcattttgtttctttgttctagatctttgattttattggacttttgcaatgttacttaaaaaattgctattttcaggcaggttgcattagtgtataatcaaattccacccacaatatcaaaaaaagactattacaaattaaaaaaataaaaatagcattcaataataacacagttctaaagctcattattggatctgaaaaactttaccaatgtaagctttggtataaaagtaaggcttggtgaactgattcttagcataaatattttttcatgatattcttatttttaatgtgtatatgtaagatgttttattttgcattttaaggttgtaagtacttgctgtagttataaatgaatgatcagcacacatcttctttgataacctttcaactttattaatattaatgtttcatatgtagttttattatggctttcttctgattggaatttaatatagagaggttttattcatgtgagtgttaatggcattttgaataagctatgggagaattacaatgtaacactgctggatacagaatgattcttttagacaccaagactaataatttttaacaatatcgaaaaacattgtaggaaaagcttgaaccatgctggcaccagggacagacaagcatgaaagattaatgtaatcttgcatataatgacacacattcttacacaaaaaatccatctgcaatgtcatgtcagtcagcagaaatctttgatgggtggatacagctgggctgtctcttctggcagagctgccctggaaaatgctaaatgtggttgtgatgcttggtgccatctgcagtgtgcccgtttatcctgtcttcactggcatttacgatactgcatagggcatcagtgactgtggagacagcgatacagagtgacagattcatttcctcggagggtctgagctctggtgggcctgtgtgccaccctccttcttgggtctgggtctcttataattggtgttggctttactttgtattttcacatccaactcttcctctttttagtctaacagttccagtacacattcttctggtttgtaaatcttacactaaccttttgactaatttattcatgtaaggttgccaaaccgatttaagattgactgttcaatgccagctaatatgccttatttccaaaatactgctcctcctaagcctctgatttaaaggacatgtgtcttatttagggaatactaaacaggcaccaggacaaattgggtaaccactatgcgtgggatattcccaaatgactttatgtagttgaaacaaatatatgaccttctcttacataaagctataaaacatcaggccagtaacacttagtcctcttgcccatgattaaaatataaatattcaagaataaatgctgttttatgacttgaccatatgtttatcatattattttgccagaacaagttaaaaagtgtgatcattgtttaaaactgtcactttgtgtatgtgtgtgtgtttttttaatagtaatggaatatgaagggcacgctctgtcactgcttaaggaatgtgaactccagggatttgatgggtaggttatattattaatcaatatatgttatatcatttatgtattaaatgccttcactagttttagctacatatttggaacctaacatttaaaaatatttgtagtgtatgtactttggctctatcttgttcatatctatgtaataataattaatgataatatgacatggtcatctatctctcaggatctggcataggaaagcaaaaagaggaatctaattattaaaatactgggaaatgacagtgtactactctatacttactaatgtgcatacatttgcatctataattatttgcttttaccatatatctagagaagcactaatggaagatgttatactggtcacatggcataactatatgatgatcttcttttgcaaattaattgataggtttaatagctacccattggttaacttgtctgtgatagattgagggaagatattttataaatacaagtaaataaatacattatttccagaaacaataagaaataattttaattatctcataatgtagtgactacaatttaggtatgttattcacagtgggcatcggaaaccattgttcgcaatacattggagtgtacagagattgttcactggcatgcaaacgttagaaccaaggcaagtgatataaatttcattgccattttttaaaattaggtgaaccaatttgctaaagtgttggactgatgtgtaagactaaaacatattatattcctttagggaagttctttttacgtgagtagatatttgagaatttaaaaagttgacaagtgtgtgaattatttgtgttacatggtgatgggcagggggcaaagacccataaggtcaggaaagggagttaggtctgtactttcaccaaagtgaaaggcattaaccttcccaaagactgatttgaatgtgctggggagggaagtgatgcaatcaaaatggagtattggcagggctgtttttcagaaatgcttatttatttatttattttttggatgaggagaaaacaatagctgttgagaaagaaaatgtggtaagtaaaacatgatttttccaaaaggaatctaattgagggaagtaaatctagatagcaatattatataaacattgggaatcaaaaatatggggtaggagattacttcagaactttatacttagaggtagacaaaaacattaataggcttcatttagaaaattgtcttacaagtatacaatttaagaaaagtccttgtgggaatcatgcataccaactacctatttgaatatgctgcatagtccctcactagacctcatgagtacatgaaggtagctgcattgcaaatgagtacctgcttcaaaacttgattaaagaatgagaataaagatatcacagatattaaacttgttcttacacagcagcattacagaatgttctgctgaatgcagtatctatcaatatgttttactggtatttgtactgggtaaagggatgaaaagaactttgcagaatgaagaaagacgattgctgaagtgtagtacaataatatttttctctttacctgaacatatttaatccttatttatttttcatggcaggtgttgttatttttcagtgtagagctaaaagatgtatagatttttcagttattatattttataaaccaaatagtttggcctaaccattatatgaattgagttatgtaagtgtttctaaactctatggcatgctgatttatttcagacttacaataatttcaaatttctactgaaagtcatcttccgtgttctaagactctttaaatcaggggtccccaactccgagactgcagatgaatatcagtcagtggccttttaggaactgggaggcacagtaggaggtgagtggcaggagagggatcatttccgcctgagctccacctcctgtcaggtcagcagcagcattagattctcacaggagtgcgaaccctattgtgaactgggcacgcgagggatataactggtcatgcgagggatctaggttgcgtgctcttgatgagaatctaatgcttgatgatctgaggtggaacagtttcatcctgaaaccatccgtctcccaccccaccctgcagtccatggaaaaattatcttcccacaaaaaagtccttggtaccaaaaaggttggggaccactttaaatagcttatttatttttgtggggtcagttttcccagtagaagctgatatggtagttggagtaattatcttaataaactggcaattttaagtcactgtacttagaattacatagagagatatatgaggagaataatagaaacatagtttcttcaggtacttcaaaggaacaattctcttgcaagtaaaattgtttgaaaatggaatattctacattggtgagttttctattcctgaacctgttctaaagagtggctaaaggaaaattttgggggaaatttatagaaaaggtgcagagatgagagaaggttaaccccaaaatgctatggcattttgatgagagacagactcaaatttctttaagaactttggcctgaagcacctccgtctgacactagtggaactattaatagggagtgattaggaaatcacctaacagtttggtttctagatacaggctgaagaagttaagagccaagaaagattctatgtatagtatttagtaaagcaaaacaatttggtaagtaatgtttaagaaatgctatttcctaagattttggagttgtatttattttttttaatgaattacatatgtttctatgagacatcttgtgacatttctaaacccaacagaaacagtgtatcagcacttatgacagctagttctccactgcagtgtgtcctaggaaacactctaagatccactgttaaaccttatgagagcttcagattctatattgctccctattttactgggcatgagtaggaagttttaggaaggaaaataaaagaatatcagctgcatagacttgaagcagtaacacttgcatttataagtgtgagtatagttttaaaaatctatagattttatgcaattgtaaatatatgaattcctcgctattaatatttgtttcagaatttttaaaaaaattgttgagttacttttcttttgttcatttcaccattaattagacccataatgttgtagacattatttggattatattgacattttatcagattgaacatatctgtattacttagtaaggtaaaaagcaaaaacaaaaacaaacttttccagaaagaaaaaaaactgtgaatcaaaactacaacaatatattgaacatttcatagatgatgggttcatagataagtataaaaacattcattaaaaaaatctttatcactctttgaaaaaggatatattatcacccagtgtttcttttctagacagaataattctgtttggagccatggcaaggagtttacttattttaaaaacaagatttgtcacatgcaaaggattagttactctaaggtttatgttttagagtgacacaagtgtgattaactcactataaatgattgaatactttgctttttgcctttcttgtatatttagactcttgtgatatttttgtaagaagctgttgatgaaaaaaaccaaactgtaaaatatttaaagaggtttattttgagccaaatatgagtgctcatggcctatgataaccccaggggggtcctgagaacatgtgcccacagtagttgggttacaacttggttttatacattttggggatacagaagttatagccaaagacataaatcgataaatgtagggtattcattggtttggcccagagaggcgggatatcatggagctggtgggaaggggagctcacagatgaattcaatgattttctgattgtcagttggttgataagctttgctgaaagattagaagtcagcagaaagaaatgcttgagttaagataaatggggtggtgtaggctgggtgcagtggcttagcagtggctcacacctgtaatcccagctctttagaaggctgaagaggggagatcacctgaggtcaggagtttgagatcagcctggccaacatggcaaaaccccatctctagtaaaaatgcaaaaattagccgggtgtgatggtgtgtgcctgtagtctcagctacttgggaggctgaagcaggagaatcacttgaacccaggagggagaggttgcagtgagctgagatcacaccattgttctccagcctgggcaacagagcgagactctgtctcaaaaataaaataaaataaaataaaaaattataaaaataaagataaatgaagttgtggaagcacaggttcttgttatgtagatgaagcctccagatatcaggcttcagagagaatagatggtcaatatctcttatcagaccttaaaaggtatcaaactcttagttaaatctctcctggatcaggaaaagacctggaaagggaaggagattctctatagaatgcaaatttctcctgcaaatgatagctttgcagggccatttcaaaatatgtcaacaaaatacattttgggataaaatactttgatttcctctagggcctgctatttgttatttaatgctataccagagtcaggttggagttggggatcttattgctaccaagtctgttttgtcagtcttatgatctattttttttttttttttgagataaattctcaccctgtcacccaggctggagtgcagtggtgcaatctcagctcagtgcaacctctgtctcccaggttcaagcaattctcctgccccagcctcctgagtagctgggattacaggcatgcaccaccatgctcagctaattttttgtttctttaatagagatggggtttcaccatgttggccaggatgatcttgaactcctgacctcgtgatccacccttggcctcccaaagtgctggaattgcatgcatgagcctggccaatgatttacatcttaatgccagtgctggccatttgcgcctaaactccaaaagacaagagggtataaggaggcatatccaacctcccttcctgttatgacctgaatagtttttcagattttctttgtgaccttcatggccaaaaggggaggatccattcagttagttggcgacttagaattttatttttgttttacaaaacttatttcctaggttgagtcactttacctgaacatgatcttaatgattgaatagttgttaacataaataaatacatattttttctaactcacttaatttcacactggttctactggtaaactgtttttcaaaataataagattctcataaggctatttttattaggtttcatatatagaaaaggtatctaatatattgaataatattgtagcttctaagaccaaaatgtcttatttcaaatccctgttctattacttactagtggtacaatcttgaaaaagttactttatctttctatgttttagtttcctaatctgcaaattgaaggtaatattacctattgcatacagttatttctccacttaaatgagttaatacatggagagtgcttaggaaaatgtctgatatatatatatagtaattattcactaaatatttctttattgttataattgtcatttgtattagtttcaaaagatttaacacagaatgtattatgacaaaatttcagatgtttcagaacatgctcatagggaggccacctctaataactctagcaatatgttaacatatgcatgacgctataattgtatgcaacattctaggagttaagtgttcgcatcctatgtatgtaagggtcaagttatttggtgctaaattagatttttttgggtatgactccacatagtctttttggtcacacccatatgtcagcatttagacagccatggattgagggttacgtttaagttcacagattagaaatctcatagagatttttgaaatcaggtaagtttcaagtcaaaccttggtttttttcattcataaagatgggactgtggcctattttgcagacttctgaggatttaatagaaattagtaaacacattacctgatatatagtttgtccttagtaaacatcattccttttctctgaataggtggtcatattgcgaacctctggaatcagtttagacataagaataaaacacacctaatcaaacatgacctgggtcatatcttgagtcttctaaccagagtagccttggattgcccaggctatgtggagctagtgggatgaggaagatggggactagagggaatagatggccgagagaaagatggtgggaactgactggaaagacactttcagcctttggtcaccaccctccagagcttcctaaacttagagaaccagtaactactgctgactgtggcccatagacagttttgtttgaaatagtgtttttaaatatattgaatgctagttgcttagtatttacaaattaggagactcagccttaaatcagaatctctggcttctgtagaaaaaccagatctgggtccattaggcctcacacgtgatgtgagtgggccacagcaaagaagtggctgcgcctttagattgagcctactcttccattcctgctgggcccttgtagcccttgagttgtgacacctgctttcactgaggcaaaatccactttccattgggttaactggtgacattttgatacgtaagaatattttgcttcttttgaacataaatgattatgaaatgaatttctggtacttctgtgttattttaatggattctgcccccatagtctacttgatataaagtcttaaaaaatatactagtagtactatctaggatcaaaggctaatagtattacatctagaagcaccgtatagcaataatgtcaaggagatgaaattcaggtcaggtttgtaattactacattcatatagtaatgataattagcagtttcttaaagcttcatattttatatgatttttattgctatctgtcttttcagagctttattgagaattagcaggattttatgactttggttggtgttagttaaatgaattgcagatgacagtattattaacaagaaatgagaatgatatgcttttggatgttaacagagcaaaacgctggtcagatgtgaattaacatgttcaaaagttttcatatctcttaacacacttaaagctattttgtctatggggaattatctagttattatatttgtgaagtaaacttacctgtgttgtgtttgtgttgtcttacccattgacacatattaacatgtttaaaggtacatgtgagcagttatgcacatagactacaaattagtaaactattttgaagtctagatttcatgacttattaccaatcattctgaagttttgccttctttgcttgatttgtatttttctagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggcaagggagtggctacagattcattaaactgacccttctccctcttttcctttcttacttgctaatctagacagcacaacacagaattaatgaacagactttgaaagatccagacttctggcatccccactagcaaatgtgagacttttgacaagtcatttaatctctttgagccttatttttctaatctatagaatagggatcacagatatattattcactttattacaaggttattgtagtactaacgtttggtttagtaaagggtttaatatatagttaaaccatcagtatatggaatggttattattctcccttcgcataaaaaatctgttgattacacagtaccaggtaagaagtttcaaaacagggccactccagtctagctgcttacaattccatatgaggtgaatatggtaacttgcataattgatgtataaccagataaccttgagaatgccaaaattacttgtgactggaagggaggataaggtttggaagggtgagattcttaagggcaaggctttttaatctttctactcactgccatttttcagcatctagaatagactatgccacagtgatgctcagtgaagcctattaagtgaatgcatgtaaagaagactttatatagtaaatgacacttggattaggtcttaaaatgggttggagctggcctgaaaaggtgagaatgagttattttcttggctgcaaaagtaataaagcaaaggcaaaacccaggagtgtttgaggaatagtgaaaaggccattcagtggaagataatggtatcaaaataggcccaaccatggaggctcctacatgccacagtaaggtctctgaattgtatttgataagcagtagggaataatgggatgtttcagagcaagggggcaacctgattggagcttgttccaggaggattcattttgcctcaccgtgtggaatgattagaggttgggagcaggagaaagtagaggtcagagacacggagaaccgttagagcaacactgtgatccagaaaagagggaaacatcattcaaaagctgattgtattacacaatcactcatccctatttaacgaacggtgctgggaaaactggctagccatatgcagaaagctgaaacaggatcccttccttacaccttacacaaaaattaattcaagatggattaaagacttaaacattagacttaaaaccataaaaaccctagaagaaaacctaggcaataccattcaggacataggcatgggcaaggacttcgtgtctaaaacaccaaaagcaatggcaacaaaagccaaaattgacaaatgggatctaattaaactcaagagcttctgcacagcaaaagaaactaccatcagagtgaacaggcaacctacagaaagggagaaaatttttgcaatctactcatctaacaaagggctaatatcctgaatctacaaagaactcaaaagaatttacaagaaaaaaacaaccccatcaacaagtgggcgaaggatatgaacagacacttctcaaaagaagacatttatgcagccaaaagacacatgaaaaaatgctcatcatcactggccatcagagaaatgcaaatcaaaaccacaatgagatatcatctcaccccaggtagaatggtgatcattaaaaagtcaggaaacaacaggtgctggagaggatgtggagaaataggaacacttttacactattggtgggactgtaaactagttcaaccattgtggaagacagtgtggcaattcctcagggatctagaactagaaataccatttgatccagccatcccattactgggtatatacccaaaggaatataaatcatactgctataaaggcacatacacacatatgtttattgtggcactactcacaatagcaaagacttggaaccaacctaaatgtccaacaatgatagactggattaagaaaatgtggcatatatacaccatggaatactatgcagccataaaaaatgatgagttcatatcctttgtagggacatggatgaagctggaaaccatcattctcagcaaaccatcacaaggacaaaaaacgaaacaccgcatgttctcactcataggtgggaaatgaacaatgagaacacttggacacaggaaggggaacatcacacactggggcctgttgtggggtgggggaaggtggggagggataacattaggagaaatacctaatgtaaatgacgagttaatgggtgcagcacaccaacatggcacatgtatacatatgtaacaaacctgcacattgtgcacatgtaccctagaatttaaagtattatatatatatataatatacagccttatgaacatatatatatataaaggaaaattaggcaaaatagcattacttgaggtactcaatagcctggcagagcagacattaagggtaagagagactggacttgaatttcagtttggtacttgactttgggtgggtaattagcctttattagtcttgattacacatttaaaaggtttaataaggccgggtgcagtggcttatacctgtaatcccagcactttgggaggccgaggtagtggatcacctgaggtcaggagttgaagaccagcctggccaacatggtgaaaccctatctctactaaaaatacaaaaatgagctgggcatggtggtgtgcgcctgtgatcccagctactggggaagctggggcagaagaataacttgaacctgggaggcagaggttgcagtgagctgagattgtgccactgtactccagcctgggcgacagagcgaggctgtctcaaaaaaaaaaaaaaaaaaaagtttaataatgtccatccccatagggccattacaagaatcaacttttaaaaagtcacacattatcactaaaaaagcaaaatatttttccctatgattatagaaaataatgcacattgttgaaaaaaattcatattttgataaccctattcatttagtatggattttagaatacttagtattgttgataagttgacagagcataagatattcaaatgcccttttagagtgtaaagtctttcagaaagtcagaatttaaaaggagagagatattcagatataatctgataattctagagtatataggaaaacctaaaatggtttctaagtagaagacaccaagatgattttgactcaaagagaaaaatgatgcattttgggccatcttttcatggcattttatttcttgacctttttgctttactttagtagttctgactataatggtggaaactttccaacatttccttccatgcaaagtggatgtgcttaggacacttcattagtacttaaattcctgaggtcattcattgactgccatacatcagaaatagaaagatgggtgtccctacaggtatgcctttgacataaatttggtggttggctataaaaactggtggttattcttatgttttagtatgtaattcagattttataaagaaatagcatttagttttatcactattataattttgaagagtatttctgatttggggagcattttatgtattctttggatatttgtagtaatgccattttaacctgtcttgtttagaagacacagtatgctgccaaaattctggtcattgcataggagttctagcattctaattccatctaataggaggggaaagtcatgtgtggggtatatttaatatgatgactgtatgcctagtcagggcttttgatagagaatgggaactagaactaggcaggaagttttcaagctgaacatgaggagacagtgtgcctttgaagccatttgcctcctggagagagacacccagagggagagtgtttagtaaattaatccactgagccaacagactaagctgctgaattatggtcagactcaaatggatcagatgtggagaagcctgtatttgaactgctggccattaggaatggtgtttgttgctatgggaactggtgctaaggaactatactgagagactctgattaaaagggggagggggaatggagaaaaaagcctgagaggacataaaaataaaaaagcaatccagttgttgtaaaacaaggctcaagccacatactgatggctgtgaaccatatattcctatagagtttgcataaataaattcatgctttccaattaatttgaggagaataaaatattgccgagggactgttaatttctatgatatttcaggcaaagaaccaaagtgtaggtgccgttttcatgagaattttagatatgcttgactaggaagtcattacatcacatttatctgtttggatgtgggagacattaacagccttatgaatattcatggtatctggttaattaagttaattgttctgcagaagtgcttgcacttccaaggacattttttttttttttttttttttgcctccatagtttctccctggtatttcatcagtaattctttacatgaactgctacttctgtccttacttttttgtatttggaacattttagcagctctcaggaggaagtggtaggcaaagtttctggtagtgttaagaaaaataactttcaggctaattaaaatgtttaccttgaggtagaacatttatagcttttgtgagaacattaaaattacgccattgttatttatgtgagcagcatgttcttttggcatgtagacatcttttcaaatagagtacagtttcctgaaacaaaatgtaatccatctttcagattatcccaacaaaatatagaacaagctatcgttttgcaattttacatatactttctcataaactttccttttttcttcagagtgtcaaaaaccacatttaaagactaagatacagattaatgagtagtcaatgactaaaataattttctgacttctagtcatgtctgttatcactgccaacttctacagaattagagaaaagttgcaaagcctgagaagacataaacaatttttaaagccatctctagcattctaaaaaaattttgtacttgggcatacccaccgtacttcaaactcacagggaataaatggtctttattttcttaagtcatgatatgtgtcattctctattgcacatgacattacattatgttttttaatagcctttctagaggaatgcttttacggtctactcataattaaccatggtaatggaggaaatgtgtttcatggagtactgtaatccatcgataatcctaaatatctgactctaattatgtggcctcctccaaaatctttaccacaaatctgattgggaagcacaatggattgacttgtttcttccttttctcctgatccattccagatttattagcaattagatggtcaaagggcaggctgtagagggccacaagatcattggaaagaccttgataaagatccactgagtaacaggtttctacactacttgttctcaaaacttagggtccatagactcaccttgtgaacttgctaaaacagagatacctgggtcctccctcctccaaacacattctgagtccatgagttggaggtagaacccaggaatgtacgtttttaacaagctcccaggtaatgatgctgcttggaccatgcattccagaggagtttctcaccaagtcactgtgcatacaaaccacctggggatctaataaattgcagactctgaatcagtgtgtctggaatggggcctgagaggcaacattttaaaaataatatattttttacttccattaatactgctattactgttttaatacctattatccttatttttaaatggacaaaaattgtatgtatttattgtgtacaatgtgatgttttgaaacatgtatacattgtgaaatggctaaataaagataaacatgcataaaattgacataatgatcacatactgattttacattgagaacacttaaaatctcccttagaaatttccaagtatataatgcattgttactaactattgttttagcctgttctcatgctgcaataaggaaatacccaagactgggtaatttataaaggaaagaggtttaattgacttgcagttcagcatggctggggaggcctcaggaaacttacaaccatggtggaaggcaaaggagaagcaaggcacattcttcacaaggtggcaggaaggagaaatgctgagtgaagtggggaagagtcccttataaaaccatcagatctcatgagaactcactcactatcacaagaacagcatgggggaaaccacccccgtgattcaattactcctacctggtctctcccttgacatgtggggattatggggattaaaattcaagatgagatttcggtagggacacaaagcctaaccgtatcaactgtagtcactaggttgtataacagatctcttgaatttattccttttacctgaaattttatatcctggaccagtatctccccagtccttcccacccattagccccagtaaccactattttactcttcgcttttatgagtttaagtttttcagattctacataaaagtaagtatttgcctttctgtgcctgtcttatttcacctagcataatgtcctccaggtttatccacgtgttgtaaatgacaggacctctttaatgccaaatagtattccattgtgtatataaacaggctgattgtccctaatctgaagacttaaaatccaaaatgctacaaaattagaaatgtttgagtgccagcatgatgccacaactggaaaattccacacctcatgtgacaggtagcagtcaaagtgcagtcaaacctttgtttcatatagaaaaatattttaaatattatataaaattatcttcaggctatgtgtataagatgtataaaacttttatgtttagacttgggtcccaccccccagatatctcattacaccaacagtgtaaaagtattcccatttctccacagccttaccagcatctattgtttattgactttttaataatcgccattctgactggtgtgagtgtggttttgatttgcatttctctgatgatcagtgatatttagctttttttttatatgtttgttggccacataaatgtcttcttttgagaagtgtctgttcgtatcctttgcccactttttgatggaatttttttttcttataaatatgtttaagttccttgtagattctggatgttagacctttgtcagatgggtacattgcaaaaattttctcccattctgtaggttgcctgttcactctgatgatggtttattttgctgtgcagggattgttttcttgatttctttttcagatagttgtaagtgtacagaaatgctactgatttttgtgtgttgattttgtgtcctgcaacttaactgagtttgtttattagctctgacaattcattcatggagcctttagggtttcctaaataaataagatcatgcctacaaacaaaggcaatttagcttccgtatttatgatttgcaagccttttatttctttctcttgcctaattgctctggctagaacttccagtactattttaatgacagtggtgagaatgggtattattgtcttcttgaggaacaagacattgtttctcaactcatgagagtaattttaataagcactcaagtattgtcattcctgtttgacagtaggccgtattttgagtaacaagggtcacagcataacttgccttttggtgaatcagttggaaccagtttgccatttagttaaaataaacttttctttgcactggtattactagaagtaattgtgcttatttataattaataataattaaatatgcttattcttagttacctaaaaaattatgatattaatgacctcttggttgataatggctaagctgcctcagcttctccaatttagcaacccaagtacatatcagttcaaagtaacacaaattgaagcaattatgtatgatcacataggaatgcttctgattaacaaaatccagaggactggtctttgccttcataaccggaacacaccacatgcatggtttcacagctcttggctattattggacttacttattatattctttaattcaagaaaaattgtagcttcattcattctgttcttaataattttaaattctctttagcctcctgggaatgggaagggctagctggtatagtcccctgtatctcagatttcagttacacataaacattaaaggggcctgacttagggcgctctttgcctctgtggactggtggggaaaatccaggtgtgtcttaaattctaataatcatgaaaatcagaaatcataatgtttcaaatacaaatcttcatacatgggaaatacaattgaattaaacattttcttcaatgtaggagacatttgtcagataacagaggggattctcatttggctaagagcttacctctaagattcattaaatgtgtttagagcatattttttgtagtttgtagttattttatttttctgagttattatttggattattttctcttttatttatgtatgcatttgtcactgctccccagaggcacctcattttggcattgaagctaaaaacccattcattaaggttgggatggagtgggctttgatatagctagcatttgggaggtagaaaatagacattcgtgatcaaaaaagctgtaagcggttactataaactatttttaaatttctaagtattttaaatattgaacaaatgtgtagacatttgatgtgcatctatactgtgaataagaacttaaacttctaatattcacattaactttcctgattttataaattctcgtttatttttcatctgaacattgaagaatgacatctacataaagtaaaagcaaatgttagtttgaacacattctaccctaatagtgcatgttttaaaattgctttggcaggatctaccaatgtattggcacattctcttcatggagttcctcatgtgataactgcaacattgcacattataatgggtaagaattcttccaaagcagttcatattttataaggaaatgttgatttatataaggaaggccatcttatttccatcagactttaagaaaaggcaggttctttgtctcttagagtagagaaatgtttgactaaaaaaccaaaaggcaatgctttactatgtggattgcctgtcttttcaaaatacttgctttgtaaagagcagtaaatgaagttttattgtaatctgtacagaaaaaaaatattgtagtgtgctcaaaattataattttataaccagatgaagaacattaatgaatactccttaagtatatccaacactgatgtaggactgtaccaagactctaggactaggattatgttattaatgaaaaaacataaccagaaaaaaatttcagccagtagatgtctatagatattttattatccctattggtaaaaagcatataagctcaggtatatgtaacactaaactactgttaaatctgtgtttaccttgcctatctactttaacttcgtttctttgaccatgttttataggaaatagcaataagctgaaaaatttagtactctgtgtttcttcactagtacctgaacaagttaaaaatggtaattattgtagttataggtaaagggaactgaagagaaagtgaggatgttcatggtctacagtacctttagatattctcctataagccaataaatatgctctcttatgtttgctgttttgatacaagtcctactgtactcactgattaatatttaatgtaatattcaagggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaagtaagtctttttcttaaaccaaaaattgtatcccaggttcaatgactgttaataacaaatttcattacattttagggcagaagactgtgaaatatcatttttaccatttaacagctctgatgatgtgcaagaaaggtaggtaaaaactcaatgtaatacagataacctgtatctttaaagcataaaacattctgacaaacaattgatcagacttaggatctttggttatttttctaacatagtagtaaagaatatagaatcacagactcttacaggtcctagtaagcaaacaactactcactcagcctttttctctttttccttccttctttcctcccttccttccccctgtctctccctccctccttccgttctctttttcccttcccttcccctttctttcctttcctttgtttttttccctttctttccttttccctttcccttttcttttgagtgcctactatatgccaggcactttgaatacaacaatgcaccaaaaaatgaacaaaacacacagttttgtccctcgtgataattttggtctagtgtgtaatacaaatattaaagccatattaaagaagggttatagtctttaaagaaatagtacattattattccttataatactagtttacctttaaatgaatcaacacattatgttggcagcaacaaaattgtacgtttttacttactatctaattgaagaaagtatttaacatatataatgatgagttctctaattttctcatatttaatagatttgtgtgtgtctgtgtgtctgtgcgcgcgttatctgttttatgtctttgttttgttttctttcttttaggagggcacagggatctcccaaatctggtgagtcgaaaagtatctccttgagaactgtgccaggttctgttgacattttgttctggtgagggaaaataaccaatcactttcattacctttagactgtaatgatcaatggcaaatgatccagggtcagttcttgaatgtcagcattatggcaattccttgcctgtgttcagtggcacctagaggcttggcacctaataccaggttagtaagcatttttattgaattgttgatacatttcttatagaccattttttttccagggtatccaattaactgttggttagctagaaacttaacaggtagtttatctttgtatattagagattctaagggatttgtcatcacagtaggttgagaacaactgttgaactggaataattatcagataatcattgactatttaacgtcactgaggctaaaataatatttcctaagttttattgatagaattttatgcctactttacttgatttattcatttagttgtggagaacattatattaaatactgatatttcttgtgaatgtctttgctttccaactttaatgcaaacataaatatccttagcatgaaaatcacacatatgtatatttgatactgtattagtctgttttcatgctgctgataaagacatacccgagactgggtaatttacaaaagaaagaggtttaatggacttacagttccacgttgctggggaggctccacaatcatggtggaagatgaaagtcacatctcacatggcggcagacaagagagcttgtgcagggaaactcctatttttaaaaccattagatctcatgagacttattcattaccatgagagcagcacaggaaagacccacccccatgattcagttatctcccaccaggtctctcccacaacacatgggaattatgagagctacaagatgagatttgagtgggaacacaaagccaaaccatatcagatacttttagtcaaaagaaacatttcagttctatttaatgtgaatagtagtgcatatcaatctcctgcccacattttcaattgaataaaatatgagacatcttatatatatctttttatccatgggatatagacattccttctcttgcacattcttcttaatcagctgtccattatggggctgaaaatatttctttcctgaatccaatcctgtagagtgtaggagaaaggatcgtgagtgttgtgaaatataggcaataaacggggaaatattcaaagttagagaagaaaaaagagaaactgcaaacttcgatattgaaaacccagatggcaaggtcctcattaattacatctagtgctaaaacttcaaaggagtattttgaaccttgtgtgatttagaaattgagcctggtggttttccccgacaccttcagaaatcctagatagctgtgtgctttcataatgtagtttccctgactaaacttgaagacgtggctagctgaccaaggagctatgtttggcaggacttgagacaatgtttatctaaccctgtttgtttaaggaccttcttgggagggtagacctgctcttctgggaacaatcgattcatagctccttcaaagccactccataaatgttctgcttgactagaattccactgttgactctgcaggcttaatcagtattaatgaatttttcagagaaggatgactaattagagatttcttctgtggtttataatcacaacatgccatctttgcaaagaccttttgatcaagactcatttgaccggagatttttcagagatgtagcttctgatgattcaggatgattgaacaggagatttcactttcttctttttcccccaccatgataaataataatttatgttagaatatctcagtgcaaattgccagtaggaactaatattcttatattctaagtattctaagattaaatgtgttcatatatgtgagacatttaaagcagtgccagccatgtaagttgtgtttctatttcaagtaaatattgcaaagcaggcataggatagtgcttttaatgtttataaattatgcaattaaagatgcacagtaacactaccatgaacgttttggtgctgtttatttttaattgggaagaagaagcatgatggaaagcatactgagcacctggagtattggtgctgatgaccattttttctctgtgtgcctttgaacaaatcacttaaacttggagttgtcttttccctctacatgaaatgagcgaatgatgagataatctctaaggtcccttacagctctgacttgagctttcataagatactaagagctctttttttattttgttgttattcttaaattaacttcatgtttgcactgaaatcaagctagaagtcatttgtatgtatttctgcaaactgcattctatagcttgatgcatttgtgagtggctgttttggcactaaatcacacctctgaattttcactctcttatattggatggaacagttatgcaagattaaaatgttcagtcatttaactgaacatgtgtggcagcatttgttcactccatttcatccatccaaaggccactttgatttatttcatttcctatgtcacttagaccttctgtctataaataaatatttaaatcacactttagattttagaaaatgttgagctatttgttacacaacttgtgcatattaactcttctataatacatcttttaacaacatagtttcacatttagaatttctaattacattgtattttaaattatgtcttgatatgtgagtaggacgcttgatggtttgctttgtaaaatgctctaatgtaagagcttattgagaaggaagccagtgatttaataaaactcatttgaaagcctgcatcatttaaaaaatagcaagatacggtttatgaattttaggtaaacgtaacatggtgatttatctatcttgtccaatactttcagtaaacagtatacttgttataaggaacagtatgtcataatttttggtataatctcttagtaaatttcttgatgtctaatagaaatatttaatttcagattaaataatggaagtatggctcttataattgcccgaaacacttctcggccagaatttataaaacacctgaaaagatatgccagtgtaaaaaatcaggtatagtaaattctttttgttacttatttgcaaagctattaatcatgtagaaaaagatgctgcaagaattgacatcgaatcctgcctcataagaaggttttattttcttctgaatatattaatcttctttttcccaatctatttcatccaaattttgaaaagcatccgccaggattaatatagattggccttttttgaatgatgaattagtggttatgtatctgtaaccacaaagataaaataggaaatgtagtgttatattgcaatgtgaaataaattaaggataaaattccatactcaggctgttcttcagaatgaaaagaagtgaaatttgagagtttagccttcttgatattatggcagcagactttctaaagttatgatctttagatcttcctgacatttgtttgcatatctgcattgattgaaatagatctgtagatatgtatttaaaaatatgacagttttatacaaatattcattcaaaatgagaatatgtgaagatatacatttccacttaagtgatttgctttaaagagaaacagtaactattacaagccatattattttggcagctgttttgacctgattattaggaaaatgatccttgaactatgtgaatttctgaaattgtgagtctttgaagtacataggtatggttgtaaaaccctatagtttcacactttttctttttctttctttttttttttttttttgagttagagccttgctgtgtcacccaggctggagtgcagtggcgtgatgtctgctcactgcaacctccacctcccacgttcaagcgattctcctgcctcagcctcccgagtaggtgggattacaggctcacacctccatgcccagctaatttttatatttttggtagagacagggtttcaccatgttggtcaggctggtctcgaaactcctgacctcgtgatgtgtccacctcggcctcccaaagtgctgggattacaggcgtgagccaccacgtccggcccacacattcttaaaggtataaaatggtgcttggatagagttgggagataacagacgggaggaggaggagagtaaacccagccaatgactggcagctgaaccttgcttatgtaccttagccatagcaagtctctccatttttgcctcattatattttaaaactttcttaggccatcttcatgaagtttgatctgtcagtaacattatttgatcctcatgtattgaacaactaactgggctgcttaggaacttaaatcataaaaaattacagtcccactttctttatatgtcaaagtagatcagcaggtataatgtaggttgtgagcctacataacagttttatgtatgtgtttgggtggaatatggagatttattgattttcaaaggaatatatgccctttcacattttaataaatttctaaacattaaaaccaatttttaaaaaacccaaagcactatatattcattgctgtttttaagtcagaaaatagaaacaagaaaatgattttaaagcactcaaaattccatgttcctcaagattagtgtcattaccttggtagaattttttccgaatccttttttattaaataaatgagaagtaaagtaagtattaacctcattcatgtacctctatttgagaacttaaatagtattaacctattaatgtacccctgagaagttctgtatttattttggggaggtgtatgttgcacaaattgtttatggaaggtctcttttgaaattgcctatggggcaagtctctcaggcaatttttgtaaacattcttcttcttcatttttttaaatcaatatacctttcttctgattttaaaagcaatggttaccttacacataaagacagacatacagaaaataataaaaatctgtatcgataggaagacgttttctaagagataatattatgcaggatttatcatattttctcatgtactctacgaggcatatcttgcttttgacacaagaaacagttgcctgtgtgtgattcactggccttaactctgatttatttatcaactttcaaaaattaaaatccatgctattttttttttttttgcaaagaattctaaaatattttgcatagtgtatatagtaagaaagattgattcccagggtgactgctttcaagcaatgttaatttgatttgttaattatccacacaggtgtgtttatttaggctctttccttcatggtgacattaaaaatgtgaatttatataaattttgtaagattatgaaaatcagatctatgtaaaaatcatgtctactgcataattcatagcagtgctggtattcaggaaggaaaatgtggcaattcagtttaaggagagtaacatctgcttctctgaaccatttttaccaggttgaataagcgaatgttactgtataacactgtaaaatagattgaaaccaccatgtgcggagtggctcctgttccttccccatctctgtgtaaaattagatagaggctgaacactacccttcaaagtccttgcagctccatcctattgctttgccccccttctcactgtccacacttttctctttcattgtgaccatttttggtagggagtttaaaaccttaaatgtgagtgcttcccccaggatttctttgcagccctctcatcttctcaggatgccgtctcctggatggcctcattgcccctcacttttgaactgtctgaacatcatgcactcccaagggttctgtcatctcgtcttatctgcaggacctctgtcttcttgtatgctgaagaggttctgaaattcaccggcatctggaggccaacatgtctacagccgaccttatcttttcccctaaagttgttccttctgcgttgctctgtgcgggtcaatggcaccactttctacccatccaggttaccctgaactgttccttcttcctcattcctcactaccagtcccctaacttgttctgttggtctcctcttaaatgtttctaaaatttctccctcaccttaattcaaactttaatcctttcttgcttacagtagcctccttttggccttcaggttctctggtcttgtcttccatacctctttttagagaaacttttttctaagacacacattggatttctctcctgcttaattcttcagtgcctttctcttgttgtcagaataatatggaatatcctcagtctggaacacgtggcctttgtatccaggtccctgcctgtgttgcaaccccacctcttattaccaccctccaccacattcccagtgttttggcattttattcgttggctaaggttgccataacaaataccacagaaaagatggcttaaacaaacagaaatgtatttctttcatggttctggaggctagagctgcaagacaatgtcagcaggtttggtttgtcctgagtcttctctctctggctggcacatggctgctttctcacagcacccacaagtgagtggtctttcctctgttcatccccgatgccttttcctatgtccaaatttcctcttcttataaggacaccagtcgtattggatgagggcctaaagacatcattttagcttaatcgtctctttaaagatcttatctccaaatatagttatgttctgaggtatacagagcgaggatttcaatacaggaatttgagggccaaggggcatgatgttgagcacctaggagtcacactgaattctgtgtagttgcttgaccatggtttgcctctagttttgtaaatgcttcctctctccagactttcttctccaggctaaatcttatatgttctttaaggctcaattcaaatgggaagctttcccaacatccatagcctgtttgcctcctcttgtttcctctgttgaactccacacttgcaccatcatggcactcccctgtatcaaaattgtaactgtttacttctcctccccgtgccccaaacataccctcacacaggatactaagctcttggctcccgaaagtcccacttaacagcgtctgtggcttcacagttaaagcatttgaaggatggctagatcttcattttgtgaggagtgcacatgacaactgctgatttaagataatagacttactggtggtggctgtcaattcttgacattccttggcttacagctgcatccctccagtctctgactctgccatccttggcattcttctctcataaggacatcagtcatattggattaggtcccgccctaatgacttcatcttaagttgattctacctgcaaagaccctatttctaaacaggggacattcacaggtaccaggggttaggacttgaacatagttggggtggtggagggaaatataatttagatcataacaggcagttgtgtgttttaaatgaattatcaactaacatgaatgattatgtagataattctacaaggatgaggcatgtagccaaggctttatacccgaggtaggaggtctaacgcagttactgtcaaacagttttgcttggggccctctaattctgtacctcagtcacaacagctgatgccatcatatcatctactgtttaactgtgtttacagtataaactggaaagttggctggaccttggtatctacatatgtaaaatatgggtgttggggaaaatattagttttctgtcaacttttaaaactgtttcattgaggtttacatgtggaaaaggggaaaaactatgtagatgatgtttaattaggaatgtatctcatgtcatttttctgaaaactgaaatgagtagttatacatttctgctcaagttatttggctatattttcttaattatgtcagaaaatacatagtgctttttcagtatagtttccttaggcaaacaagaaaaaacgcaagttgaagtttaccttgcaccattctatagtggtaagtaaacagtgatcttgcagcttgtgtccattgttaaagtgggaatggggcaggcaaacaccttttaaaatccatatttgattggctttctcttttaaaagaagacatacatcccattttatcttcagaagtttagacttgcgttcttccaaattaaattccaagtgtgaaacttgtactagtttgctttatgtcagctaaactaattgacaagttgataatggattatatgtcttctgtatctacaggccagtattaaagattatctttaattgaaaaatctacagtatcactattttatgtaacttctcacagatatgtactatttgtcataaaacaagatttctaggtgctagatctaaaagaacccaaaaggctttggataagagattccttcttccaaaaaaacttggagatccctgttcatagtctcaaagctattaaaatgtcagcatacatgctgatatttacttgtgagagagggctcagtgaactttgattcgcgttagtagctagagataaaccaagtataatgattatttgtatttatttttagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattaggtaagtctatttatttcaccgcttattgtcaaccagtaaacataaatctaatattacaacgaaagctctcttctctgaactatcaaagcaggcagttggttagtttttaaaaaatcagtaaatcagggaagcataaagagacatgcacaaatttcaataaataaaaagcaactttacatttattcaactgttatgtagacccaaggcattttctttggttatgcgtgtctacattggctttctaatttattgttgtgcataaactacagataatgtctacaacttccattttggatttttaaaaatggatcaagatcttaaatcttttagtggagccatctgaatagtaaagtgttagatttttatccttccatcttagtttcctctcactcataattactgtaacatgttttgttcagtaatttgcttttattaggcctttacagagcattcaacttcccttgggaacaattttacatagcaactggtataaacaggtttaggaacctgcaaacgcattcttggtaggcattgtgacactcagtggttagaagaagcatgcaggggtgcccactagacatgggtgttctagaggcataactgactgttttacagaggtaatggagagcattggacaatcaaggaagtcagttaaggaggttttagagcaattattgttgttgatgatttatcaatcagaccttctcagttttctagattacagctctgttgggaatgctgtgtttgttatcaatttgtatttggcattggcattgtgtaccatacttattaggtgtatgtgaaaaacaacaaaataagttgatgaaataatgtattttctttacagattgcatccaagacttatcagtctttatggaggaagcatggaagaaatgattccaaagtaacatgtaattgtttctaaaagaaatgtacaaactagaattttaatataaagaaatgtggccatgctttaaacctgtggtccccaccctttttgggaccagtttcatggaagacaatttttccgtggatgggggaatggtttcaggatgaactgttccacctcagatcatcaggcattagattctcttgaggaacatggcactctagatccctcacataccagttcaccatatggttcgcacttctatgagaatctaatgctgctgctgatctgacagggggaggaactcagtaatgctccattgctctaacctcctgctgtgtggccaaacggatatcctaatagaaattgatgttactaacaattagcctctagggctttaaaagtcaagatgaaatatcaattcaaattctgtttttagatatcaattcaaattcttttttttacaatgtgtttattggacacacaaaaaaactttgcaaccatcataatacatcaatatttaacctagataattctgaaataatttggattctttcatttttcaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttcttaaagtggtagggttttaaaattcatgatacaagtaacaaagtaagttgataacaaatactattttgaactgggcaaaatctagcccaatatgtaattgtgttccccttgtatctgagaggcctgtgttggacaaccatagtactctgctttcactgtgctcagataacctgaaatatatagttgtttctgagtagttctgagtaggaaagaaccaaatgtaaatttccttagagaccatcctggagaagacagttctaaatcggggcttgatttttcatctatgatcctagatgttctcctgaaagaatgactagcctttttataacgatacaaagttttttaaaaatacataaatgtcataaagtttattcctgtgtatacacactctgggttcaggaggttttgtgcttacatttcactactcaaatgccttcgcaaatctcagaacattcctcaccatcactgcaggcctgtgaacagataactttcatcaattaggatggctggctagtggcagggacttcatataaagaaatctttcccagaattgtttttccacattgccttctaatttgatcactccctataacagatgttcaaaattcggccacagctctcttatgaaggcagagtcagataaaatgatattctgcaattatctagatcataagcataaaataaatattacaaaaatgattgtatttaaagaaattttttaaaatccagaaagtcatttaaaatagaacctcatatagtatgaacaaactataaaaatattttacatttca

SEQ ID NO: 12 - DNA, 145347 bp, Homo sapiens
  mutation 90758: a/g SNP in forward strand
attgctatttgggcaacaatatggctccttcagaactggtcgagaatttctgtggtctttgcttgaccttcaagttgggagtttcaaatcagaggctttgaagtctggaggagttcgcagccattaatccttccggggttgtgctaaaggcgtttctagaaagagatcggaaagacccgttcagcacaggcccattgcatcttctctttgaaaacgcttgtctgaatcaagtatcttatacagacccgagactgaggggagcaagagcgcaggtccggctgtggcgaggtgtccaccaccgtacttgtggtcaatgcctggactagagagccgaggccgtccagggcgggctggccagggaaccagaagcgtccctggactggctgagtgagggtgccctttccagcaacccagtggccatggttaaaaggcagaatacaaccgtcaaagaagtccccagctcccacataagagagcgcaaaggccaatggaaccaaggcctcctcgcgagaactagctcgctttgaggacaagatcctggggatggaggtggggactgacgtagtgagagggtctggaggaacagtcgtagctgaaggtcaggacatgaagaattgcacgtatggtagggatagaatggcaggtacaacttttctgtactgaaggaactgggagaggacgatccggttagggaggttggggaactaatctcaacgctgcgtttacagatgaagccgcttttatatggcgtatatgtttgcttagaggggccgacggagattaggagaagccatcctttggcgccaatgatcaaagcgtctgccaaggagaagaagccaagggatgggcctttcagagagggcaaggagtcatgctgctctggatgccagtgtcaggacaagaaatcgaaaggagcgaggactcttcactgcgtgcctcagtctccccgcttctgcctctttcacctctgtcctacttccggcgcgaaagcaggccactcgctctgatctagacctagttaacattagcttttcccttccttccctcaaatcccctcccccctctatccccgtcccttctgccgcctgaaagggttaatctctcctgcgggtaaaaacaggtccgcggagtctctaactggcgacagatgggccactttcttctggccacaaaggggccggaatggagcgctccgcggcatacaaatgggcaggtcacgtggttccaggctcttggctggaccgggaagaccatatggcgcatgccggggaggaaggaggaggggcgggggtaggggtggagggtgaggggagcggttgtcggaggagggcgggagacgagcaaggcgtggggagaagtggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaaggtaattacagttctttcatttttttgccccagaatagaagcaataactgaagactgatgaacctacatattctgtatgtgtgcgtttgcgagagtgtgtatgtgtattgagaccagcatccccctccataattgcccataagtactcacacataatgagtcgtgtcactcaagtaccccctgcaggctttctaatttaaattttaaaaatttgggtttcttttgtggatagcataggagcttcttggattttttaaaagaatgcacggtaactatgattatctgctagtgctgattttaaagtcccaaaagcaataatgacttcactttctcacttcttacagtaagaaaaaaaaatctatgttatcaatatatattttgtgtgcatgtattttacgcacattgggagtgtcaagctgtgttttcagtgaatgaaagggacatggataccttgagtattcacaccatggaaaataaatcaggttcagagatagtttagttgagaggggggaaagtggagaaagggagagggactcactcctgctacctgttaccgctccagaggcggccaagtccccagcagccactactggagccagaaattcagttgttttactaaaggctttttattttccttactagaagcggcaacttcgcggttgccaatcgctgaccattataattactcaatcttttaaagggaggtttgaggcgaactttgaaaagccccaataaagagcgggcggccctttcaatgggctgtttattagagaggagccttccgcacctgatccccggcgcgtgggagagcgctctgcgccgcgcccccagccctcgccctgcagctagcgcttttgtacaaggtggaaatttagcggtgggccagagatggaaggcaagaaaagaaaggcgagggaggggtggaagaccctgtccacttttgttgccaaatgttacattgatggtgaaacaatttggtggaaactatttttcctcctttctgcatttgcttttcagtatcccgtcgatgtaatcttcttaaaaatcgctgccagtattagtaaattacgcaatggctgttcaacttaaatcgctaagtatctggaagccaggacagaaatggaagtagaatgtgtgattttacagcttttttttttttttatggagttgtgagtaactttgaacacatttggataaacatgaagtcgctgaaatgtacagtcatttccacacacattatcctgtcgggcaaccaccataaacacatttaagttaatcactaggatacaaacacatatgcgtgagtggtgtacacatatacatattcactaccctcccccagtcctgtcctcactcctacgtactagcggggcacacgcacgcgccattataaaacactgcatttaactttttctcagaggcattcattttgtaatgggcaggtacttttcgcaagcatttgtacaggtttagggagtggaagctgaaggcgtatctggcttttgaatatagcgtttttctgcttttctttctgtttgcctctcccttgttgaatgtaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaaaccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtgagagcaattgttgcatttcttcttaaagggattctgtttttatttttggggaaagtagttgcttttttgctgagttaaaaaatactaaacactatatgtagaataaaagaaaagaaaaaagtttaccttggcatatgctcttgtctgtttatcttgcacagggagtcaccagttctatgtagataatgaaaagacctaactgatatttcattatttggaatatgggactggacggcagtacaaacagtgtgtttttttctttgttttaagtggcttagcctttaggttttttatttccatttttaaaaatgattgttacatgttttcttctatttctttttttaaaaggtggattttaataattattaacaagcaagacataaacaagtatcctagcttagtttgtctatacatttaagatgtataaaacattactattttcttggtcttctgttatctgtacatttttctgaactaaacagttttatcttgcaaactagtactgtcccagaaaaatttatacacctttaggaagtaccaaagggaaatgagttaattaatttaaagaatccaagagaagtaacattttataattgttctattaacatcttgtgatgatttccatcatttttccaagaaaaagcataatggattatttgtactgaagaacacactatttgtactgtatttaggaaggtgtaattatttcctccccccaccctttggggcactattctgttgtttcatgaacacaactcactggaaaaacttatggatgattctgtctattgttaagtccacttcaaaaaaaaaaaaacagtttggcatttcttttcctctggatgtattgactgacagtcatgattcctagggaatatcattttggcacttgtgccctggctctactgtggtgctctgattactgtcattagtaactccattgtttctactctgattcgggtgccacattggatgactaccccccttcccaagcttgttcctttaatctccttctcattggtgatttaggggttccagaaagctgacctcatttagcaagctgctccagaaaaatgtgagtaatgtaatggacaggaacaattagccatactaataacattgccaatgaggctgcgtcaagctgtgacagaagcagtaaggaatacttcgacgttaaaaaaatgtttgagagcaatttaaaatatattattttaacatgttttctatcagccttcatcacatgacagaaatacttttaagttagtcccaactttatctaaaatgcagcaatctcattccaagtgaatcagagttgttattttggaatcaagctgttgctttctatatcctggattgttctcactgttcttactttaagagacataatactgatatgatacttgaatactaccagccttccagtgtaggaggtaatgaagtgagcattcagatctgatctaacctattaagtagctcaatttcacctgcaattaaaattagacatcttcatgcaaactaaaatctgttgctgtagtgaagagaagaaataaaagaatgccattttgagaattccagcttccaaaatagcaaacagggaaatctagactgtgttcttttgtaaggtagaaatgaagactaaaagttaggttttttttttttttcttcccattttgccaatacaacttcattctaaaacatagggattctttcagtcagtcaaggagtaactcacatgccaccatcttttattcaaaggcaggcacagatgttccttctgcaggggaggatttaatttatgaaaatgatattgtttatgcatgaatgaactgcatgcactctgcataacacatagcacttccatctgatcagagaaataccacagaaccagtgccaatgtcagaaacatattctacaaatttactcacttaaatgtttaatgaatatttggaaggcattttcaaaccataagaaacattttaaattatcttcttttatgaattcctacccatatttaaaagagactcttacagtttttgtaattggctaatgcttatacccagtttgtaagaaaagaacatattttactaaatgaaaaccaaccaaaaaaaaatgctggcaagtttggcttcactggaaaaaatatttcgtttagttttgctgtttaatgcttgtcatgaataatatttgggattctatctgtttcttcatcttgagccacgactattcctatcaaataagatgcttaggtatacttgtttaatgtgaaaatcctatgaatagttatttctagaaaaagctggtatgtaaaatcagggggaaatttcataaagatgaaattgggctaaatattgtaacatgcataattactattgaataggaacacttcacataacatattttactttatataaccaattgcagctatatagtatgatctatctacttttaatcattaaaacaattatatataaattaaaatgaaagattataatatcaagagtgttctactaattttaggtttataatatgttacagtaaaataccatttgaaataaattttgtgttctaatttatcttaaaatctctctgtttttacatttgaaagtccttacattcttacaaaattaatgcattttctgaaagaagctagcaattactaaaatgatatatggatcattagctaacagtttgaatcaagctgttttagttctataattatacaagaaatttaaagtgaaaatacctattaagcaattaataaaactaggtttcaaaatattggctaattttctcctaatgggaaatgtaaaatagcaaaactgcttcttaaactacacaaaaacctcctcacttctccttttctctctctctaacaccacttatttcctgaaaatcatctaaataaaatatttaattccagggtctgatgaagaataaaagagccaatgcaacatcttgtggaacaccaggactgagaactcttgttgttaccattgcaaagaggcgttctggcgtcagatgcacagtgatttgtatggtggcataatcattggctcctggccaggcattatgtttcagaggacactattgtcaagaaccattcaactagaaatctgcactgtatgcactcaaaagttgagatcatctgccttcctatgacaggaagaattctgtgctggcaattgactcatggactctcttcacatacactaaggcttggtccagtggctctgatggaattaactgtgcagccaaactagtggcattgacaagacagggccacagtctctggggacttcaggagaaattgctaattttaaaatgcagagtattatgttaatgctggattaaatcttcagatacattaaatgtggatttggccatctaagcattattatgttatttgcccagttaatttagaggtagatggatggtgacaataaccatctctacagatccacaattctaagagatggatccaattgtgaaatgatatggagagatagagtaagttcaatctagcatatatgaagtaatttggtaactgacttttcttttaacaagatcaaaagctaacctgctttacactttcatgtctaaggacagccaaccagagagatggcttcacacactagcccactgctaagtgcttttcattcactttcatatttcatcatcaaagcaccctcctgccttatttatagatggggaaacttcaggaagttgagatacctagatatttgcattcctgtcttcctttcttcattcaggtttttctttcattgccacttcctcaaagaagcttttactgattcccatttaaaatagcaactgacttcaactccaccaaaatcactgtattgcccctccctctttccagagcatttgcctatcaaatgttatcttatgtatttacttgtatagcttaattttaaactatctatctctaggtcttctgagcacctgagaaacagagacaaagttgtctcttctgtgtgttgctgttcctctggtgcttagaagacctagaggatcctcaataaatattaactttccaagggaactgaagagcactaatgtgatgctaaagcctgttgccttaaccactatgctataagtcaaatcagttgagaatggagaggaccacaaattattttcagtccagcaagtgttataaacattaattctataaaaagaaaacaattgaaactaatttcttattatattgcatggcaccaaactccccccacttcctttttgaggatcatgagttgtctgtcattgtttctttttattgatatcaattggttaaatataatctggaattggaataaaagaaaaactattataggctttttccagaccatgtatttcaatgcatattattttttcctttctgttcattattctttcagtaattgcacttgttctatttttagtgttatgtaaaattactgtagctcataatttctattttgaagggttcagtgtataaacttagcacatcaatactatctttttagtgttcgcgctcaatggtgtcagttaagagatcaccatcacttttggtgacgtcaatgaaggggtattgcaatgcttaagagaactgttaatccctttccactggtgtcactaacaattgtagtgcttgtttattcatagcaggtacgtgactaagtaatgttaacatcaaagcagaaagaggataatagagtgttctaaaaagaaaattcggtggttgggtgcagtggctcacacctgtaatcccagcacttttgagaggccaatgggggtggatagtttgagcctaggagttcaagaccagtctgggcaatatggtgaaacctcgtgtctacaaaaaatacaaaaactagtggtgcatgatggcatgcatctatagtcccagctactcgggaggctcaggtgggaggatcacctgagcctggggaggtcaaggctgcagtgagacgtgattgtaccactgtactccagcctgggtgacaaagtgagaccctgtctcaaaaaaaaaatgatttgagataacatcacttgtcattgtttgttaactgaataatctttattctagccagtgcctaaatacataataaatgatagtacaaatggatataaattataactaaacctaagtagtgatatttatcacaatatttctttactagaagaatttctttgttaatagaggcaaggctacttgtttagataccttaaaataacataagatttttggataaataaattaatgattctttgattctgactggcatattaaaaatattaagcgaagagatctttgcttcccaggttttattttttgtctaattaactactggtgcatttatattaaaacatattgtcaagggaaaacgtatatatatatatgtgtatatatggtgtgtgtgtgtgtgtgtgtgtgtgtgtgtgcacacatatgctatacttggttgagtagtatccccttcccttgcccacctctctcccaaatttatgtccatccagaacctcaaaatgtggcctcatttgaaatattgtctttccagatttaattaagatataagatgtaaattgatacaagttcatgctggattacggtgggccctaaatccaatcactgatgtcctgataagaagcagacagaacacacagacacacagcatacaggaagaatggcatgtgaaggcaaagacagagactggagtgatgtgtctacaaatcaaggggccccaaggatttggggcccacatcagaagctgggaaagagacaggaattctcagcttctccttctgaatccctaagaaggaatcaaccctgctgacaccttgattttaaacttcttgtctccagaactgtaatataatacatttctgttgtcttaagctacccagttgctggtgatttgttatggcagccctaggaaactgataggtatactaaaatctctaatgaattgatgttaaatatatataagtataggagagttcatttaaattcttctgaaaatgtcttcttaaacttttaatgatacagtatataacaaccagtatacgtagttggtatcgggtttgacatttaaacaagctgacaaaaaacagctgtttaataaacatctgaattatataaaagttttattgtttattattcatgtgaatgacttaaactgacatctacatttagtgaagtgtgaatgggcctagccaataaactatgggtaatttttttaaagtctcatctttgaactcacaaaaaattatcaaatatcagctattatgtattcttcatgtgaagaaaatgtcatatttatttgatttgtggattagcatatatattaatagagcttttgaaagaacaaatgtagcactttcccgatttcatagacactcatttaacacacaagttcatattttaaagtacataattttaaaaaaattctagtccaaatgaatttaagtgccatgacttctaaaaattctgtctctatttttgggttttataggaccttgagccagtactcttctggtgagcttaagaggctaagacttcacctttagttatatggggctttcatctgattatttgtctattttgattgctctaaatacaagttagtgtgtatttcatctgaatgtatttcattataagttttggttttatgtagatctggggatctgtcttgtttttaatcttgattggtctgtttgttttgggatagttggtactttcatttcttatgcttgctttctttttcattttgtgcccacctttagtcaggtgaacatcagtaaggaataaaattttatttttttaagccactgaaaaaatttaaaaaccacatcataactctgcctctgctgactgataaaaatgctaacttattaagacaaaatgttatgcaagaagactttattggaatagagaaacatcctttttatgtaagaaatatcaacagagacatgtgcctttcttgtgacaaatgtggtatgtgtgtggattagaggtctggaatgtggcagcatttcagtacttggaggggagaattagagtagggtagaaagatagacggggagcagaggatgattctcacccagtagaaagcagagtgaagaaagaaaggggaattgttttttgcattatattatttgaactgtggattaagtctttccataagccatccctacgcctctaagtaggttttattaacttaagctggtttgagatgggtttttggtcacacacaagaattgcctgatacaagagaggctttgattttgttgttgcttgctcatttttatacactaagatggagaaaaccctggacatagtgaagacgaaattgaggaaggtgttgggtagagtggagggtagaagacctgtaacataggtacagaattacattaaactggaaggacttatatccagatataggagtcagggtagaaagagagaatgttagcagtaagggtaacagagtagcagaagtttattcttaccaggtcctgttatgtgacagtggaggcatgttgaccttctgactaggggagttaaaggagaacactgaaggtttagaataatgtctctaaggatagaaagagaaagtttcatcaagactcatcaataatagggcagcagggcttagggccaagcaaattcagagaccatgatattatagtagtttgtagtggtcttaatccatctaatttttcagcattttctcaatggccaatacttagcagtggtagtgttttatggcatttggacaacagaagtgaaagcactggtaagagagacgttgaagtgaaacaccatggggctcagaaaagcagagttgatccatctggtacatgggcaaggatggtcctgaacaattctgcagtaagttggaagatagaaaaaatacctaacgaacttgtagatctgggtaaggagatttttggcagaatattgtaaggctaattggcttctcttaactatatgagatagggttttacaagggagagataagcgagcataatttagaagaactatagggggtcccaggcagactctctggctggaaaattattctgatagcaagaaattagccccaaagcaaagatgaaaagtagggtacttccaattaaacatgtcataagggcaagcctcaatcaagagtgtggctagaaggcacagctcacctggacaaaagtgcttctaagcatattaggagcatataccacaataacctgacttggacccaaagttgagagaggccagtctcaaaaaaatttgagggaattgcttttgcataatatgatactttatatacatatctgttacatatcatatatatcatattaaaaagaaaaaaaaccctgtttttccttccgttctttcatataacccttctgacaacaaatgtggagtttttcacacactaagcaattctttagttcttgctggacacttcctggatgtcctacaattcaactcgattctcacacaactgcccagagtcagtgcagacccgcagattaaaggcttagccccaaaagactaccccccactttagatgtcaatcacaagtctcaacttcatttacttctgaaggacgagctatacattggaggaaacccctctttctttcaataatttgctagaatggctcacaaaactctgggaaacatttacttatggttaccaatttattataaaggatataactcagaaacagccaaatggaatagattcatagggtgaaaaatgggggagaggcatggagcacaactctctcagcacctccatgtgttcaccaacccagaagctctcagaactccttcatttagggcttttatggagctttatcaagtaggaatgattcatgaaatactggcattggtgattaacttaacctccagcccctttcccctccctcaacattgggggtgaagctaaaagttccaactctgtaatcacagggtgagcttccctggcaactagtcccctgatccttagggggcttctgaaagtcacctcattatcataaactcaggtgtggttgaaagggatgttttgaataacaaaagatgcgcctttttcctttatctttctgagttgtttcaggagctagggacaaaagactaatactataacaacaacaacaaaaaattcaatttttgcttttatctcttgggaattacaaggattttaggagctctgtccagaagccagtgatgaagatcaaaatacatatttcttattatatcacaattcacacatgtacatgatatccgtaagataagtgaactacataaagtaagctcacaaagtttctgtaggagttttgtccatttacaaacagtttgtaagctaaaagtatctgtgacaagcctcagtcaatttagaagttcatttttccaatgttaaggacatgcctgtgacacagcctcagaaggtcctgatgacatgtgcccaaggtgatcaggctacagcttggctttatacatttagggagacataagacatcaatcgatacatgtaagatgaatattagctcagtccagagaagcaggactactgaaagtggaggcttgcaggtcacaggcagattcaaaggttttctgattgggaattggttgagttattatcttaagacctggaattaataaaagggaatttatcatgcagatgaagctttaggtagcaggcttcagagacattagattgtaaaggtttcttatcagacttaaaagagtctgttctaacagtctttaggtctcagtgttgatgttaatgctggtcagctgtgcctgaattccaaaagggaggagagtataatgaggcatgtctgagtcccttttcccatcatggcatgaactagtttttcaggttaactttggaatgtccttggctgagaggaggggtccattgagatggttgggtggcttggaattttatgtttggtttacaagtttaacattaaaagcctctgtacctccaatgttttatggacaaaaagaaggctgaaaaagctacttggctgtaatcatgggccatttcttgctgaaaagaagaataaaatggaggcagaaccaaaagcccagaggctagagccaagagctgctgagaatgatgaattagggaaccactctcagagagcagatctggatgtgagataggaacattttctttctcagggtctatgaaactggcaacatatgctctcctgaatttcagaattgctatggaccagtgactgtgatatgctttctatatttttcccttttgaatgggtgcatctatcttgattatcctctgtctcattattgtatgttggatttgtgtgggacgataacatgtgtttttagttcctaggttcccagaataagaggagcacactcaaagagcgacatttatgagatactggatttttcacttgatatcataattgggtgagacttgaaagaaagtgaacatattttgcaaatgggagggatgttaaccactgacaaccacacccacagggtccactgtattagcctatctgcaaagacggctgccaaaaattccttctgtccatatatacattcccttttttaatgtgactgtttcacctgccagcaactgaagggctttatttccatttccccttgtgacttgtttgactaacagcaagaagcaaaagtaatgctattccaattctagacctgggccttaagaggcatgacagcttctgcttttactctcttgaaactcaatgtcattttttaaaagctcaggctagactactcatcatgagggaccacatgaaaagagataggcccagctagtttccacccattccagccgctccagatgagatgccagacatgcaaatgaagccatcttggatatttcagccccagctgagcttccagctaaatgtaagtacattcagttgatacctcatagagcggaactactgagctgacttcatccaactcacagaatcataatgaataacaaatcattgttgctttaagtcaatacatttaaagtttttttgttatccagttgtagatgaattatacagcctggggggaaaaaggagatagcacactgttagttgcctcatcaatattcatccccaaattctttttcctttttagtaggtctcacctcccacctggaagctgaaaacacctttcccagtctctctggaagctacagcacaggcatgttgcccaattctaaacaataggacatgataggaggtctgctgggtgggatttttgaaaatatttttttttctggttaagaaaaaagaaatgcccaaggaaaacctacaaatgccccttccattcttgcttttggacattttttgggagagggtatgatgcttagcactcctgcagccatctcggggccaacaatagaatccttgttgctacctggtgatagtgaagtagaaagctacaaagctcttgatttcttttcttttttttttttttttaaattttattattatactttaagttttagggtacatgtgcacattgtgcaggttagttacatatgtatacatgtgctatgctggtgcgctgcacccactaactcgtcgtctagcattaggtatatctcctaatgctatccctcccccctccccccaccccacaacagtccccagagtgtgatgttccccttcctgtgtccatgtgatctcattgttcaattcccacctatgagtgagaatatgcagtgtttggttttttgttcttgtgatagtttactgagaatgatgatttccaatttcatccatgtccctacaagggacatgaactcatcattttttatggctgcatagtattccatgctgtatatgtgccacattttcttaatccagtctatcattgttggacatttgggttggttccaagtctttgctattgtgaatagtgccgcaataaacatacgtgtgcatgcgtctttatagcagcatgatttatagtcctttgggtatatacccagtgatgggatggctgggtcaaatggtatttctacttctagatccctgaggaatcgccacactgacttccacaatggttgaactagttcacagtccaacagtgtaaaagtgttcctatttctccacatcctctccagcacctgttgtttcctcactttttaatgattgccattctaactggtgtgagatggtatctcattgtggttttgatttgcatttctctgatggtcagtggtgatgagcattttttcatgtgttttttgactgcataaatgtcttcttttgagaagtgtctgttcatgtcctttgcccactttttgatggggttgttttttttttcttgtaaatttgtttgagttcattgtagattctggatattagccctttgtcagatgagtaggttgcaaaaattttctcccatgctcgtgggtaggaagaatcaatatcgtgaaaatggccatactgcccaaggtaatttacagattcaatgccatccccatcaagctaccaatgactttcttcacagaattggaaaaaactactttaaaattcatatggaaccaaaaaagagcccgcatcgccaagtcaatcctaagccaaaagaacaaagcttggaggcatcacactacctgacttcaaactatactacaaggcttcagtaaccaaaacagcatggtactggtaccaaaacagagatatagatcaatggaacacagcagagccctcagaaataacgccgcatatctacaactatctgatctttgacaaacctgagaaaaacaagcaatggggaaaggattccctatttaataaatggtgctgggaaaactggttagccatatgtagaaagctgaaactggatcccttccttacaccttatacaaaaatcaattcaagatggattaaagacttaaacgttagacctaaaaccataaaaaccctagaagaaaacctaggcaataccattcaggacataggcatgggcaaggacttcatgtctaaaacacgaaaagcaatggcaacaaaagacaaaattgacaaatgggatctaattaaactaaagagcttctgtacggcaaaagaaactaccatcagagtgaacaggcaacctacaaaagctcttgatttctaatgacatcatatgggatgaaccaacccaggaacagcctgactctggacctcttttaatgtcagaaataaaatcttatttgtaaaccactcttagttgttcaggttgttgacacaggcactgaagtgcctccaaatggtgatgaataatgaggcaaaagtcaaagacagcaagtctagtgtcaaattttttgatgcctatgggtaagaagttcaagaaagtgagctattttctttctttttaaaatttatttttatttttgtgggtatatagatgtatacattagtcagctattttcaatagtgagaagggatgttgccacttagtataatgcctttttcatagctatcatagaaaccatatatacatatagtatagaaaatgaggatagatttctgacttaaactgcctatttcatttgtgtgcctggttacacctaattcaagactctacaatacagcattgctagcaattactgtgagaatatttcaagctccctatttgctggaaatacatttcatttttttgttccaagtttatgaatattagaacctatctaaaaaggagcttttaaaaacttgaggaaaggaaaagggagggcctacttttcttgcctgtgttatttcttgttactgctgattgagatgctagagatcatattgggtgagatgtgtcttagaatacagctgagcaattcacttttaacagtttccatctgagtacaaaaaactggtatgtgcagaaaacttgatattctgacttggcgggattctaggatttgttctatttttttctgtaattgttgtagggacatatggccctgtaccttttgggcagcaggagccagaatagcaggaacattctgacaaaattcccactcagcatgagagggaagcagtccccttgatacactgatgatgtgcccacttagcattacaagtgtttgagaggtggacacaactaaaactcacctcactcaaaatatatattgacacggagaaagtaaatacaatttgctgttattaacctttcttctcaccattgagacatgttaaatatctgaaattaataaaggaattaaatttaaaaagtttacttatcatgcatttaacacatttattgagcatctgttatataaatgcactgtttcaggcacaagagatagagccataaataagcagattaaatcactattctcaactgaggtactaatctgatataagagaggagacagaaataagtaaacattataaatcaactacatacttttacatggtgtaaagtgcaattaagaaaatattattgaatagaggtcaattttggaatggttgggcagggaagaccttctgaggtgacaagaagttggcctgggcaccatggggagctctaccatggtgaaaagtgttccagacagagtagacagcaacagcagaggccctaaatgagaatgcacttggcttatctggagagtagaatgaaggccagtgtggtaggacacatactaataataggagaaaactgatagaaaagagggtttgagcaggtgggcaggaattggacaacatggtgtctcatatgtcataatagaagtttggattttattctacctgcagtgagaagttcttaataaaaaaaaaattctataaactggagtttgagaaagaactatgttgatgatagcataagccctcaatcacttgtcacataaactccaaacttcagcagagactcagggagatcaaagggactaccacaggattacccactggctaaaattcagatccatggcagttggtcctgactggaattagacttccttgtctgttgccctcattgcagtgggtctgaatgtctctgtcggctgtgaatttttctccctctatctgtggcactgagaaggtggcccagacttccagagtctgtctcattggcctattacttggggatttgctgcccttcttctggaagtttgggtatttgttttcagagcatacttaaaggcctcctgaaagcaatgttaacaatagcaggatatattttacagtcttctactcagacttggatttttaagaaccagggatggagactgtgtttccagatctagtcaaatcccttccaaacataaagcaacaaagtgccttttaaactaggacctgtactgtttaatgctctggaaacaaatacccaagcttcagccaaaggagggaaagctatgttcaggaagcttcctgaaagttttttgaaagcaattttcatgcattagtattttacatatatatatatatatatatacacacacacacacacacacatatatataaacatatatatatatacacatgaatcactaatgagacaattgatcttcaggaactaacgtgaaataattggggtatcttggtattattgttatagataaatgttgaagaagttcattctttcagatattaattgagcacttactgtgtactaagaactgtgatagatactggggatttaatggtgaacaagataaattctctgccatcagggggcttatattctaacaaacttaaaatttactgagtgttctctgtatttcagtattgttactaagtacactaacttagtggggaagctagacaataaacaaagaagtatgtaataagaattaatagtaagtgctgtaaagaatactaaagcaggttatggtagagagattaatggcagcgtgaagatgtccatgtttcaatccccagaacctgtgaatatgttaccttacatagcaaaagaggctttgaaaacataattaagggttatctgggcaggcccaatgtaatcataagagtccttatctaagacgggggacaaaggtcaaagacagaggaaaagagacgatttaaggatagaagcaaagaggagagatgttagactgctggctttgaagttggaaaaagtgaacatgagccaaaacaaacaaaacagaacaaaacaaaatccacaggtgacctttagaaaaggggtccccagtctctgggccatggaccagtacctgtctgtggcctgtttggaaccaggctgcccagcaggcggtgagtggtgactggtggacaagcaagttttaccacctgagccctgtctcctgtcaggtcagtggcagcatcagattctcatagcagcctgaatcctactgtgaactgcacatgcaagggatctagtttgtgctccttatgagaatctaatgcctccaaaatgctcaccccttcaaactgcccccatccgtggaaaaactgtcttccacaaaaccagtccctggtgccaaaaaggttggggactgctgctctagaagccagaaaagaggagatatattttcctctagagcctacagaaggaatatataggcctgctggcaccttgattttagtcctgtgaaactgattttggatttctgacctccagaaatgtaaaacaatgcattggttttgtttcaagtcactaaatttgtggtaattagatacagcagcagtaagaaatgaatacacaggtttacaggatggtgaattatggagggtgctcaggaatggcctctttgaggtggtggcctttaaacagaaaaatgagcaaagtgaaagaatgaaccatctggtggggagaaaagcattccagtcagagggaacagcaaaagcgaatgctctgagaagggattattcttctcaatgtgtttgaggactggcaagaaggctttgtgtgaatgagcaaggggaaaaagttagtaggtgatctcggagacatagccagggtccagattataaaggacctctcgccttgctaagcattttgactttattccaagaataatgggaagtcaatggaaggctgtgagcagggttatatgctctcgttattttttaaaggcacaatgtaactccaaaatggaaaattggctctgggctggaggtgccagcacaggggaaaccgaaagcagagagctgggttgggagagcggagactgaagttgtccagctgaggggtgcagaagtgcagactgcaatgacagcaggcagaaaggactatatgttctagacagaatggacaggatttgctggtagattggattgaaggcatgagacaaaggagacatggatgatatcaaggattttgatactacagatttgaaacattctgagagggacaggtttgtgatggaaaatcatgagtctggttttagatatgttttagaagcttattggacagccaagtagagatgtcaggtagggagctggacataatacctaaagttcaggagagtggttggagctggtgacatcatttgcagaaccctggatggtacataaagcacgggacagtgtgtggatagatcctaaagagagccctagggcactccagccctggaagaaggcagcttatcaaaggaaaaagaaagaaagaaggaaacacaatccttattacttccatcttcaggacaattcaaagccagtgtttttgacttcctggcttgagtgaagcttgaaaaatggcaacttgcccctttgcaaagctcctaaggagtagccattggcttggcctgtttgcactggctctgggtgagcttttaaaatgccagtgagctctaattgtgttgattgcctaacagctgtgaatacaagatgctgactccagaactgcaactcattctgcgaagggcaccgtccttttccctctaatgactgctgaacagagccacctgaagcctgcatggggtttagcagcagctgcacttctgctctaagaaatagctcactgcagtcagatcaaactgaagctcttccttgcttttcctcgaagcttgggtacttattgtcggagcattaaacagtaagagtcctagcttaactggtgcacagtgctttatgtttggtagggatttggttaggcctacaaaccgtctgagctaagaaccttgagaaactcctgctatagttagctctttctgtgactctgcagtgtgaccaggaatgaggacagaattaagaatttgctgcctctatgatagaactgtttaggcactagaacactggaactagatctacaaccctatgaatttaatttccttttcaactcccctactccttcttttcaatatgatgataatgatcttgtttaaaaaaaaaaaaagccttctgctttacttcccactctgctcctcttcccagggactcactttcttcttgactgcttccccattacaagtactcagctccctgttttatcaccctgcttagagcagccattatcagccttggctgaacattggaattacctgggaacttttaaaaatccggaagtctgggtctcgcctccagagattccagcttagttgtcttgagcgtggcctggacatttgggttttcaaaagttccctatgtaactttaatgtgcaaccacaattgagaatcactagcctccagactctctgtgttatcaaaattaatgagcagctgattttagaaatctcagttatcaggagaaaagggtgaacccccccagggctcttctccttttccaggtgacacttctttatggcagtgcgtgaaagtgaagccctgctgcttgtaatctccctcaagggagtgcaagatccaggcaaagacaagactgcagaggcgctaccttgggggaaagtaggaccctaaatacttacacctggaggcacttacctttaatactgaatttgtcagatgcaaatttgtctatgcaaaccagggccttatctctagcttcccctcaggggttttgggaagtgcgctactactctgaaacagggttgtaaagcgtcacctgtgctctccagggaaccctctggaaaggaggtggaaaaacagaggcttccacccttgcaactctaagtgtgttccttggccagtgggatccatcacctagtattttcttagatatgtggtatctgggggccagtcccacacctatgcaataagaatctccatttgaacaagatgcccaagcgattatatgcaagtttaagattgaggagggctggtttaactcgagggtaacgaaaagtacgaaatcgtactttacaggagaagctaggcggagggagccacttattcttcctcttgcagctgggtctttttgtggtgagtggcgaagcggcgaggctggcaggccagggtgctggactgggtcaggcgcggccccgcctccctcctgggtccctgccctgcgcgccgttgctgtggcagcgctggacgcggctagagctggggctgccgcgccctccacctccttctccaaaggcctccccggacccctggctcgggcccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgagtgcccggccccaagcgtcttcgcctccctccgcgcttcctccctctccccggcccaaggcctacacccacgagcttttgctccaccctccccttttctcgcctcccctccccgtgctcgcctcactgcccggacaggttaccgagtccccaagtcgccgcctcctccttcccaactgggaactcacgcctctcgccccatcccagaacccccagggattctttcgctacctagccttttcccgcctccgagaccttccccgggcaaacgtcacaagcagcttttgctcagagtctcagcagaaaatcttgagccccaaaggggaggtaatttacaaatgtgagaaggtcaactactcctcccctccaagttgaaaaagttttaatccattaactttgatggtacattgaaactataaacatctcacagattatgcctacacaagagttctgaatccaactctcattttgctgacttgaaaatgtaactccagagctttgggagtgtttctgggtttttttctgcccctcaccttccttgccattgtctagaattaagacttcttcaggctcggtctagaaacttttgatttttaatattgaccctagattattggatcacagttttgcgatgcttagttacgtcaagcggtttgcttaacgtttgccttttattgacttaaaattttagttacctaaaaaagttataatgctgtagtttacaacaaatacttcgagtctattttcacgtcttagtcaaatagccttatagacttaacagatattttataaagaccattttgcaagtcttataagtagactttcatatagtcttatttctaagtccaaactcgagaaatactccccattgttgaattagcttagatgtgagcggtgaaagacagatgaaatgggggaggaactacatcaaggttactctacttgcgaggagatgacttgggggagatggaatttggtattcaacctcttttagctaaatacaaatttatgaaattaaaaaaattgccttcccctgttggaaaacaagacacagtgtggtatttatgttacagaatagactcactgtcttaaagtcttgctcaaaagtctaacaaaatgaaaccaactagccagggattcagcactggttgcgattgtgaattctgcctgtgctgcatgtgccatgctcgctcgcttcacgaaaacagtctttgaccttaaagtgttttcaggtgttttaaaaaccaaggtgtagtattttcttgaaccttttaagttaaaagctagggatatagctatggaattatttgtaagtctttcaggcaattcgagttatgcaatatagaagtttataattacagtttggattagcccaaagagccagtttaacctacagtgcagctgaaatgctatagaattaaaatgagacattgtgcaatgagaggtcatacaaaccaatgttgcagtatttgtgtacaaaaaaagcaaacaatgacatgagaaaagaaatgctgttttatattgagtggtgattaaggtaaaataggtttaattagtgcacccctggcagtagagtttaaaatacatcttgacagatttgtaactttaaaggttgcaagtactgattctttgtttaattatgccctaaaaccatttggtggtcttttccttcatacaggtgtaccctttttctttgtaattaatacctggtattcaaaccactttgggcctctaaaattgggggcacagaagcctagagccttagtaagtacttctgtttatggaagaaaccaagagatgttttatttaggtaaaatatagccaggcgtggtgtgtccctgtaatcccagctacttgggaggctgaggcaggtgaattgcttgaacctgggagttggaggttgctgtgagcggagatcacaccactgcactccagcctgggcaacaagagtgaatctccatctcaaaaagcacaacaaacaaacaaaaacaaacactgggaaataagaaggagatattaagagatgatatatttaaatgttagaaatgctctgttgttgaataagcttagatgtgagtggtaaaagattaaatggaagagggagctacatcaaagttactgtacttgggaggacatgatatggtaggatgtggtggggggagagcatgtccattgctggttggcaagtgactggctgcctcagaaaaggatgagggtgggtaggggagatcactggagattattagaacatacgtatgttttcaagattgcttagtttttaaacctcatagtactttgttttcactgatgaaataaaatactatgtgatctttttctaattttccatcttgagtaataagcaaagacattaatgtattttatgaaggctctgactgccaaaattgggacaaattgatggtcttgttggcagggtaaatgagcataaccgtagtaattgtagttctttttattgggttcagggatgacctggaataatggatgtgttattacccttccctgtagaagtgaggctttcgaaaagaggctataagtcaatttgggaggcacaaagtatcagcgctttttggggattttttttttttttaagtagagaaatattttaaatgtgtgatataaagttatgcatgtgcttcttaagcacattaactcaaccagatccaacagctggtctaataactttttaattgtttaaaaaaatttaattgacacattgtaattgtatatatttatgagatactatttgatgttttgatatttacgttgtacaattatccaatcaaagtagttagttatccttcacctcacactttcattatttccttgtgggttagaacattcaaaagactctcttctagttattttgtaatatatagtattttactgttaaccatagtcaccatactatgcaacaaaacaccagaatttattcttcctacctagttgtaactttgtgtcttttgactaacctctctccatccttccttctcccctccccttcccagtctctggtaactattctaatctctgccttatctatatcaaccttttataatagaaaaagattctacatgtgagtgacatgtggtatttgtctttctgtgtctgggttacttctcttaacacgatgtcctccaggcttagcattcacaattgacaggactttattttttaatggctgactagtattccattatgtttctgtatcacattttctttattcatccattgttgtacgcttaggttgattccatatcttggccattgtgaatagtgctgcagtaaatatgggattgcagatctcttcaacatactcattttatttcctttggatgcatacctggtagtgggattgctggatcatatgatacttctatttttaattgttttaggaacttccatgctgttttccatattgactgtactagtttacaatcataccaccggtgtgtaagtgttcccttttctccatatctgtgtcagtacttattttcttttgtctttttggcaatagccattctaactggagtgaggtgtatctaattgtggttttgatttgcatttccctgatgattagtgatgtcaagtatcttttaaatgcacctgttgatcatttatatgtcttcttttgagacctatcaattaaagtcgtttgcccatttaaaaaatcaagttggccaggcacagtggctcacgcctgtaatcccagcactttgggaggccgaggcgggcagatcacgaggtcagaagatcgagaccatcctagccaacatgatgaaaccccgtctgtactaaaaatacaaaaattagccgggtgtggtggcacatgcctgtagtcacagctacttgggaggctgaggcaggagaattgcttgaacccaggaggtggagattgcagtgagccgagatagtgccactgcactccagcctggtaacagagtgagacttcatctcaaaaaaaaaaaaaagtcattattattttatctgttgaattaattttcttatatattttggattttatccctttgtcgcatgtatagattgcaaatatttttctcccattctgcagctgttttcactttgttaatagttttcttcaaggtgcaaagttttttagtttgatgtaatcttattttgtctatgcttttgaggtcttattttaaaaatccttgctcaggtcagtgtcgagaataatttcccttttttcttgtaatttcatagttttcaagttttacattttaaatctttaatctatttttatttttgtatatggtgagagggaggggtttaatctcattcttctgcatgtgaatatctgattttcctagtaccatttgttgaagagactgtctttttcccagtgcatgttcttgacatcttaaaaattcagttggctgttgtaggtgcaaaaatttatttctgggctttccattttatttcatgggtctgtctggttttatgctagtaccatgctgtgttgatatagttttatcgtatatttcgaagtcaggtagtatgatacttccagttttgttctttttgctcagggttgctttggctatttggggttttttttgtggttctgcatgaattttcagattgtaacatttctgtaaagaatggtgttggtattctgatagcaattgcattaaatccatagatcactttgggtagtatggccattttaacaatataattatttcaatccatgaacatgtactatcttcccatttattgatgtgggaagataatttctttcatcaaagttttatacttttcagtgtagagattctttcacttccttggttgtttatttctaggtatctttttttttaaaaaagtactataaatggaattgttttcttgatttttcacatagtacaatattagtgtatagaaatgctactgatttttatatgttgattttgtgtcttgcaactttactgaattctaacagttcttttgtggagcattttgggttttctatctataagatcatatcttctgcaaacagggacagtttgacatgcttctttctaatttggatgctcgttacttctttctcttgcccagtttatctggctagaactttcagtagtatgttgaatagaaattgtgtaagtggccatcctttccttgttattgatcttagaattgatctcgttattggtcttttcccattcagtatgatgttagctgtggatttgtcatatgtggcctttgtgttgaagtacaaactttccatacctaatttgttgggtttttaatcatgaaattatgccacattttgtcaaaggcttttaatgcatctattaaaatgatcatacagtttttgtctttgttaatgtgtatcacatttactgctttgtgtatgttaaaccattcttgcatgcctctgatcccagtgatgaatcgcacttgaatgtagcaagttatctttctaatgtgctgttggatttggtttgctaatatcttgagaatttttgcacctatgttcatcagggatattgtactatagtttcctgtgttgtattgttatctgattttggaattagggtgatgcttgactcatgaaatgagtttggaagtattccctttgcttcagttttctgaaatattttgagaggaattgatattggtttgttaaatgtttggttgagttcagcagtgaagccattcgtttctgggcctttctttgatgaaagactttattactgattcaatttcctcacttattattggtctggtcagattttatgtcttcctaacttaatcttgataggttgtatgtgtcggggacttcgttttttctatgttatcaaatttgatgaaacttgttgaaaaccaactctaaattttgttcatcttttgaaattatttttagtctctatttcatttatttctcctctgagttgaattacttccttacttctaccaactttgggattagtttgttctgttcttttttttctttctttctttttttttgagatggagtttcgctcttgttgcccaggctggagtgcaatggtgtgatctcggctcaccgcaacctctgcctcctgggttcaagcaattctactgcctcagccttcctgagtagctgggattataggcatgtgccaccacacctagctaattttgtatttttagtagagacggggtttctccatgttggtcaggctggtctcgaactcccgacctcaggtgttctgcctgccgtggcctcccaaagtgctgggattacaggcatgagccacaatgcctggccgattagtttgttcttaattttgtagtgccttgaggttcatcattaggctgtttgtcagaaatctgttgtcttttttgatatgggcatttaatactataaacttacctcttaaaactgcttgtgctatgtttcgtaggttttgttatggtatattttcattctcacttgtctcaagaaaaattttaatttcctttttaatttcttcactgacccattggttgtttaggagcattttgtctccatgatttgtgaagttgtcagtttttctcattgttgatttctagtttatttcttttctttctccttccttctttccttccttccttccttccttccttccttccttccttccttccttccttcctccctccctccctccctccctccctccctcccttctgtattgctttgtctcccaggcccaagtgcagaggcacgatcttggcttactgcaatctctgcctcctgggctcaagcaatcctctcacctcagcctcccaagtagctgggactacaggtgtgtgtcactgtgcctacaggtgtgtgtcactgtgcctggttaaatttgttttttgtttttgtttgttttgttttgtatgtttagtagagatggctttcgccgttttgccatgttgcccaggctgttctcaaattgctgggctcaagcaacctgcccaccttggcttcccaaagtgctgggattacagccatgagccactgcacctggcctgatttctagtattataacgctgtggtcagtaaagatacttgatattatcttaatcttttaaaatttgttaagacttgttttgtggcctaacatgtgatctctcctcaagaatgttccatgtgcatttgagaagaatgtgtatctgcagctgttggacggaatgttctgtaagtgtctgctaggtgcatttggtctatggttcagcttaagtccaatatttcttgatctctctgtgtgtgtttgtgtatgtatgtctagataatttattcattattgaaagtgggctgttaaagtctcttactattattgtattggagtttatctctttaggttgaatatttgctgtatgtatctgggtacttaggtattaggtacatgtatgtttataattgttatatcctgttgttgaattgatccctttatcatattatgaccttctttgtctctttttacagtttttgacttaaagtctattttgtctgatatgagtattgctactcctgctcacttttggattctgattgcatggaatatctttttccatttcttcactttcagtctgtctttaacggtgaggtaagcctcttttaggcagcatgtagctgagttttttttccagtcctgcagctactttatatcttttcattagataatttatttacattcaaggtttttattgataagaacttatttctcccattttgttacttgttttctggttgtcttgtagattctcagttcttctttctctcttgtttacctctgtggtttggtcattttctgtggtcctaagctttgttttccttctatctcttgtttatgtatctgttgtaattgctttctttgtgggtaccatggggctaacataaaaagtcttgtagttataataaactattttaagctgatagcaagttaactttggtcacataaaaatactctagacttttttcctccgccatccctaatttatatttttgttgcctttatttctttagtatgtgttccctagccattgtagctgttgttgtttttgaccagttgtactttaaaccttcatctagaggatcgacaggtttacatagtaacatgatatcactggggaattctgagttggatttatacatttacctctattggtgaggtttatattctcacatgtgttcatgatagttatcattttttcatttacagctgtagcactcctgtaaacattgcttgtaaggctggtgtaggagtgaattccctcagcttttgtttgtctgggaaggcctttattctcctccaggatagttttgctggatatagtatcttttgtccttggccgagactcgtttttttttgttcttttagcatcttgaataaattatccctttctctcctggcatacatcagtaatttaatgttactgatgagaaatctactgatagtctaattaggattcccttacatgtaacttgatgcttttctcttgcagattttagaattctctgtcttcaacttttgacagtttgactataatgtgccacagagagaatctttttgggtttaatctaattgggaatctttgtggttccttcatctggatgtctatatctcccccaatatttgggaagtttttagctattatttcattaaataggttttctgtgcctttcttcaacttttctccatctgccagttctataatgcaaaaatttctttgcttagttttttttaaactttgggttatttcacaaaacctattttcagattttgaaattctttcttctgcttgatctggtctattcttgaagctctcgattgtgtcttttattcactgcattcttcagatttctgtgttttaaatgatagatcttgttttaatttctcattttataactttcctgatttcattgggttgtttgtattctcttgtagcctgctgaatttttttaagatcattatttttaattttgtttcaggcattttataaacacccttttctttggggtctgttactagagactcactgtgttcctttggcagtgtcgtgtgtccttgctttttcatgtttcttgtgacatctgcacatctagtggaatagtcacattttccagttgtatgcagtagctttcacagggagagacttttcctgtagatgggtcctagagtgttggttgggtatggtacattggctttggtttggggtggattcagtaccatggtctctgtgtagtttcgtcagctgtaatcttcacagcaatgtctgatttcctcagtggcctaggctgcaggagtttttgatggtggtatagttttgctagggacaggcatgtcatgctagttgtcaggctggacacttgcaggctcggagggctgacaagctgtcttttgggctccccagggaagagaaagtatgattttccagcttttcttctatgtttatttaaaactttgttgtctggctcacagtgttctttatctaaagtctagccagtggtggtggtcatattgcaatcattattacagcttcagactttctagaccttttccattttagtgaccttcagccttcattcgcttccattcatgaccacagaatagatgtagtcatctctattgaaggcaaacccatcccatctcttcagcttcatctagaaatttgtttcatctgttacactttctttctttggtttttagccttcattctctaccagctctttcacttaagcagagatatgttcaagactctcccattctaacagttccctgccttgatcctacaagcttttctctttagctgctaccttgctttttatttttatttttttctcacttgctctgataatctcctagaaaaattggcttactctgaccatctccattagttcacctcttaattattcttcaaccatctgagacctggctttgttctttctctactgaaactcttcaggcagagattagcagaagtcttctaattgctcaatgaagtggaaattttcagtccttattttctgtatttctccttcatttgactttgacttaactctcttggtttttgtaataccaccagcacctagtttatcagtctctcatgggaacttcattctatctgcctgccaaatggtggagtcccaaggactgtggtctgatctgctgttcctcattacatgctttctggtcagtattgcacactgtggttctcatctaccatcatctacctccagaagtgccatatatttagtaagtttacaagaaaagcaactttccttgctccgtagactaactctgatcttttgttccctatcatggttatggaactcactaattattcagcatcagctgtcagaatgtttaactttgctatttaggtttgtgtaagttatgggacaataactaggataactagaattagcttgtagcttatgtgggttagataatacaattgcatatgtaagtagtgaatattttggcttaataagtgaaggagtatttaggaagctatctggaatgttatctaagtcaggattctgaaggtaactctagcctcactgtcccttactcactatttctaaacacccaccaatcctgcctactttatttacttggtatttctccaatctgccatccttctctgtccgaccaatcactaccctagctcaggccttcaaagtctctcacttgacctactccttcacctcctttgaacctgtgcacaaatgttagcttcttagtaaggctttctctggtcacctgtataaaattcccatctgctacatacttcctggttccctgtattgccttatattcctcagtggcatttatctccttgtatactatataatttctgatctctgtcctttctattaccaccccacttcaagatggcaaggatttgtctgttatattagtgactgtcctaataggaaaaaaaatggcacatttatattagagtaacttgagaagaatttttaaaagtcagtatttataaagctgtagatatagagatagtgaagtactcttgggactagtaatcattgggcaggtgataccatttttaagcccaaaagggcatagtgaaagagcaggtgcctgaacctggattcagagagactatgtagaggaggccactaggcaggagctgtggcctttgcctcagcttggctgattacctcactaatcctcactaatcctaaattacccaagttccttcttttctggcccatttcacagtccaaagccaactttaagccagagggcaaggggagcacttgatgcagtccatgcagtatggcctcccagtgaacagggcaggtggaggatagaaactaaatctagatggaggagagggaagatattcagaatatgttttttctttactgtcagcaccttgaagagtgcctggcatatagataatatttattgaatgaatgaatttgttactggtttactggcctcatgaactttagttttgcctattctattataacttggtgactacattcctatatacttgataccaactcctcattaactacaaaggcagtattcccctctccccctttttaaacatcaaaactcttttttaaaaaaaattcttaaatgaatcgccagtatataacacataaaagtatgggtgccttgattggagtggtgggtaaatgatcctgagtctgtctgtttgggttccctctttgcctagcaggaatgtgactgtcttgtttaaagcccactgaagtagaaaacaggatgagagacacactcttcaacatggcataagatttccatgcttggctcctgcctatctctgcatcctcatttctcagtagtttcctcatattttaccatcctgtaattgaaagaattacaaaactagttctctacacaagctttcttgctgttccagctgctgggaattagcttcctttgtgcttttttttatttgaatgattcatgtttacattcattaaaattaatgaagattcattacagttgttttctctttaggcataattggatctcctatactgagacattgaatgcaactttgattgtttttttcccccattatatgttaagctccttgaggttcttttcaactttgcgttattccaggatttctatcgtaagagttaaggttcatccacttctctgatgtgaggttcatggcaggaaggttccatgttgctcagctgcagagtagaaaatactgagcagggcttaaatagattaggatgctgccattataatataaactgtgtttacgaaagagcatcatcaattcagaaaatatctttttcattgactacagtggtgcctgatgatctttctattacaatcttaaattatggtcattttaattatagaatcatacatgggtttatttatgttaaaataaggtaattatcaagctagctgtgacctatgagaaaaatcctgaagaaatgatgaagggatcaggtgactgtttttgaagtcaagtgtgaaaggtcagaccactctgggtcatgggaccctgccaaggcagagcaggtcaagtgctgtgcccagtggggccaacccccagtatggtgccagggactgggtgtgagaagtcaaaaattaagaatacacctcagaaaggggacatggacagatgccacagacttatttgcgtatttcatgatttagcccttagcttgtgctgatactggatcagatattttcagagttcagtattttcaaaagcatcgctgatcacctgttggcattgttttacatctcaaccaaggaaaaacttttgggacatctgtttaacaaggggtaagcttttatttgaaatgttcgattaaagcagaagagtcaggcatttttttgtgcctccccaaagaaagatttgtttactgtcctgtgtgaataaatataatgtcattatttcccgtaaaggaaaagctgatggggagagtaagtaatgggtaagattaggcaatgttaagctcatatattagtatgtttaagagtgatcaatttagggatctctgtgacagagatgccaaatgctcacagtgctatctcatgttggaaacatgtgtctcctccacttttcctcagtcctctgaaatgacggccctttagggattgacagatactatacagatttctgtgctgatatgtgatttgtctaaaacaaaagtttcacaaaacaattcttaccattgccatttaagagtcactctgatatgctctgtttccattgcaaacaaatgctcattatgatttgtgaaattaacttcacaatttcctaatggataacaccttgaagtatgaaaagcactacaggatcttttatagcttccctcctccagctctctataatctgctcccatctgtggtgtaggaaagatttcagcagtggccgctgaaggccctaagatcttgtctcaacagatagcaaggtgcataacagactttggacaggttgtttaacatgtctgagttactgtttattcactggcaaaatgaagggcttatattatattgtctctaagtactatcagttctgaccacctatgaactttcattttaaagaaaatacctatttctatggcctttaggcattagggaattttgtcaaattaaataaatctcagtaaggtttgatggtcaatggggcccactgtctggtgtgtgtggaggggtgttgtattttacatcaggaacttcagagccctcatgaatttctaattagaggaaccacctgggaaatataagtcaaagccctttgctcgccttactcagctttagggcacagtgactagaggtgggcaatcgctttggtgtaggtattgtcattggaaaggaagaaaccattttctggaggaaaagaattggttgaggctagctttaagcagctatttcatgatggacaaaaggactagctcatccattcttcattcgtttctctgtatcctctatcaaatttctgagtaaagattttatacaatgcttgattagcattcaaatagtatgtttcaaagattttaaaaaaaataaaactaggcctttgaatcataattatggcttataactctatttttcatatacttactatctcaagttacaaatttcatgttatgtttttttcaaaagagtattcctgccacaactcagagctcagctgaattagagcagtgactagaaaatctgagaaggctgagcttcaaaataaggtctggaaagtgtttcttattgttacaagagagtcaaaatgattttcttgagctttaagtttatgtaagtatttacttgacacttagcagtttaaaagataatgtgcaaaaatatgaaaatgagaaaaaacaatttcaaaacaagagttggtgattacgtgagacttagtagagcaaagtatattctaagtattaatctgtctaagctgtttgggaacagatgtacgtgaaatggataccgggtgttctgttgtgtacaccccaagtgagacatctgttggtagactgtgtggtcagaaataatggaagcaggggttaaaccccaatatgacctattactcatgtgaattattgaaggactaattactcagtaaaacatgatgctttgattcatcagtctacacgttaagaaaaaagcctctttagaaaaaaatttagttctgtttctaagctgtcaaatttgaggaaatttttaagatgtatgcaaagactcaaatttccatagtaactgcaaatactatctgcttataaagttttaaaatgttttgacaggtctactaatttatcataaaaatagcctcaaaagttttagctttttgttagggtaggttgggtctcacagaaaacaaatgtagagtgaattttctaaagcagggctgtccagttagacttcctgaaatgatgggagtgcactatatctgaagtgttcaatacagttaccaccagctacatgtggctattgaacagaaacatggctagtgtgactgagaaactgaatttttaattatatttaatttttattaatttgaattcaataactgcatgtagcaagtggcaactgcattgtacaacacagctctgacacatggagagttgaaaatgtttgtttactttcttcccaagttttcattttagtctttgtttctacatagaaaggaagatatagcttttgaaaaatgaacctgaatgtagaactgatatggttatgcaatttgagctgcctatttaaagataaagcaactgagtttagagatttcaaagtggcagagtcctttaacatatttcgtgggctggccacggtagctcatacctgtaatcctagtactttgggaggctgagatgggaggattgcttgagcccaggagttcgaggccagcctgggcaacatagcaagaccccatctcagggaaaaaaatatgtgtatatatatgtatatatatatatatatatatatatatatatatatatatatatgcatacacatatatacatatatacacacatatattaacatattttgtgtgtacaaaaaatatttttattatgtgtagattagttggttactagtaaagttgaagtcttgtctatagaaatcattgtatttttcatggtcattgtgatacattgtttgaactgaaatttggcaaattcaatctgtttcttactacaagaatagtacatagatttgaaatggtaactctcttagtctgtgtactctgaccctgtgaacgtctggagactaatgttattcctaaatatgctatgtccacatggcagcatctgaaggcaaacactttttaaaactgatctacttttgtggacccttcctctctctctttcctgcatcccggatggggccctctggggctggaactggcacagaactattcccctaggagtgggttcattgaagccaagggacacacaaattgagaatcagatagactggaccaaggtcattaaaccagagagggcaatccagatggggttgtccaaagtaggaagttctgaagtgaattgcagaaatccaaacatggcaaagctaaaggaatagagaaccagggcaatggatatagagaacagagcaattgggtatgcaggaagatgctattgcctagactggatgtttttgtaccctctgtaatttgagaaaatggaccgtccttgttgaaatggtcagggatgtagtagataaattcattgcagttgtgtaatctcagcactagaatactgatcataaccatatcacttgttatcccacctagcctgccacttgattgggttattagattacatttcagacattgacaagtctacaagcatcattaaaatcctaaacacagacttctgaccgtattcctacccaagttttagaagcactatgccaatgacgggggtagtatatgctgagcaggtgagttttgattgtgtgtgtctacatgtgtacgtgggtgtggtgagcaacaggaaggaactctcagccatgactctaaatgctcttgtgttggccaaaattggtataagctaggaggagaaacacaaaggagagagaggcatgaagttgaaggacattaaaccatttgcaaacttttggcatgcaaaccagaatatgaggaaacttagtgtaatgggtgactgaattcagaggtagacaggcaatcaggaaggtataggcaccaaaaatagttaccattggtgagcgtttttgtttttgtcattggcatggtgttatgaacttatgttaagcctaagggtaagtctaaaataatgtaccagctggcatcagggaattcccatgtacattcctagattttcattagaaacagtgttctggaaactaccactgctgctacacagcagtgcccagtgcttgactgaaaatagtgaacacttagatttgtttactctgccaggttctgtgctaagtatcttatcttgtttaaccttagcaaagaaactatgtagtctagatagaatttttatccctagggcccagaggtgttaaataacttgcccaaggtcataccagtaatttcagttgctggggttcaaagctaggcagtctgactccagagcctgcactgtccccatttggttatgttgcttccccagttaagcaagcaagagtctatctgacatctgagttggtggtagtaaagcatcatggtctgaaccaaaataataaaaacctttgaaacaacattatctgacttctttcaggcttttaagacagttccatcatcaacagcttattccatttctctggccacttccagtttctgaacaaatgaagaaaatgggagtgataaattggagtttttaacaagtttttttaaatctaattttttttatggaaaccaccaaacatacccaaatgtaggaataattatgtaataagtcctcatgttcaaccctaagaggggtgaagctctatgtgacccattactgagtttaaacagttttcaatttatggccagtcttatttcatctatactctacccacatcccttcttcccctggaatgattgaagtaattcctaggcatcatataatttcatctgtaagcatctcagcatgtatctctaggagataaagattttctaaaaaatcatattactactcttcaaatttaaaataatctttatagttttacatatccagttagtgtccagattttcctgatattttctctattttttaaatatgtcaaccttgaaatgaggtccatattatagctgatggctatgccttttaaattttctcatccacagattcttcttccttttttttcctttcaatttatgttttgaacaaactagtttggcctatagtttctcatgggcaagaataaccttcagactgggatggccatcactctgatacccgtaaaggggatgaggcaggttggggaagggagagcctcagaccatgatcagatgtcacaagatttttgcttacctagggtgaggacttgggaaaaagattgcccattaggagtcctgccttgggcaaaagtggccaaacttcagctgtgctgtcacaggctgtgggctgccttggaaatgtaggacctcaactcctctgaagttgaggtggagcttgagggtacgaatccctggtggccattataatgactacactcattgggatggcatggcaagttcatcctcaaagatggatcctagcatccaccatgaccaatgaggtttttttattgttatgatcactataaactcaaggatttaaacctattaaatgtttttcaattcacagcaatgattatttttactgatcttcaaattgtcacattttggatttttagaccaatgggagccccttcatcttgacttctgagttcttttgacattcactcagctgtctgatagcttccctgctttctggaatggcaagatattccaggttcatcttgaacatttcatgcttgagatatggaatcaagctcatcatcagagggtcctggttccttttactggatagtggtattagagacctcaatttgagaactaagcaacatcattgctaaaacttcccctatgtgtaccttgttacttaggtttttcaaagaacagagctagaaaatatgttgggtttttttgttttgtttttaaagaaaaaatgtatcataggattatgctgatacttccaattcaagtgcaggcctaagcttttcacattgtctcttttctcctacccttaaagtcctgattcctaactataacaacatcattactcatttgctttatcctgcattatgtagacacaatagagtaacaacaccaatgctgccaatcaaaagtataattactgaaacccacttaagatagtcctgcaatttttttttttgttcatagagtgtacactactagggaggtgtagtcaaattactatgttttaaagacacttggaataattcatatctgtgaagttatacccccaacttatttgttttttgtattattgtttcattttgcttttgatgtttaggcatttcttttttaaaaatcaattttataattacgtgaaatacttatatggttccaaaatcaaatctactaaacaaactatattctaggaagtatagcttttatgtttcccttctatgcttttccttccttcctgtaggtaggaaagcttatttgttcctcaaagctctgggttgttcttttattttatataaataaacatgtgcatatattcttttcattacccccacagtacccaccgtcttaaacacatgtacaatatatgtgtttttctaccttgatttctttcttacttagcaatatgcccagaagttcactctgtagcgctttacatcagcatcaaaatccattatgtactatcgtttattgacctctctgttggagaaatttggattgtttctagtcatttttgttatcgcaaatagtggtttaataaaaaactttactttccgttttttgtttttcaatgtgcttttaggatagatgcctagaagtgagattgttgagtcaaagaataaatgtgttaataattttgctcaatattaccaaattctttcaaaagggttgtgcaattttgctttttaaaatcattattgtataagggcatgtatttcctgaaaatttctccagaagagtttattgccaaactttaaaaaaacagcctgatacataataaatgatatctcagcatagtttaaatttgcatttttcttgttaaatcattcatgtttttactgtagtcctcctaacatttagggagcaccaattatggggtctctagaaggttccaggattctgtaatcaatttgacatgatttctgtcttcagatattcacaatcttcaggaagatatattgacaaaagaataactacatgatctattttgtgtgcaacttagtacttacagagcattataaatgcacatggaaaaataggtaaaggagaaaatcattctctgttgggcgggctgagggggaagtcaggaaaagctacagagaggttcgagggtaaactttaatgtgggccttgaagtatgatttggagttagcaagacagacaaaggagcaaggaaaccattctagaaaaagaaaattttgaaaaatctccagaaaaggatgctttggcctatttggaaaataacattgtcttatttatgggggagatgacagtgctttgtttttagtcagtagtttatacaggactttgaatagcatgcaaggaagttggcgtctcaacctgaaaattgaggaaggtgtgacaaaggctgggcattaggtgagatcaagtatttctgtttttttttttggtaaattaggtagcaggatagattataaatgggctccacactgaggagcccagtgtgatggctgatccagcagatcagggggcagtggctgcaaagctgggagaatggcaaggtaagcctggatgcaagggatattgtcaaagacaaaatttgggggatgtgaggcttaaaagggaaataaataatggtgatggtgagatttctagcttgggcagtgggatagatagtagacgctgcgcaaattcgtttttaaatcagcagaatgagaagcatcttatttgaaatatattctaccaaatcttagcatcaaatgtgctagtgactagcaaaatatgtaaacagaagggaagtagcttgaaaagtacacaaactggagaaattgctcctgaaggactgtaagttgaacccttttaagcctaagatctgtatttcctatgagccctaggctctttccttgtgtatcctgtttcttattagagtagaggctacttaaaaataatcatagtttaaagcgctctattttcagaaaacattattcattagatgttagtaaataatgtaatctttatacattcataatatttctgcattattggagtgtaaaaagtcagtgaaatagtcatttgtaaagatgtcagtttttatctgtggaaaatagctgttcataccattttaagcttaaaagttcttcatttacttcttaaaatatccatgttggtattattttgtctaatacaagtaattaatatttaccccaaattaagcttttaagtttactaaatgttacaaacataattcaaagcactgtttagtgtccatctgtgcaggaaaaataagatcaatacaattgagcagctgttagcatgtattggtttccttatattttaagtatgttttcatgttttgaaggtgtaaagggatgacagtatgttttgttgtggttttcatcatacagataaaaacttattacagttgaaatcttggtgaacataatacattttaaaatttccattcctcacccatttatctagatatttagacacagtaaaataaataacatggatacatttttgtcatgtgatttatgttttttaaaaagtagaaataaatttctctaaaagttatttttattttttaaatttagcatttttcatatttgaggaaaaaacaatatgtcttggtaccctagcttctgaactaataacacacctgtcattttacaggttattttaatgtttttcattgggatcaaacctactctggaaatatctcatgggtgagctttatttttatgaaatgttcttggcacttgaagacctttgtaggtacatgccagactcatcttacatccagttcttctgcatggaaaatatgtgcattgaaattctaagtgccttttcaaatttgaccttcttagagaataatatgagtcccaacaattaggaaaactatggaatgccttttggcctttacttttcaaagattttcagtcagtaatgtttaattagcattcattgtgtacattgtccttttttgtgtgatatggctagttccaaaggaatattctagaagatctcagccttctgctattgaaggtgataatacactactaagttatgtgttgctttacattaaaataatgttgcagcagttacttattgcttaactagcgggtataggacatcaggttgaaataactgattttgaagtgaagagttcttgtttatatcttaaactaaccaagtatgttcattaactttgagaataacaatgatctttttcattattcttgagtagactggataaatcagaaaacccatgttagaggtccctgtaaaaacttcagtcttatttggtaagtccctttataagagtttcaataaaatcaggtaaatttaaactctgaaaattctacgtactgtctatcatgttcaatttactgttaaccagtactatgcactggaaaaaatttttttcaccttaatgagaccactggtcattactgctgctactgatgctcttttgtctgcacatactgttgcaacataatgtgttgtgcatttgatacggatattatcatattgccataaggagctgctattattttagacaccaactgattccatgatagtgtcagatttctttaacatatgcttatgtttttgtacaaatgaccccaagaaacatctgctagttttgtggtggtatctactgtttcttttttagaatttgacctgtcagtcactttttaacgtgaatctacaatatttgagttgtattcctttctcgtttttatgctattgatattaacaaaattgagtcagttttatggcataattcagagagaaaccgaagctgtctatggatgttattttaaaaatacctttttcatgatgattgtgcctttaaatttttgtcattgattgacactttaaaattgaaaagtgcccttttaatggatcctttaggttccaaaatcttaagttgaaaatttctgtctattggtcctgaaagtactctctgaatttgataagtatgtagtagttgtggtgtatccttggtcagtttatatcctgtgctaattgctaatcttacttagtttctttgatgcgtgtgtgaagacaggcaaagaaaaaggaagtggaatttctacaaaactgtgaaatctttactttatggagactagagaaatttctaagtaaaagaagacactcattctattgtagttaggatcccttcttttacttgcttttcatgatcttgactgaaaagcaacaattgagatttccattgcccgacgctttctcttctgcttttctttttgtttctcttgcatttttaaagacagctatttattcaaaaacaatatgaacttttatttattggacttaaacctggaacatcaacaaaacaaagaacaaacaaaactacctttccaaatttattttattagaggatgctatcaatacaattttgtattatgttcacacttgataccaaacctaaacccaagaaagtgtgtcctgtgttacagcctatccctctgtttaagataataactagaacaatttacttttattttctactcatctgctttctgtgtatcagctgttgtcctccctcagcctcgaagcatgtcatcatttccatctccgtgctcattcagtcatccttgctgctcttagtcccctttttgtcccttgggtgacttatgtcattaggacaaccttctgtccccacttggctgaaactgagctgaggcccttgccagttgcattaggtgtggcacctttcatggctcagtttgggcctctgtgatatctgtgtgccttctactccaaactccattctgccagaggtggcagggtgactggaagctttagtttcagtgacaaaacccaagcgtggctatgctgagtgtctaagtagctttcatttaggcctgaaataggagagtcaggcgcctctgtgtcccctgagaaagagagatttccctcagctctctgggcccagcactcaaccatttaagtcagctggttagtataatttccctaaattgtggtttagtttccctatgagtaggactggagtaggaccaagtaaggaaagtccctagtgacctttctgcctcctgaggagcaggccatttactttgagttgtagcttcccatctgtctgtccccactaccctatccaaggccctggaggagccacaggatgagggaggagattcatggaaaagcgccttcaggtactgggtatgtctggagtaacatttaaagtttaaaagactctttaacaattttcctctgatacttactactgcctatacttgtttggttttagtacagtaagttttgcctatcgtgggggtgaagaaaatagaaatattcccattaactttgtatggtgcttggtatgacaccctgaacaggtgcacccgtaattgtttacttgatgttctttttaataagtcaattatatcatcggaaattgaagaatagcaaagttaatttgtttaatcattctatgggaactcttgcatgctcgttcactagaggaacattgcgtttctcccttaaaggacaaggctttgttttgtttttaataagacacactctttataattaaaacaaaatcccagtgttaagggatttctgttttaaataattggatttctttcctttgttcctctaatccctctatatgagaaaaaaatctaatggtgtcttaggataaatatttttagattaaaaagttctcttaaccactgaaatttaataatacttctcaaagtttatggatgatatagaatgtaatgtaaggttgagaattttagatttggcaaaggcaaagatacaaaaactagtgaaaaacaacaaactggaaacacttttaaaatactgatgtatttatctttgcaataaattattcagaaatataaataaactcactatttacatagttttatttaaatttgtcctcaaaatactaaatttagtactatatattttcttctttcagataaatgctttcctgaaaatggtattttaatatctacagatggtttagtttaacaatggttggggtaaaaatgacatagggaaaagcaaaatgtgacagcccagcttggttacctttagagaaactcagaataaactctattcccatttccttctctttcccctttccatactcgagagcccttttctgagactcttaagtcatgtttgggccttggagaggataaatagcagggtgggtggtaaaaggggagagtgctttgcttgaggcaaagttttcctccatatgggaccttcctcaagccctcccttcaaaccctttaaatgagagcatgagctcctaggacagaggtcatgtggaaagcagcattagcatgaaggggggtgctgtggaggggtgtaaggtgcaaaaagcagcattagcatgggggaaggtggggtggaggggtgtaaagggaatgagatgtgaagtggttaaagggccatttttctagttggcctctgggctttgatgaaccttttccagtgtgcctgtttctccacttagccctgggctaatcttgactcttaactttccaggtgtgtatctatgctgatttctcctgggtttggaagctctgagaagctctggttctagttcaatcacaagacttttaaagaaccagaaaaataaaacaattttttaaaaagtaatgaagaaaagacttttaaagaaccagtgaaaacctgggagtaaaaatatagaagacttgagaaatttcatctttacctttcaagtgggcagcatgagaaattcttgtaaatggtgctttcaaatcttacacaaggttctcagttacctttatttgtactccctagactgtattgcatcccttgctatgttgactaattcccacctaaaataattcaatggcctcccaatataatctggcattctaattaataagctaagaaattatttggtttttcactcattggcgttaaatattcttcagtgcccacatttggaaatattggaacacagaaatgaaaaaagatacaatcagtttctctgcttgccatgttttccttgatatggcaatacgacaacaggtcaccctttgaagaaaattcagagatgctaaagtagaaattaaaactgaagataagtcaaggcaggatagtataggagtctgctacagctgccatagcaaaatactacagcctgggaggcttgaacagaaatttatcttctcacagttcttgaggctagaagtccaaaatcaaggtgccattggggttggtttctgaagagggttctcttcctggctttcaggtggccaccttcatacagcatcctcacgtggccttttctttttgcctgcatggatagagatctctggtgtcttccttgtaagaacaccagtcctattggattaggaccctatgctatgacctcatttaacctaattaccctatttaaggccctgtctctaaatacagtcacactgggggttagggcttaaacatattttaggggaacacaagtcagtccataacacgtgatttgctatagttttcctttacctaaatcttttccaaccttgagagtggattttggccaggtgtggtggctcacacctgtaatcccagcactttgggaggccagggaaggtagattgcttaagcccagaagttcaagatcagcctgggaaacatggcaaaaccccgactctgggggggcagggggagtgggggaattagctgggcttggtggcgttcacctctagtcccacctactcaagagggtgaggctgaggctggaggattgctacagcccaggaggcagaggtcacagtgagcagagatcacaccacttcacttcagccctgggttacagagtgagaacttgtctcaaagaaaaaaaaaagtgggttttattcttccccttaaattcctattaatagtgaggtgaggcttcttgtgttttttttttttttttccaagacaatggttaatgtgtgattacttaaaaatgatatataacactaagaaataaagaattgttaagtgagaaggaacatattaaaatggcttggaaagatgggtaattttttacattttaagtaggttttctcaactctaactctgtggaacttggtcaatctaatcagtctaaatatagcacaaataataatagttatatggacaggagaaatagtagccctcaaagatagtgaaatacatctgaatatcactaacaatgtcatgaatttgcttgttctaaagttttctgaaagtatgaattcataactgagtttttttttttttgcctatgactactaatgtttgaggagagagtagtgtcagaaccacccccccatttattacatgtttatttcatattttggtactgaaatcagtgtttattttgtgtcttcctgataaatcttgccaataagtaattaccttccatactgaaaagttcttaggattaccaggttgctgggggcaaccttaaaaggccatgcagaacattgacttaggtggctattaccctgctttattcaggtctgagcatttactttcctactacaatcagaatactgacctacatttaaaagtgcaacactgccctgttatctaaatccactgtgttcctgagaggaaataccagaaaagagggcaccaatattatttttctgctgttcttgatcataagtgattacctttttttttggttaggcattctgcttctgaaagataactgaggttgaagttaatagaactaagattcttatataaaatcataggaaagataattttcaggattattgaatcatattgaaaaatgatataattgtgttaaaagataaggactaaaatgagttaattcaatttggaaatagttaaattagaatttgcttctgtttttgatgaatactgctttttgaaaaatcttctgagtatttaagcttttactactctagtcattctctctaaagtagacatagaagcgtgttcttatcttgatttggtaaggctctgaaaatgcaaagcaacagatgttgtacccagcataattatatgtatcctggaaacacatctttattgagtgggatttgttcttggggaaacaaaaatttggcaaacaaaggacattaacttgctgatctcagcagtaattacttgggttagattataataatcttgtgtaggtggtaactgcatgcatatattacaaaatctaattctaaaatacgtacattaaaaggaaaatgaacttgcgcaaactttagatcatgtatccccttgaagagcagaaaagatctcaatttcattatttgaaagttgtttgaacagctttttggaagaggtttccaggattccaaatcctaatatgtgtattgatactgaggctttggactaatctttgggggttactgccttttttatgcccactgaaaatagagcatttcaaacaaatgaactgatctctgatctttaagcatgccagtaactctttggaacaaatccatagttatttttaccaatgactgtattaaaacagtactttctgtattatctcttccattccaaggccattttaaaacaccctctttctcttctcccaataggtaaagtacgacagagctccttaggactgggttatggagaattatctggaggtcaatttgagaaccactgtgcaaaccatttcttaaataagtagctacaaggttgtccttacaaaaatttctgaagttgatggtgttgcgttttggagtctgaagcttaaataagagtttgtcagtggtcatggtctaaatagctgattactaccaaggtcatctaatttttttttaacacaaaaaaatgttctgagcacaaatgaaaccttcaggacaagacatttatgttttgagaatgttcttaaatgattcctgtcgtgtatcttattttacatatcttaatgatcagcatgtattttttgttgttgatgatgattttataaatgtgctatcacctagtttctaattcctaacagctccttcatcagtagaatattgctgtagcacagttttgccatctgttaagaaaagatggtgactaataagagtggcacatttcagggctggtgtgctatcgcaacatctagtgttttagtactgaggacagtgatgtatgcagtgttccttacagccatggggtgtgggaatgttttcctcttcggcaaagtctgtgtatttctatagctgaactctcaggatccagaggaaaaccacaagatgatgaaaccagatgattgtcatcaaatttctattccccactacatgattattagttttcgtcaaaagaaatactcatcctatcctgggttggaattggtaaagaattttgcattgtgactaggacacctaaaagtttttaggatgagtacaaatggaatttgatagatttccccaaaatgtttgggaaaagatttattcctccctaggaacagcaagagtagcagcatcacatgaggcaactcctggtaattttttcttcttgctcttatttcaatgatatcttttcattcttttctgtatctctcaatttctatgtttctcctcttaatgtatcctgtaaatttcttagtagaacctttttactaatgagggtttcctagtttgctttaggaggcactcaggatgcccccttttgtaaggcagtaaattgaaaataagaacttggtgaaggtccacgtgacggttagtttccattctccattgtaccaaactgctacagggaaagaaccatatttaatcaacctcaaatcctcaatatttaggtcagaaaacacttggcatagaagagacactcaaattttgcagctaaatagattattgatagaaaatatgtttcttgcctctacaagcaatatgaaaccaatacaatctctaaatatcttcagactactaggggcaaatactgtattataagaataattcttcagaaaggaaaatccagctactctcatatcacctctctatgttgaaagctagggaagataaactggcttccagccagtgagagtccatgtggacctagtgctggctggagatccctaatccaaaggcaagagccagatactggttgtctgctgaaaatcagaagatgacctctctggtagtaaggccagtgactcatccctgcatcttttatcctcttctgatttgtataaggatctctcctttttccccagtacccactctcaagaattgctttcctttttaacatgatcataccaaaatgtatctaacagtaccttgatttcctttctgaggaatttagggagcatatttactttgtcagactcattagaggtttggcttcttggtcgggttcttaaatggacaacttgtttgggtgatttggcagagaataggagaagccagtcccctctgatagagcaaacctggggagctgtggttgacccacctgctaactgtcctgtacaattaggcatgtggcatcagtgggtgactgaccagagccaccatctcaatggcggctgttctttccttcctgtgccttctcagatctcttttttgttcttgttactccactatattggtttttcttgagtttttttcaagcaaatatcattattcacttctactgcagttcctctgttgttcgctttttctcttagtcttcattgttttccattttgaacattcagagatccatcaaaaaaagtaaaataacaggaagggagaggtaaacaccagtcaaatgaagtattataatagtgtattactatactctttaaagtaattgaagggtggttttttggggtcagaatatctgttagaatttggaatttgccactcttgagactggggcaagctatttaaactctaagcttatctgtccttcctcacaatctgtaaaatgggatcataataatggcacccagtttatggtgtagtgagcattcactgacacaattaatctaaacttatttgcactacatagaacagaatttttgtctattaaacaatatagcgttttaggcatgaaagaaactttagattaaattaaatatcatttttcttaccacagggtaagtttctgttttgtttgcccctgtttctctaactcctagaatagtttccagcacatagagattaaacaaatattcgttgaatgaatgaatgcatctattctaatcctcttgttttaggaatgacccgtcaggctcaaaagtgaaagcatttccctcaagattggtgacagagttggggactaaatctaaggctttctcttcctacaccagtgtcctttctgagaacacgatgccattttctcaatatttgtttatttatatggtaaattggtaggaagctgtgtggtactataagaggataaactttgataatgaggtatacttgctatcaaattctaacattctcatttaaaacatggcataccatttgtcttctacattttcatatgtaaagtgaggtgatttctaccttatagaactattgtgaggattaactgaactaatctttgtagagcacctggtcccatttattttttttttttgctcaccccaccccccaactttctagctagataacttatacattcactctgtttttcattccttcttgaatctcctgtggccagacttgacccctgtcactctacagcttactcgtcaaggtcagtcctcatctgacttgacctactaagagtctgacaagtagtcacactatgctccttgatacagctttcttcacctaccttcttggatgtcattcttttggttctcctcctaccccattgggctgctttttcccagtctccattcttgggtattctcattttcccatgtctgtcctctgacttcttattgtctctgtttctgttttctctggttggaccttctctagtttctggcttcaaatactatctaaatgctcatgtctttcaaatttgtaactctagtctagacctctcctctgaattccagttttataaatcttctacttaaatattagaggtctaataaacttctcaaacttatgttctacaacaaactccacattttctcctgcagcctctaaatatgtacctcctatagattttcccatttcagtaagtgggaacttcattattctgattgtccaaaccaaaaacacttggagacttgctacattccaccctttgtctttcattctacatccaacctatcaacaaatcctgttgcctcttccttggaaatatatccacgcttgagcagcatcattgtcaccacttggtgttatacactctcatttctcacctggagtattgtatttctcatctggagtagtgtctgtccaacgatgtcccccatcagtctgttctccatgtagcaatttcgtttttgtttgttttaagattgggtcttactttcgccttggctggaatgcactggtgatcatagctcgctgtagcctttaattcctgggctcaagtgatcctcctgccttagcttctccagtagctaggactacaggcacacaaccacacttgactaatttttttttttttttaacttttactagagatggggtctccctttgctgcccagtctagtcttgaactcctggcctgaagtaatccttctgtgccagcctcccaaagtgttgggattataggcatgagccaccatgtctggcccagatgttaattttaaagtgtacattagagcacatcgttcttctgcatgttcagcataaaatccaatgtccttaatgtagtctatattaccctacatgggctacttgtgcctgatccctctactcttatgtcttatccctctcctgctttctcactagcaccagccacatcttaccgttccttgaacacaccaagtatgcatttgccacaggaccttgatgcttactgttccctttgcccagaaacccttggaaccagctatgtgttaaaattcagatatttactgattttagagagctaaaatggggtatatataatatattacataacactcacagctggtttgtggtagcatttcataattaaataatatttctgaatgaaacattaagaatgcccatgctaagagggatgagtaaagactcaactctcattgtcagttcagctgcagaatgaggtcagctcaagatttgctgccaaatgacttaagaaaaaaatgtttttggagctttggggatttcagaattgcagatgagagattctagacccgtacctacacagcatgctcccttattttgttccaatctttgttcaacgattatttattgggtagtcaaggaagatctctgtctaaaaggcttctctgtgtggaacaagactggcatgtggaaggtttccaattaacgatattgaaagagtgaagctcaaatcatttttcactcaaatacatactatttagaagacagtggccagtttaagaataatcattattggaaacaaagtactatttgattagggatagttaacacaaacacttattagtattagggatatgtgaaatacttaatggatgagtcatgtgctgacataaaacccattatccattttagttcctggtagcctaactggttgaactctgttttattgatctattattgatttggcctgtaacttcaagttacattttaatgtaatttcatccttttctgatcaccttgtgtcttcaagcatttttaagcagttgatagatagttgaaagatattatcactatttcaatctaaaagatattatcactattttaatctacttaaaatttttactacattcattttaagtatgacttatggaacgaatcgaaaatacaagatagtgaaaaacttgtgaggatcacctgaaattttagcattcactttccttacatagaggaacttagtctctctaaagaattatgagtaataaagtatcataatgatatttgtcttagttttggttaagtgtactccacaggagaaagttaggcatgagcaggaattattgtagtcccacattctcaaacagttctccagtaagaaagattttatgtgtttccagaaatcattttcctcctcttcagagctttgggaccataattgtatttaaattgctaatctgttttaaggaatcataataaattgtttaacatttatattcaatcaactttgtaatttgtataaatttttcagggtgacatttgaacaatttttaagaaaatgggaaatacagaagtattcttagttttaatatattttaaaaagatgacatgtgatctactgactgaaatccttcaatcatttttgtttttctccccaagattagatagaatggatgtgattttatttttaatttgcattatggagagtacttttggggggttttatgaaaaagacttcatttattttgttagtggtacttcagttgcataagaaaatgttcttttaaatatagtggtcatttgtgtgcagccttcaagttagcaaacatgcctttgagtagtcactatttttgaaggtctttatatctgattgcaatggcttatattcaatagtcctcctactaaatgaaataaaaatggatgcctcttctgccacagaggcacaggtggacatgttggtagcaagccccatgcggtgtgacacatggcacagcccaacatgggggcaaagagcatgcggcttgagctaggagtcactttatggctactttagtgtagatttgtgtttttctgtggaacagccattattgaagacatttatatagtatgatgtttgtttttcattaaatgctgattgtgatttcttaaaaatagttaagacttgattagcagaacctatttagaagccagagttcccctgcttcacctcttgctatctatataaatgatatttttgactctgtcctttataatgttggcaccctgtgcatattagatgtaatcagggctgaaaggaaacttgaatccatctggaagcaataaacttttctaaaagactgcacagtgttatttaatcctgtgacttcttactgtgagtgaaattaaggtttgatgcagttgtgtcacatcgtattgatatcaaatttatctttctaaaaaaaaactgacagtattacagcacagaggagaagatggcttgctgtaatcctgtaagctattttacattgattacatgctacataatgtacctaagtatataaaatacttgatctagaatgtttatgttttctccaaaattttctcatcaggtaatactttctcaacttcacctttagttttggcttcttatcatagtactaactatgcggtagtaattgtgttatgatgaaaggcatggagaagaaattataattttaaaactattataaagtggagacacacttgtataattaccatctatgtagactgccaaggtataaacatttagcttattttagtatcagactctttgaatcaatttaaggctttttcaataaaattggcttcctctaatttctactccaaaatggttaaaattttgttttacttcaaatacgttgtagggtatcatatttcatgtgactaggagcctaaactatatcagctgactggcataatttgtgaattatatgtgtgtttattaaaatttaaagtttttattaagacttacaattttattaagacttaatttttttccttacattttgagtaagtccaactgaaaataacttagagacttaggaaatttgactacattttataagtaatttccttgtaatttttctttcttgtggaaacaattcttactgatttacttaactcttttttcaatggcaaaaatgaaaaccaaatatatttgtcaactatattcttttaattgtggaaatgaaaggttcatatcccccatttgcctagcatattaaaaataaacatgacctttgtcttgaatgttgttaacttggattttaaaaatcaaaccaattataagctatattaaaattgcttatcaccttccctttgtcttcagtaagtctgggcctaaaaatactcatcatatgaataaataaagttttacaaatactttttagaacatcttgaattatatgtgtgtttgaagcttacttttggatgttcggtcaacaaggcttctgacagtttctttttatcttccctctattccctgccactgtgcaccccaaagtgatccctgaccacagtggtcccattgctggcatcaggaaggtagactgaggagttcaggtatcctagaggctgttaggtgaatctcttctacctctttcctggtcctaggaccactggacacttcaagtaaaaataacaattactttaatctctcaggtaaagtttcttctcccttccagcaacacagatctgcctgtgccgagttcaaatactctgaactttcaacagttgttctgaatacttttttgtcatcttatgatcaaatattgagagcattgaggggataactgaatgggcatggtataaaagtcagacttttagtgtttctaagtagcagaaccctttggacaatttagagggctgtgcgatatcctcaccgtgactgctgggaagtaatgggatctgacctgcagaggtactaccttggctgacaataatgacaaaagtgagagcaaagtacatatgactatccttgaggtcctcaggaaaaaaagagtattagtgagttgaactgtatgtaagggtctttaccaataaggaagcccatgcccagacataatccttacaccctggcaatagaaaccatcattgtggtttacatctcatcctgttcctacagtccagcaagttcaggccacaaaaggtttaagcactttttcctttgttctcatagcaacagttgcccatggaggttcagttacactaatattaacattttaatatacacaaagaagtgcctcgaatgtagtaggtattcaaacttgttaaatgaaagaagtaaactttcagacttaccttgaactactacagttttattctttctctaacctctcccactactaccatcttaaaaccaccatttaattagtattttataacaagttattaaaggctttcaaagacctttgaaccttcaccctctggtaagttaataacttctgatatgcgattaaatgtcaactgagtagtagtgggccctaagagctcagagggactgagaaatgaaggttattgtttagaagagtggctcaatgtgcttcgacagttggttaatatttgaaaagactagagtcaagaaagccttccatgtgctaggaaatgaaggagcaaaggtccagaggtggaaatgtatacagtgtgattaagggattttctgattgatagtaaatacagtcaataaaaaacttttattggaagcctagcctgtgtttgaagcattaagctaggtgctgggatacagagattagagatgaagataatgatgaagatattgttgaagtgaattgctgagaagctggagaaagggccaattaccataatctgaggctcaggaggaattggtgcaaagatcatctggtatgatatatatgaactgtatatacaaactgatctgtgtagctgaactgataatgccaaaaaaaaaaagactaggtttttgattaagatgaatccattaaggtcatgttttctgttggtgccattcttggagacctcccccaaccctatacatttataaatgtttttcctgagggactgagatggaagtggacatataaaaggaaaggtctgggcaaatacataagtaggtagtaaaatcaaggaacaaatgatctcaacaaaattgcccttcttgaaatgaatgaaaatgatgaaagccaatcacattgcatgatgaacttggggtatagaatatgaaatatttaaaattgctttatttcatgatgtttcagatgtagtaggaacttgttgcatagatggtgtaaaaacaatctagtaataaaatcttaggtatttaatacaaggtgaagaaagatgcaatgcataaatcatgccattttaggcttaattttcataaggctatgcctgtctttataagactatataccaggagttctcaagctttttggtcttggaacccttttatactcttaaatcgttgaaaaccacaaagaccatttatttaagttataaccattgatatttgttgtattagaaattaaatagacattaaaaatatttactatttaaaaataaccaaaaagatgggcatggtggcccacacctgtaatctcaacactatgcgaggccgaggcgggtggatcacttgaggtcaggagttcgagaccagccaacatggtgaaaccctgtctctactaaaatacaaaaattagccaggtgtggtggtgggcgcctgtaatcccagctactcaggaggctgaggcacgagaatcacttgaacccagggagatggaggttgccgtgagccgagattgcgccactggactctagcctgggcaacagagtgagactctgtctcaaaaaaataaaaaaaataaaaataaaaataacagtaagttcattgcatattaacataaataacatatttgtattaaaaataactattttccaaaacaatcaaaaaagcagtaccactcttctattttaaattttttcaaatctcccttttctaaaaaaaaaaaaaaaatattgtgtaagtttaaggggtacaagtgcaattttgttgcacggatatattgcttagtggtgaagtctgagaatttagtgtatcttcacccaaataacatacgttgcacccattaaataatttttcaacacccacccccttctcactctcttgagtctcctttgtctatcattccacactctgttcctatgtacacattatttagtacccacttaaagtgagaacatgtggtatttgactttctgagttttttcaactctggcttaatagaagacagctgaaatctcagaatgcttcttcatccagtctgttgtgaatatgttgctttgattcaagtatctaaggaaaatacagttttacacagatgtgcagctgaaaaggaaacatcttttaatatgttcagataattgtggatattgtcctttgatactatagcaaaacttatcaagtgctaatttcttaaaggctggttataatttgaaatctgaaaacatatctatttaattgtagtttgctatttgaaaatttattggtctgtcttgtactttgaatggatattttgcccacgtatgattttataacatcctgtattggccttttggaaaatttggtttactattatacagtttctaaatgttgataatttttattataatatattttaaaaagtctaatgtcactgccagtctcatcagaaaattctttgagattagaaagctgttaagatcatcatcacacttacaagttttacaaaattttaattttactcaaaactttatattttatcattgacaaagctctcagttgctttgcttagtgactgactcactttgttcattttccagaaagtgtttaccaaatgctgctgcctcaataccagagtctgtattgtcagttgatctttcaagtaaaaagtggtgttctatgaaaaacagctagttcagctgcgactgaaatgatataagtgtttctcctggagcaaaccaccacttcgatttgtagcagaaatgctgtatgtatactttccattgttattactcataacatttttaaaaatatactcaagggtggagatttttttaaaaataagtgttattgcttcatcaagaacagttaaatgaaactggattttttaaactgagtttgagttaatgaagaatgcagcaattattagtaaaatttggtgctccaccttgattcatactgacactccaggagttttacccactatttcttttgtacctttagtgcaaatgttaatatggtaggaatggtaaatgacatctttagtattattataaaaatcgtttttaccctgtatactctttgagactacacattgagaattgctgatgaaggtgttttaatttatcataagcactgaaaagatttacttaattcaccaatttctcctgaatatttgtttatataaaacaagactatgtgtatacacctacctttttattaatggtagagatctaggaaaattaatttctaagaactagccaggatatttggaatgtgaataaatcatatatccagaaaaaagctttagaagattgtctatgattgaaagtcaaacagctctcatttctattatactgttctttttcaaagaatttaccaattttatgtggtatttatgattaaacatacaccatgtaatttaacatttttaatgtcacttttacatcataggtattaaagattagcatttttattgtctgtattttaaagctcaaagaataacatttaggctgggtgcggtggctcacacctgtaatcccaacactttgggaggccgaggcaggcggatcacgaggtcaggagattgagaccgtcctggctaacacagtgaaacaccgtctctactaaaaatacaaaaattagccgggcatggtggcgagcgcctgtggtcctagctacttgggaggctgaagcaagagaatggtgtgaacctgggaggcggagcttgcagtgagccaagatcgcaccactgcacttcagcctgggtgacagagtgagactctgtcttaaaaaaaaaaaaaaaaaaaaaaaaatttagatttttgactgtttcattgattcatcttagacttcacatgaaaatatctgtatatcctcaaatgcttacattcttaagaagtatctcagccatttacacatgatagaaacaactaaatggaaaaaaattgcagttggaaattcactattttttatttgatccgataacaatgtgacatttgcgattggactgtaattttctgtctttctctctgaaaataagttcaaaaatttccctctaattcttttactagataagaagcctacttcgttgtaactcttgatatatgtatgtatttaggaacttaagcttttctgctaataaatgttatgtcataattcttgaggatagtattatattgtgatgggttttcagtaaactacaggagcagccctatttgtttaaaccctagtttaacctgattattaacaattaaattgtgttttcttctaacaattaaagtgtgtttaaatttattggtcccttgcttcacagatttatctcagtatgtggtgtattcaaacagaattttgtatttttaattaggggattagataaccaattctgaagagccaaaaaaattgttagacatcacattgcttaaccatctaatataccataagtgtgtgtatacactatgttgtgggagccatctatcaggcaggcctgtttttcaggcagtattttaaaaagtggacatgtgcagaaactgtgagcacaattagcgccaagcagataaatccagctctaatcctgtttacggtctacatcagacagatgtgccaagattgatttagacaagcccgaggcttacagtaatatttttaaaagtgccattcgctgttctatttttgttaaacctttgctaaatattcttaagtcttgttggttttgctcttcttattaaccaccgtaagtaacctactttaagcaggtcccgctttgctctcatggtgacaaggtaacctgccaggagaggttatctttattccctgtaattaagttgacttttccccccaaaaaaatacaacaataggaagtgggtgctgaattaaataaatagcatgatacccagtagatgtatacttaagttccttgcaagaacagatggtccccagtatctctgtaagtaatgtgagaggacagttaatgttctgaaacaactagctataaccagtatgatactaatgaaccagtagatttcaaataataaaccacatgccgccaagcaaaattatatgtcattcataaggatttaattatcataacttgcaaaaaagtgtcaatagatgatttctatatttttatctactgatatcaaatatcaatttatgaatagagtttcacttcatattttttaccaataaaggtatgttttaacattaaggtagaattaaagttatatttaaaatacatgccccaaagtatgtggtgatttttttttaactcctcttttactatactgtctgtatgtattgggctgtatatggaaatgtagcttttacatacaattaggaaaacaattgcttttatttctagcagaaacttgtactataacagaagtggctagcatgggaatcagagtagttatcttgtagatgacaactgaagcagacataaaagatgtaatattttttcagcactcaaaaatttataagtaaaattttataaacaaaaagcagtatttttgtgattcatatggaaaataaaatgagtctgagtcattcttaaggtgataccgtaaaggtgtatagataagaagtccatttttaaatatacccaagacaacagttttttctctcagtatggtttgttttcccttttttctctttaattatgtttcccataagtatttgtatattctaagaatgtccaaaaaataaatgttttgcagtgggggttgaaaagaaagaaagacctttttagatttcagctgatcttatcagatgatctctagaaccttgaaccttcaaccttcactgaagttagctggagggcttttcacctggaaacctgagaaacctcagaagccttctgctttagctctctctcaagtctaggaagccagtggcctgcgaccccacagagccagctggtccactcctcatataagaacttcggtaacaatacaaagacatagcaaagcaccatctaatctgataactcattaaacaatatttagatggctcaagactttaaataaaaacattttaagcttgtttatagaatactaacaagttttattcccaaagactatattcagagtgagaaaacaattttccttaaaactaatattatatacatgttcatatatgttaggaactagttatatgcaaaatcaagtgactcttgtgattagaactggtcacatttattcatgtagcataaatggttaatattgccaaaatgagtaatagatcagattttctatgtgagatattgacacctgagagatttacagtgtttcactgttgtgaaaaatggagtgctgaagaacatttgtctattgttatacatttgtaaaagaattcacaaattactaatttcaaataagaactaaatatttcttctaagcctatagtttttctttttaatttcttctaagcctacagtttttctttttaatttcttcttgtaacattggcaaaaagaccattcgtgtgaaaacctcagattttgatctgtacacaaatgcaggagtagagattggaagcttgagctggaaaagcaggaaatactgctcagagccttacaaggattttcagaattttcactgttgggtcctcctggttgctgcagtctaacctcgcatctccttgaaggcagccccagtttctgatgaaatactcttcagttaatttatacatatgctgtcttgctgttttcctaaggactgcaggcagaactgtggttcacctactgttttaaatttggctagatttaaaaacagatgatctcacttatatgtggaatccaaaaaagtcaaacttatagaagcagagagtacaattgcggttgtcaagagctgggggaggggaagcaaggggatgatggttaaaggtataaaatttcagttagacagaatgaataagttctggatctattgtatagcattgtgactatggctaataatgtatacttgaaaattgctaatacctgaaaatcactaagagactacgtcttaaatgttcttacaacacaccaaaaaaaggtgtgaggtaatgaatatgttacttagcttgattttaatcatttcacattgtaaacgtgtatggtactgatcttgtacctcatttcattttccatatgaatcagaaaaatactgctttttctttataatatcttatacagcatagatacaatttttagtggtcaattatattgtaatatatacataaatatatatgattttcattggtcaattatactgtaataaaacagcaaaaaataaagttgtaattaaaaaataatttggaagaaaaaattagcaagtggttggagattgaggaagatgggaccaataagtcctccaaggagagtcatacattagttttttttaaaagtccattattaatcttataatatttaatatgtttaatttcttgacacttattaatccaattaagtatgagaacactgtggataaatctaaaaaccttaaagttgagtaaaataaaccagatacaaagaagcacatactttatggttacatttatatgaagttctagaaaaggcaaaacttagctatagtaaaaaaatcatggtcctgagggaataactagagagtggtatgagggagctttctataatagtgggaaaattctgtatctttattgggatagtggttatgtgagtgcatatacttaaaaaaactcatggaattatgcccttacaaatctgtaatttttgttggtaatttataccttaataaaaaacaaaacagatgacagggttagtgattgtttccttgaagaaggtctttacatgggtctgttgttaacgagttgtagtaaaaatcatccaaaatgcttggattcaaatcttagatctgttcctaccagatgtgtgaccacagacaagttacttacattccgtcttcagtttcttctcttttaggaaaaagcatctagtttttgttgtagagattaaattagataatacaaatgaagtacagagaacagcgtttggtgtgtaacacatgttcattattagctacccttattttttagagaatggaaatttttaaatttaaactaatcaaactattttaggataagcaagtgaaacaatctttttttcaatcgatcacagaaatattttcactgaagacaaattagacatttatataagcaaactacagtgtcattaccattcaaattttcatatgcatattcatgcttacatgcatatgaaagcattacacatatgtattctataaatatatacaaaacagtaatggaaatgtgctgtactattttgaacatctttctagtcagcccggcattttatttacttttgagacagggtctcactctgttgcccaggcttgagtgcagtagtgtgatctcagctcactggaggctggaggtcctgggctaaaggaatcctcctacctcagcctcctgagtagctgggaccacaggaaagcaccaccatgcccagcttatttggtttattttgtttgtttgtttattttttatttttttgtagagatgaggtctcactatgttgcccaggctggtctcaaactcctgggctcaagttatcctcctgcctcagcctcccaaaacactgcaatcacaggcattagccactacactgacctctacattttaatagctgagtagccttctgttatatgaatatacttttttttaacaaaaccaatactccattattgtacatttaggttgtttccaagtttcactcaaataatgcttgggtaagtaagtatttttatttattattattatttttttgagatggagtttcactctgttgcccaggctgaagtgcaatggtgtgatcttggctcactgcaacctccgcctcctgggttcaagcgattctcctgcctccacctcctgagtagctggggttacaggtgcacaccatcatgcctggctcatttttgtatttttagtagagatgggatttcagcatgttggtcaggctggtctcaaactcctgaccctgtgatccgcccacctcagcctcccaaagtgctgggattacaggccgtgagccaccacgtctggcctggataagtattattttagctaaattgtgcatatttattcccttagagtaaattcctggaagtaaattgctggatcaaaaccaggtatattttaaagaattttccttttctacattaaaaataattataattctgattacaagaaaggaaaattatggagcttcataagaaaaaattagtctcatatttcatacctcatattgcatatttaataggtaaccagtgttaaatttgttgtgtgttttccactgggatttctttttatctcctttaataaaagcaggatcagatccctcagattactttgtaacttgcttttattctactttttcatacctcttagcatgaatgtctttccagaccagaatacagagatttcacttactcatttatgagctgcagaagatgactatgatttattcaaccattctcctattgaagagcatgaatattgcttcagatacttttgttattataaatattagtgcaattaacattttaaagtcttttgatacatattcccaacttgttctccagcaattaccatttttgcattcccaccagcactggggctacttccctttagttgcaccatcatttagcattatttttgatcttgtgccaatctaaaaggcaaaaagtggtatcttgttgttttaatttgcatttctttgattactaattagattgaactttttcatttgttcattggtcaatttgcatttcttcttttgtgaaatgcctgcttgggtcttttatgtactttaccattaaagtgtttttcttgattaaatagattatgtaactgtcatatgttgcaaatatttctgtccatttggcctttgcttatgactttttatgagtctttaggacttttgaggtctttattaggtattcaataattttaatgttaaatatattgatgtctgtcttcctttgtgtcttacggcttttctatttaaggttacgtaaatttctaatatacaaatattggtgtatattatgaaatagggccctatttttctttacaaaagattagtcagttctaaatcatcctttgctatttctagcggcgcttagatgccaccattatcacatcagtgaatttttaaatgtgtaattgtttcctgatctattcatttctctattcctagatacttctattgtaatagctttaccaaatatatctgatagggtgtgtactccccctcattacttcatttatttatttatttatttagagacagagtttcagtcacccaggctggagtgcagtggcatgaacttggctcactgcaacctccgcctcctgggttcaagggattctcctgcctcaacctcttgagtagctgggattacaggtgtgtgccactacacctggcaaatttttttttttttttttttttttagtagagacagggtttcaccatggtggccaggctggtctcgaacttctgatctcaggtgatctgcccttctcggcctcccaaagtgctgggattacaggtgtgagccactgtgcctggccccctcattgcttttaaaacattttcttactgtaatatatttattccaagagaattttcaaatattttatgagattccttgtccattccttacatcaaaaaataccacggagattttgattgaagttctattataagtagttacttggggtggggggaggggggagggatagcattgggagatatacctaatgctagatgacgagttagtgggtgcagcacaccagcgtggcacatgtatacatatgtaactcagctgcacaatgtgcacatgtaccctgaaacttaaagtataataataaaagaaaataaagagaatactggcatggaaaatatgtaatcttggaacttgttgtatctccacttattcaatcctttgtctctcagtagattttgaatggctctttatcccacacgagtctagaatcattttgctaagtttattcctagatataatatgctaattgatatgggaattttttttatctccattataccttcttcttgggtgtagacatatttgtagccagcttcctcactgcatattttttattaggcctaatggcattaagtttattattttggattttacaaaaaaaattatgataacatctttaaatagttagtttcaactcctcctttccccttaaatccatcaattactgtcttttatttcactttccttatgtactgactagaatgcctagaataattgaatgctatgagtaataataggtattcttgccctgtttttggaaatccttctggatttcagtaagtgtgatgttggcttttggtttagtatctttaaatttgcaatttacaagatattttacattggaatagtcattgagttgttaagtaaagcacaaacatgttaaattcagactgaagtacaggacttcaatgaaaagttaaaagagtttatttcatcactttcattttttctttccctcagtggctgtttgtcccctccccccaccccgctccatcccccagcttccttcctttgtgctcttattgttctaggtttgactacataaaaagagactctcaatttatatgtgatacaagaccataactaatattataaaattagtctagaagaagttatttgcaacctatataataagggactaatttcaagattatttgaaggactttaaagattggtaagaaaaaaatagacaaccgtttagaataaggcaaagcatgtgtagaggcaactcttaaaaaaaaaaaagtgagctgggtgtgatgatgcacacctgtggtcccagttactagggaggctgaggcaggaggatcacttgagcccaggagttcagggctgtagtgcaccacagtcacacctgtgaataaccactccattctagactgggcaaacataagaagactctgtgtcttaaagaaaaagaaatgaaaagatattcagtttcattaattgtttgactagctgatttttggaaaatacccacaaatataaccaagcctacaagttattttaaggtgggtaagagatacatcttatctatatgcattcacctatgtgaagcggacacccagtaacacccccgtgtggaagacaagcttccttaaacttcacaggacagtatttcccatgtagtccatcatagggtgaggatttttcaggacctttggtaagcctgcttgctttcattcttgagggtagaggaagggtgcaagacttccctggtctctcccaagcattttggggaccctggccataagcctacttgctcaacaggtgcaaatgactggtaatatgctgaccagatgcaagtgtaccaccaatgatttgctgtgactgagtttggtttcctttgcatatactatccagctttttgtttctaatatattcttccttaagggaaccaggacttcttggggaatccagatgagcttgaaacactgtttttataagagaagggctgttttcaaaaacatctatagttcgtaacaaaggagttagattgaagggactctcactgttcagtctgtgacaagcatgagtgttaaaatggagacaagaattttagttaattgtaatgttgaatttgtaaaaggctataacttcataatatgatcaaggggaacaagcaatctaaaatgtgttaaagtagcattttcaaagtgcggtccagggactctcagggttggtgaggtcacaactgtttttataatattgctaagaatgtatatcactctccttctctccaaggatacggtggagttttccagaagctatgggatatgtggcgatagccttgccctaatggagtgtgtgctttgtgctttgcatttttgtcctttaaaaatgcttggttttaattttgaatacaataattatagatagatataacctacataaaccaaagttatttgcggccctcagtctttaagggtgcacagtggggcctgagactaaagagtttgggaattgatgttctagagaaaagtcagtcttactgatgagggttaatcaattagtatttactgaccgggacaggacaaaccattcattttataaagacacacagagcatttcactaaaatacttttactctgattaagtggtgattttagtaatagtaatgattgtttgattttctgatacctgaaggaaaaagagcctgttgaattgatactttgagggtgttgagttttaggtcactgggtgactgtagaaatggaccaggagaagaactgaaacttgagccttctaagaaatagaagaccaaaaaatgtttagtgttaccctatcccatgaccacaataattgagaaaaaggcctttccgttccctcttccctaccctcccccttctcccctaccctctcctcccccctcccctccccctcctctcccctaccctctcctcccccctcccctccccctcgtctcccctaccctctcctctcccctaccctcccctccccctcctctcccctcccctctcctcccccctcccctccccctcctctcccctcccctccccctcctctcccctcccctccccctcctctccctccccctcttctccctccccctcctctccctaacccctcccaacctttcccctccttctctgtccccctccccctccctccctgtcttcctcccaccccccactccctgtcttcctccttgtcttccatcctcccttccttcctttccttcctgtctttcttttcctttctttcctttttcttctttccttcctgtcttccctcctctccgtctgtctccttctccttgtccccttctctctgtcttgcctttcctttccttctgtctttttctttctttctctttctttttcactcttcctttttttaatttcccttttacttgccttctctctttcattccttccatgctttcttttttttagtggtatgtatactttgtgagcaatcagactatagcttgcagaatagttgggagaggccaaaaatgcccctgagaatgcaagcaaggaacttcttagtgagcatatgaacatcctcactccaatcggaggataacattgttcatacttcaaggactaaaaagctgagagagggtctctgctttctgttacttttagcactcgagtcatttctgcatgtatttctactgattactttttctcctattttggttcatatgttttctgcttctttgcttgtctagtgattttggattagatgagtgacattgtgaattttactgtgcaggatggctgaattttttttctattcctgtaaatatttttttggcattgttctaggatgtagttaagttacctggaaaaagtgacatccttttgagaggcttgcttttaagttttgttaggtggaatcacagcagtctttagccagctcactaaggaccaatactcttctaaatacttaccataatgtcatatgaatttccatgtttttccacttcagctggtaggaacacctgtgtcatctctaagcattgtactgttaattcttctagtagttcttatctggctttgtacatctgctgatcaatactttcagctaaagtctcaaggggacctctgcaaatctacagtgttcactgttcagctttctcttctgtagtaaattgcacagtgaactctagtccccttagccttcctgaacccccagttctccttaactcagggagatcaccaggccccaccaggattcctgtatctgccctgtgacctggagattctctgcaggcaataggttggggcggtcgtagggtccactttgttttcctcctcttcggcttcactgtcctgtgttacctgatgtccaatgtctgaaaactactgtttcacgtatcttgtgtgcttttgtagttttaggtgaaaggtaaaactagtttcttattattccacattggccaaagcagaagttttggaagtctttttttaaggtctaaaacacttctactttgagagtcaattgaaatggtcttttccacaataattattttctgacctatggtttaaagataagtcatgaaaattttatgccactatttttttttaagtctgattatggttaaattcagggggctatttcctcctagattgacagagtttataatgtttcctactcacaataattgtacttctgcttcctctttgcatgtgttactttaatgggaatgtatatttccttttcgttaaggctgccttcaacaatttgtcataaagtcacttctgttagtgaattctattttttctgttactttactctatccttagtaccaaagagctccttatgtgacaccaatttattactaaaatgtcgctttgtttatgttcttggaattcttcatacattgactatcctcagatgtcgaatgttgtaggcctgtgtggcagggactctcttccatttattctatttttaatctaattcttgacaaaataaacccaatttttcttttcttcccctttccatctcacgtagggactggcataaagggcaatccataaaattacaaatgatgaatttttttggttttaactattattcatacatttaagatatggtcacaatttttatttcttactagtaattcattttattttttaacttttaggttctggggtacacgtgcaggtttgttatataggtacatttgtgtcatgggggtttgttgtacagattatttcatcacccaggtattaagcccagtacccattagttatttttcttgatcctctccctttgctcactttctaccctctggtaagccccagtgtctgttgttcctttctatgaaacacaatggttttaattggaaaatttatttttttttcaggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggtaagtactcctcatgggaaattttaatcagcccagtttccttgatatacatgattaatctagacatgttttgagtaaaaacaactttagtgatgttgagatagtttccttctgttcctagtttttgtcgtgagaaagtgttgaaatttgctaaatactttttctacattaattgagataatcatatttttccctacatcctgttaatgtggtatcttatattaattgattttcatatgtttaacatccttgcattccaggaataactccccaatggccatggtgtataatcttttaaagatgctattgaatttggtttgttaatattttgttgagtatgtttgcatcaatattcataaaacatattgttctgtagtttttctgtactgtttgtctgactttggcatcagggtaatactggcctcatagaatgagttaggaagtaactcttgaatgactattttcatgaagaagcttcaataatctgaaataaaatacttaaataatttagttcacctgagagttgtttttagaagcgtatttatttttctattaatgtcttttttgaactatataagaatgtattctccttccactcacacattgatggcaagtgtgtatttgtactctgtggcctgaaaataagatttttttgaataatcttaagaggccatgctttatactctggtaattgagaattacctatttcacagtagctttttctaaaggttaatttccagagaaaagagaacatgtttattaggatatatctcttaatgaattcagtgtatctgaaatttctaaatgacattttcatattttgcatactaaataaaattcataagtacaaatataatgcaattcataagtacaaatataatgcaatttggatttctagaagttatctagttaaaatatgatcttaggatttattttttttgtcttagatttatgaatcttgcttgtttttctgttaattcatttcttcttgtttgctgcatcagtcagatcagagtagaggcagcttgtatagttgatggcacagtttagggttagatggcacaggatagaaatgggtgctagacaaagagcagtcacagaggcatgttagaaatttccagttccagcatcattgatgaagaaaaccatgaggacccaagttgatcaaaggcagccagccaataaagctatgctcatgcgagatgagctgaagtgacattacattaaaattggaagaccctcttactaagtggctccatgcttccctgctagcccctttgggacttccaagaagacttggttatttcaagaagacaagaacccacagaggctgtagtttagtttatctctctggaaacatagagaatatgtataattaaataaaagcactttaatagtgaatcctttacagtgttatttgaaatttatgtcaagtgatttaaaaagtaaaaatgaaaattaataatttcagtggaagtaaattgattaacatgaccaggaatacataaaacttgcatggtcttgtctataaaataaggatatgtcatttaattaggagagtcaaagctcattcttgcgcttaaggtctgaggaactcttctcccatggggcttatgaagggctacactgaggcaacttcctcaatatatctcagccataaaaccaagagaaagtaagaagcagaggacatcacaacaaagctcaattcagtaaaagcaattttataggagtagagggacttgtcaaaaacaaaaacaacaacaaaaaacaatgtccaaatatttattcagcttaatgagtgatgtttttgtttgatctagggttaaaatctagacaaattacagagatgaataaactacatatcctttagtctaccatcctctgaaaatgttactttttgaaactttgattttgataagagctggaggcactcagggagtcattctctggcatggtctttgagtacagagtgattttgctgattaaaagcaaatagattgacttttaaaatcaactcatacaaacaaactgttaaaatcctctaatgagagtgaagaaacctaaccaagactgactgatacattactgctccatctctgcaccaaagtggactcagggaggcctgtaggagatgccaactccttatcctactccccacaaagacagttcttggctatcttcatcagacacaaatgaatggttgaggctccaaagctctctaccaattcttgtgttacactggcacttttaaaaaattttgtttattttttatttttaaatggagtctcactctgtcaccctggctggagtacagtggcgtgatcttggctcactgcaccctttgcctcccgggtttgagcaattctccctgcctcagcctcccgagtagctgggattacaggcacccgccactacgcctggctaatttttgtattacttagtagagatggggtttcgccatgttggccaggctggtcttgaactcctgagctcaggcaatctgcccaccttggcctcccaaagtgctgggattacaggtgttagccaccgcacctggctggcacttctcttaaaactaatatctcaagaagttttttctttaagaatcttctttcaattgcaggtccatgtagttctggtattcattaaagtgcctatcccaggggttttggtatgttgtgtttcaattttcatgtttcaatttttttgatttatgcattaattttgttttttcagaattcaggtgcaggttgtttagtttccatgtatttgtgtcgttttgagaattcctcttgttcttcatttctaattttatttcattgtgacctcagaagacacttgcattgattttgattttttttatcttattgagatgtgacttacgactatgtggtcaattttagagaatgttccatgtacagatgtgaaaaatgtatattttgtgttgttgggtggaatattctgcagatgtctgtcaggtccatttggtcaagagtctgatttaagtccagtgtatacctttgttagttttctgccatggtgatctgtctggtgctgtgagtggggtgttgaagtcccccactattattgtatagctttttttccccataggtctagtagtatttgttttatgaacctgggtgctccaacattgagtgcatatttatttaggatagttaaatcttctggttgaattgaaccctttatataatgccctcctttgtctctttttgatgttgttggtttaatgtctgtttcttctcatacaagtatagcaacatctgttcttttttaattttctatttgcatgctagatctttctccatcccttcactttgagcccatggttgtcattacatgtgagatgggtctcttgaattcagcagaaggttaggtcatttaaaaaatctaatttgccactttatgtcctttaagtggagcatttaggccatttatgttctaagttaatattgatatttgaggttttgttcctatacatttgatatttgtgtattgttaagtagttgctttctagtttgaattgtgtaattgctctataagatctctgagccttgtacttttgtgtgcttatatggtagcaagtattgttcttttgtttccatgtttagaactccttggagtatttcttgtatggcaggtgtggtggtaacaaattcccttagtgttttcttgcctgggaaagactttatttctccttcatttatgaagcttaatttggcagattatgaaattcttggctggcattttcttttttctttaaggaggctaaaagtaggcccctgatctcttcttgcttgtaaggtttctgctgagaagtcctctattagtctgattggatttcctttataggtaatttggcccttttctctagatgcctttcatattttttctttggtgttgaccttgcatagtctgatggactatattccttggggatggtcatcttgtatcttgcaggtgttttctgaatttcttgtatctggatgttaacctctctggcaagattagggaaattttcctgaattattgcctcaaatatgttttccaatttgcttacttcttcctcttctccatcaagaatgccagtaagtcataggtttggttgctttacataatcccatatttatcaaaggctttgttcatttttcagattctttatgtttgtctaactgggttaatttgaaaaggtggtcttcaagctctgaaatcttgtcttctgcttggtgtagtctgttgttaaaacttccaagtgttgttttgttttgttttgttttgttttgagatggagtctcactctgttgcctaggctggagtgcagtggcatgatcttgactcactgcaacctctgcctcctgggttcaagcgattctcctgcctcaccttctggagtagctgggattacgggcgagtgccaccacccccgactaatttttgtattttttagtagagacaaggttttgccatgttggctgagctggtctcgaactcctgaactcaggtgatttacccatcttggcctcccaaagtgctgtgattacaggtgtgagccaccatgcctggcctgcttccaagtgtattttgatgttccctttagtgaatttttcaattccaaaagttctatttggttttatcttaatatggctatctcatgtttcatatcctgcattgtgtttctggtttatttgaaatggattttaaatttctcttggctctcactgagtttccttgcaatacatattttgtttttttagtctgtcatttcaaagttttcaacttggttaggatccattgctatagagctagtgcaattctttggaggtatgaagacactctttttgtagtgttggagttcttgggcagattccttcttatctgagggagctgttgattcttatttttgaatttcctattggttgggcgggacttaaactttttttttttttccccttgagggtatgactatggtgtatgttgtgtgtgatcattcaactttgtttctgggtgctttcagggggccaaggctctttatggattccttgggcgtggtagctttcttaaatgctgcttattgtagcaatgtattggatttgtgagctgacactctatctcatgtggggctgagggtgcagaagtctcaggaagcttattttgtggagtagtgctaagcctttctggtagtgggctttttatttgatagtacagttcaggctgcaatccagtagatggcacttaaaaaataagaaccagcttgccctcagttaggctgatgtccagtagaagcacctgtcctgacaggggagtgacaggaagagattctgttggtgtgtgccgaggcctttggggtcgctggttggggggagatagggggaggtgcactagctcctcatgcaggaatgtgatctgcttttctatcataccccatcagagggctcatgaccttcagttcataaagattttttccttgggttcccagccatagtctgtctgtaggttatgcatatgcccctctgaaggcaaccaccaaaatggtcttggggcagagcctcttcccccagtctagggcagacaactccatgacttgtatgtcctccattgctgggacactgctgctctgtgtagggatggggagttgggccccaccctttatgtaagcctaagtggcattctcactttcagcaggggtggagccatcttgaaaaccatgaaaaactctttcttcgagtacctgtgctggcccccagtgggaagaaccactgctgcgtcttcaacagcgtgtggggtgggagggtattgccacagatgaccccctctccatatccgttccttgacatggtgttgccccctttagcgattggcactgtgcccacctttcctttgtcccaaaggggttttggcaagttgtgtccctctcccttataggtggcctacactaggggggttagatctctagaggttccatagctccctgggaacttgctggccccctgggcttttcaaagtcagaacaggttatgaggtatgtttgctggggatctggtgctacagagactcaagggtagagaatccctgggcagagcagaggcccaccactggtgcacaagcaatatggtgaccaccatctcagtttgtgtctgaggggagtatgggaacccctgcaggagctggccacccagttctctatccctgggaaattcctaaattaccaccaataacattgccctgggtcacaagggtggggccttgaattctttgggggttgatctctgccagactctagctacttttcctttctgcaccccagcttcttcccatgggcactccaaaaggtcctggctctctttccccagttttccattagaaacttgtccatttgacagtaactttgatcttctttctaagaagagctggcatccaaggtctgtggtcagctatgttggaaaaaagaaggagaaaaaaactagtttgtattaaattctgaaagactagtggcactggttaagtctttaaaggattgttaacaaaagaaaatctttttaaaccaaactcctaattttatcagaattgtaactgaaaatataaatgtatgaaaacataggtattatgtaaaatttgctcaataaaagaataggaaaaactactatttatcttggactgatagcatgttagtttgagatttgaaccctttctactctagtaagtagtggtgggaaaaattcactgtaggagtctgcagacataacaaactatcattagactgccaagacctccacataataaagcaagcagagaatgtcaaataagtatgtgaaaaatgatcaaaaaagagaaattgaaaatataaatagggtgctattaaaaaaggatagcatttatgttatgacatatgtacacatgaatatcactttttagaatttcatccttcttaggacttattcctgagtccgaggattgagaggttctgataaaataagtctcagtgggttccaggcatgggctttctttaaaagtctctccagggattctaatgtgttgccaggaccaagtaccatggacagccaagatctcatcagcacagtttgattgaatgaacttatgtagaaccctgaatgccacacttaaccaaagaaacctttccagggattaattataggtgacagaacatgctatattcttattaaatattattaaaagttaagcaatacccattcctgattcatgtaaaattctcacttattttccaagagttttactgtatgactggtttatgggatgcttggaaaaggttgacagacatggcaaaggttcctgcagtgtttctctttgtccatcaacagccctagctcataacctctaccctttcagctaaaagcaattagctcttcagaagtgattcattctatttatacttgggataagtaacatcaggcagtcttccctagggcttctcacgggccctggtggcatttttattctaagagagggttatatttttacatgtaattggtcataattatactaaaaacaagtaattggtgtcttatacaagaaaattatatttctgctttagtcattgacagagtatcctgagaataagagttaagaagtatattcattgtcatcttatttctgatatatttcaaattcttttgctaggaagaagcccttttgactgtgctttgtgtaacaaaacttcttcggagaaacaatttagataaactttgtcagatcttatgtgattatattcaaaatgctaattgaagattctctaaacattttcagtaaaatgttgaattgttttcatgctgttaaataagttaacatgtcttcctttactaaagtcattattataaaaatgtaaatcctaatgataatagctgatgtttattaagcatttagtaggttccattttttgatagcaacttttatgaattatctcattaaatcttcataataatagcatcaagaactacaaatatgttttcatgtaagaagggaaataaaattatgagttttgctgtgaggtttgaagaatgaaaacaatgcatgacttagaaaatagtataattaagtgaattttattatcattatcatctcttagtttataaatgaaaaaactaaggcttacataatgtaaaaatcagttaacaaggttaaacaaccggtagatggtagaggaggagctgggaataaatctgtacatgtctgaatctggagcaggaacccttaactgatgtgtcattctagcaggtcatcagttactctacaatacctattaagtatactttatttactgtgtttagatttatagtagatttagactctactgtaaaaacaaggacttcatacacctgctagaaagtatccatatcatcttgtttgaaagttgtcccgctctagtgttcttttctaatcatgatgattcagaactccaaactcttgaagcagggcaacccgtagggtcagcattcataatttctcaatacttaaaaaagtttcctcatgactgttgctattattgagatttctcaaatgtcttggcctgaattgggtgtgcactatgaaaaaaaaaatggcagacatttctttttgttaaaggaattttaaaaacacatataaacacactgatttgtgacagattaccaggctttatgtttagcagggtttcctaagcaaaacacaaattctgtaaatctacagaattagataaaacattgactcaatccttagatgagagtataatggattatcacttaataacttctgtcactgaaaataaatgatgtaaaaagtaataaagttctactctcacagtatgaataaataggaaatacataatactttaaattaggcaacaaatcattaagcccccagcattcattagactatcattaatgataataaaattgtgtggtatttatacagatattatatgtaactccaggaattttgttataattgtgtatgaatatatttgttgtttgaggcaggtagatggatatttgcagcagctatgtgctgaagcattctggtaatagttttcaaatcaaccatttttttctccttgtcgatcatctttaaagcaaaagcaccgttttttactatattttttgaaaaaaatacattaggtgtaaaattatatattttgaagaagttcactttctgtttttactagtttcacacctttgttattttttcagtggaaggagcagagataggcaaaggcgaagcctgtgtgtgtggtcaggttcctgggcccttcatagcatctgatgccaagctgtgttctcttttgtgtcattgccttcccacttgctaattacgtgacagagctagggacttccctctgtctagaatgccccccatctcttgtttgcctagtgaaatctggtttgaagttcaaggtctgatacaaaccaggtgatcctctgcaaaactaactgtacctgagcaaaccaggcacttactcttttatatgttcctggcactgctgatactctgatagaaaacatcatcacttaatgctaactgtgggctcacaaaggggatacttctactgtaagaagactgtaactcttcttagcacagagattagtaagtacttgaaacagagtttcacatataataagtgttcaataaattttattttttatttctaacacttggcacactgcatagctcagtaaatgttggtgaagtgaactgagtattctccttatctattatgtggtaggcattattctagttgcttctgttataaaccaactcatttaatccttatcacagcacttttattgtggtcaatattttttaatcctcacagatggctaaggaatcagcactctgagagattggttgacttgctttgggtaaggtgcttataaagtggtagaacaagattcctatccaggccttctgattcaaaaatacattctttttttttttttttttagtagtgttttctggaaaggcagggtataactgactatgctgtgtatttgggactaagtatattattgtcaagtatattaaaaatgtcgcaacactggaaaggagtccatcaatgggctatgcaggttgagggatttgtagatgagaaactgataaatttggttagcaaggaaagccatcaagctgtgaaccctttatattggcaaaagagagggtcctttgaaatctaagggaacagaactttcctgttctccaagtttggagcagaataggtaagctctaggcagtctaatgcccaacttttaccagtggtgttttagttttttttttttttccaaaaggaaatgatggaattctttatatacttctgaattgtctatcttttcaaaaataaaaattttcattttgcagtacatacagaatcaaaagactttcaagtcctaactccacaaatgtttattttgaagctctttaaactgtttaccacggatattagtaaatctgtcagaaatgaggtgacttacttatccttgtcccaccagatatgtgggaaggatgatcacgctagatagcatggatgggtcctctatttatctctttttacttgaatggaaaacacatcattcagattaatcaattagtcattgtgactgatagaatttttatatggataatctgggtttggtccctagctttaccacttacttggggtctttatgtcttctatggtctcctatctgtaaagggaagttgataatgccaatctagctaggttactgagatgcttaaatgtgtaatgtatgcaaagcagcaggtactcaataaagggtaactcttactattattgtatagctctccaggtatgtattgagcttctatagaatccatagccccaaactctttagccctttgagaccaagattaagcattgtctttccagaggagagggtgagagagattgccattatactaatagaattcatcattatcaccgtcatcatcatcatcatgatttcttggtgtgtcatggaatgtactgtgtttcacattaccaacagatgttaattttcacaacatccctgagacaagaaactatgattacattttacagataaggtcatgcagctataaagttgtgaaattgggattcaaactcaggcagtctgtccccacagtccatgttcttaacccaccatgctctcctgacacttgaaaagttaggaggcgtactccatagcctgtaatgttgctgcagagagaatctaattttaaatccagtgaagcatattagttgctgtctttgatatgccattcagattgtgctatccttatgatgcctaccttggttgtatatgtaactgggcgtcaaatatataaatactcaaaaagtgataggtgccaataaaatattttatagttaatacttatgtaatctgtgttctctgtgtttgagggctggttctaaaatactgctctatatttgacttctggttaaaacaataaactttgctcatattagttatatagttgataccattctcatgttgctaacatgtctgtaagtaacagttgaaattgatctggcaattttagagctgtcagacccaggagatgagagaaacatttaaaatgtttataacattaaatcagctgagtcaagagagagaaagagaaagatgattcagatttcttgtactggtggatgtaagtgcttggaactgaaataaaggagaaggtgtagggagggagaaagataaagaagtcttccctttatacaagttgaaattgagttttctttgagatatagaggtgaagacattttaagaaacttcttaaaactctctaatgtggcttttcaacctgtttccatcaatttggcacatctcacttttcggcacaacagaatattctaggtttatctcacaccttccttgccccagcccaggaatcagccatttctctaagaaactcttgtttattttggtggggaacagtattgggaaaccaacatctgggagctaaatatactcctagtggttaggaggtcataccttgtagactcttgtagctgacggagttaggacatatttattagaaatcataagtttatattgatcttgctaggatctatccaatcctacaagattcttccctgtgtctctcctttgtatttgtgtatcctttcttccatattaagaactgtggctcccaacaacaaggcatgtgcccatttgcccaatcgtatgatgtataaaaactactttgagaaaagtggcagccaaaccactaagaaaaataaacttgctgaaatgagttcaagatttattggcagctctttttttggcccctagactgaaagtatatatttcaagtattgtgttcaaaaattatttgggttagctttttccacctttcataatagtaatattatttacttgaaatacagttggctttgtttctatattcagtttttttctctctatcttcattaatttcattatatatatttaatatgtaggacattaacatgtttccaaaagaagaaaacactccttcctgtatcatttccacctcatctctcttaccccttataggtaaccrattgcactggtttctagtttatcttacttatattcctatttgaaaagttacctcatatatgtatgttttttaaatttttatacttttttacacagaaagtaacgttcagtatgtactttgccactttccttttaaacttaacagcgtatactggaaatcactccatatcgtgtcacagagagcttccttatattttttaatagctgtataagacttcattgtgttgtctgtaccatattttattcacttccccatgtgtggacattttgactgtttctagtatctgcaattactaataatgctgcagtaaactttgtgcatatcgtaccttggtaaatttctagacatagatttctgggttaaaggttaagcacatgtgtagttttgttagatattgataaattcctttccatggggtttatatcatttttaaaatatttaccagcaacgtataacagcgtccattacttcaaagcctcaccaacagattgtatgttttaagtacttttatgttttagaatttttccaatgcgataggtaaacaatggtatatcaatatagttttaatacattaaagttcagcatcttttcaagttcggctagtctcagggctattcttaatatcttgtgaattatcttcatattattttcccatattccataatacttttggttttttttcctcctcaattctgacaagttctttatatttcaggaatattagccattttatttgatatgttacaaatatttttctcccaatatataacttttctcttataacgatttttttttcatgaaaagtttttaattaaaaccttttatgggcccaggtgcagtggctcacacctgtaattccagcactttggaaggctgaggtgggcagctcatttaaggccaggagttccagaccagcctgaccaacacagtgaaaccctgtctctactaaaaatagaagaacattagctgggcttggtggcacatgcttgtgatcccagctactcaggaggctgaggcatgagaatcacttgaacccagcaggtggaggttgcagtgagtcaagatcgtgccactgcactccagagtgggcaacagagtgagactctgtctcaaaattaaataaatatataaacaaaaccattatgggccaggtgcagtggctcattcctgtaatctcagcactatgggaggtcaaggtggttgaatcatttgcgccaaggaactggacagaccagcctgggcaacatgggaaaaacctctctctaccaaaaaagaaaaaaaaaaaaattagctgggtgtggtagcatgcaccagtagtcccagttactcgggctggtcacatgagcctggggaggtcaaggctgcagtgagcagtgattgtgccattgcactccagcctaggcaacagagtgagaccatttctctaaatacatacatacatacataccttttgtggagttaaatttacacactttttctttattggctctggcttttgcattgtagtaagactttctttacactcaacttatagataaattcacccatgttttcttctagtacttgcatagttgaattttagatctctagtccatttggagtttattttttgtatggtagaaggtattgatcctattttttcccaaatagttgttacccagttgtcccaaaacaagttattgaaaagtccatctttgtcccagatagactggaacaaaatgaattaaagacttaaatatgaagatttttacttgtgtatcctttcttcctagaaagaaaacataggcgtaaagcttcatgacgttgaatacttcatgccattggtctggcaataatattactattatgaaaggtggaaaaagctaacccaagtaacttttgaacacagtacttgaaatatatactttcagtctaggggccaaaaaaagagctgccaataaatcttgaactcatttcagcaagtttacttttcttagtggtttggctgccacttttctgaaagtagtttttatacatcatacaattgggcaaatgggcagatgccttgttgttgggagccacagttcttaatatggtagaaaggatacaccaatagaaatatttatatttaagtctggcaatcatttttaagatgtgaacttgaacaggcaacaaaagcaaaaataggtacgttggattacatcaaacccaaaagctcttcacagcaaagggaacagtcagttgagtgaagagacaacctatggaatgggagaaaatatttctaagccacacatctgacagagggttaatatccaaggtatataaagaactgcaacaactcaatagcaagaaaacaaataacatgaataaaaaatgagcaaaggatctgaatagacatttctcgaaagaagacataccaatggacaacatgaaaaaatactcagcatcactaacaatcagggaaatgcaaattaaaaccacagtgagatatcgcctcacacttgttagaatggctgttatcagaaagataaaagataagtattggtggggtgtggagaaaaaggaactctagcccactgttagtgacagtgtaaattagtatagctgtgatggaaaagagaatggaggttcctcaaacagtttaaagtagaactaccatatgatccagcaattccacgactgggaatatatccaaaggaaatcagtatattgaagagaactgtattttagtgattattgcagcattgttcccaatagccaagataagggatcaatctgagtatctatcaatggacaagtgataaagaaaatatggtgtgtatacacaatgggataccattcagcctttgaagagaaggaaatcctgtcatttgccacaacgtggttgaacctggaggacattagctgagtgtaataagccagccaccaaaagaaaaataccacatgatctttcctatatgtggaattttaaaagttgaactcaaggaagtagaatagaatggtagtgaccaggggtatgcgataggctgagggatcaaggagatgttggtcacgggatacaggatttcagttagataggaggaagaagttcaagaggtctattgtataccatggtgagtatagttaattataaagtatacttgaaaattgttaagagtagattttctgttcataccacaaaatgataagtatgtgagataatgcatatgtaaattggctcaatttagccatttcacaatgtatatatatttcaaaacaacatgatgtacatgataaatatacagtttatttttaattaaaaattttaaactctctaattggtcttcaacatatagtacacaagtcttttcacgactctttataatggaacatatgttcttggaatgctaaaaattattttttttggaggccctgcaaataactaaaaatttatcttaaaagccacacctaattacttacatatgatccagaaaggatactttgaaaaagctttttaattgataaaatcattaaggtaaaacatattcataaaagtgttctctaataattttataattttctagttcatgaaggattaaatatacaactatcatttgaattggattttttatgaggttaattgtatttaaatgctaattattttaactaattttgtggttgacttctatgtagagtagggaaaaagaatttcctaaagccagttacgtatatctctttttagtctggatttttaattaggaaaagtgatatagttaaataggtctactctatagcatcttctaaaatgagtaaaaattcattatatcaggataaaaaatgataaagatatatggatgacacatttggctgaatttttcttcttcgctgttctcttgctctctatttaaatagtcttagctcttttatcatttaaattctgaagtattgaggtgattattccggcagcaggtgattctgctaattactgttcagtcagttttagctattagaaacagagatatgtttacattgctgggctgcatgtaaatttagaagttacatggctttgtttttactttgacttacggcattaaaattattttcatctgtgtatgtaaagatctgcatctataagcttttgtggataataaggtgaaattgatgcattttaatataaattgccaatataaaatatctctaactcagacctctactggaaagttgtcaaatcttatgtaggaaaggcttttaccatcactgttacacattaactgggcatagtttaatattaatagctcctgagacttgtggttaactgaggtttctatttcctgtgtttgggttttatctttgcaacaacttggttgcttttctgtgtaaaatagtggtgaatatacacaagagtatgacaaggttctgggctcttaactttgatgaacaccatgccatttccatcatgctgcactcaaaacagcacagatgtgagtctgggagtggcgtccctgccgctctcatgagcctttgtttggagaacaccctgattaacccccacccttcacggttcattgactcactgatagatcaagtttaaactagtatatattagcacatttgttaccaacagaggaacagttggccattctgttttacattgctggttcattgcaaactggcgtgctaaaaaggtctgtactctagagtatgaattgggaagttaccaaaggactgagaaccaagtcagttgcatattaatgttgaattatacctatattttaatcttggattgtctacttgggggatgcttacactgttgtcaagttatgaataagtgataattaccactttgaaattcatctttttttttcaaggagtttaggggatttaggtgtctcaatatagctttcatattaaacagtttgtcataattggatgagagcagagcaaggtcatgactacctgatgccttgtgttggagcattttaaaaatgttttccagagagttatttgtacctaatgactttacataagtccttacattatactttatttctaggtcacctaaaaatgttaattgtttagtcaagagggttaggatgtgtgtctgttttctcatgaaaaaaattaagctgttccctttttatcaattttcttgcaatctaaaggcttttttttcttaccttcctaacctagtgactaaggtcatcttattgttacagttcctttcatgggagataggtttactgcatcatttggcagtttcatagggtgaattttgtcttggcttcatctttccttactggttgtcatcccctgggccacctgcttttttgcattttcctttctcttgtgagatgatgaagctctgtgccccgatggggatgagagacagcactctgagttcaagtctaggataaggcaatgggcttgcttttcaaaacaaactagtgtcatacgggctgctgctttcaggtccactgtctgattttatcactgatgacttgtttctggaaggcaaactgatttaagttctgagcaaaagggtcggtgtttattttcaatgctactattaatttagagttttaatttagaaaagattttttaccagttctcaaatatgatttttctattgactttaagtttgtagatataaggagtagacatgagatagagactgaattgcttttttgtttttaaaacttggcagtaataaggggttgcttgttttttcatgctaaatattttttctaagggatctagatacctatcagaaaacttaactttgataactctggttctttattaagtatttttgtcttattttaggaattaatagaaatagttgtaattttagacttcctttataaaataccaatttaaagagaagctttttgcttaaatgattgttttgcagtgttgtgcttttgttttctttaatgcagttgaaatcgcagctttataacttattttttaatttggggtttttaaaagaatattagttatttatttatatttattgggcacctactgtgtgccagacactattctaggaactagtaaacatagcagagagcagaatcatgaagttcttgacctcaaggagcttaaatcctagtggtagagggggaattcaaaaaaatcaaataaatgtatttctattatgtcaagtgatggtatgtactaccaggcaatcagatgaaaatatttcctcttctatacacagtgggcaaggaaggcttcattgactgtggagttttagaagaaagctgaaagtaatggggaaagagagccatatcgatatatgaaggaaaacatggtccaagcagaggaaacgaaaagtgcaaagaattgagcaagaaagtcatgttcaagtggagtcagcaggggaaagagtaggtcacaaatgcggctgagggtgggtcatgaagggccttacaagctttgtatgagtttttacttttattctgaaaaaaacaaaaacaaaaacaaaaaaaaccggggagctatttggggattttaatagaaaagtaacataatttccttttaaaatggatatgtggccactaagtggagagagtggtgtatatatgagtggatggaataattgatacaggcaagcaggagacaggttaaatgaaaaatggattaatccaggcaaaagatggtgacttaaattaagctgggagtgggagagatggtgagacatgcttagactttggattcatttttccagatagaactggctgacagagacatgtcatttaccaacatagacatggcagattttttttttcttttctgagacaaggtcttgctctgttgtccaggctggagtgcaatggtgtgaccatagctcatggaagcctcagactcttgatatcaagtgatcctcccacctcaacctccctagtagttgagattacaggcatatgccactgtatccagccaactttttttttttctgtagagacaatatctctctgtgttgcctagggtagcctttaactcctggcctcaagcattcctcctacctcagcctctcaaagtgctgggattataggagtgagccaccatgcctggccaatatggcggttattaagaggataagtcaaagattacatgaatattctgttatgaaaagtgtcaaacatatagaaaatataaacagtattccagtgggcacccatatttttatcaccttgattctacagatcttaacatttttctgtatctgcttcaaacattttattctgccaatgtgttctaaagtaaattgttgatattgtgatagttctctccaaaatgctgcagtgtgtagctctaaaaatagatatttttcagataaccaaatatcattaacctgccaaatcaatgaatgataattgcttattaacatttaatacttggtccatagtcaaattctccatattttccataatgtcttttatagttaacttttaccaactagtgtctgatcaagaatcattcatttaactaattacatttaaactgtaacattacaacatgttttttcgtatgttttattctctctgacattgacttatggaagagactagattatttgtcctgtagacattttatcatacataagagttactaggagagctctgattactagtccccactctcagaaattttgattcagttgctctttccagtgagctgctggtgatgctggactttcattctgaagaccatactttgagcactactgctgtaccactatccgatggcttctttgtgatatcgtttaacttgttgttctgttgcctgtatttcctctaaactgaattttcaatctaaaggcttactgagattcatgtttgatactttgggcaagaatacttcataagttctagtgcttaatgttaggtagcacttaattctgactatttcactattcatgaggctaagctaaggaggtgacagcctgatccttctattgtaatgtttcatgtgaaactactagataatttgttgagttggggggtgggtagggaagagatatctagttttcaataaatatttcacctaatggttttaacacacattgatcatccttgcctgaactaattatttaattagggatggcaacatggagactttctaattcaatctttttttttttttctaaatgaatggccttgtttttatttttaaatggatgttacttcgcaactggggttatttgattacccagaaatatagcgcatattaaaaaggtaggataaatgcttagttaactaattaagcaatttttaattaccagttttcacagtaaggcactaaagtttctgacttgagcaaagataaagtggaaagataaagtggtcgtttagtgagatgggcaagactgtggataggtagactaggtttggtgggaaagtcagaatatcagttttgaatatgttaagtttgagatgtctattagaaacatatgttgacgaggccaggtgcaatggctcatgcctgtaatctcagtactttaggaggctgaggtgggcggatcacctgaagtcaggagttcaagacgagcctggccaacatgtgaaaccctgtgtttactaaaaatacaaaaattagctgggcttggtggcatgcacctgtaatcccagtaatcccagctacttgggaggctgaggcgggagaatcacttgaacccagggggcggaggttggagtgagccaagatcccgccagccactgcacttcagcctgggtgacagagcgagactccatctcaaaaaaaaaaaacatatatatatatatatatatgttgacaatatttcagttgaataaaataaaatattctagctattttaggtagaaaggcattttataccgatactactactaaagggtaagaagatatgactgtagtacattaaatatgctgatggcctacaactgttgctgtgttgctttttcctcttcaccacacatatgcagcctcatgaaacattttccatgaccagcacactgaaggaaataaaaggaacctagtttagagatggttctgcatgatacaacaaaaatgagctgctaaagcattacaatcccactcaagagtattcccccatcaaatagtggggctggtattttaatcagttgatactaattgtcaaggtgtgatggccaagggattgatgtttatcagtgtatggacagtggttcagagtttggtgaattagtcgagttgaaagagaaagattggtgacaaagatgtatgaggtggaaagtatactttcacagaataagaacagaaaatgagatttatgtttttttgtaaacgttcaacaaagaaaattcattcagaggaggaaataggtaggcaagatgccctattctacagatgttagtcagcatcactgcaaagcaacctcagggcttatgcagtggacacttaaaatagcactggtgcagggatgggagaaataaatggatttaataagcactgctgcttaccaaggttgattgaattgccactattgccaagtgttctacctgcaaacagatcaaccttgagccctggatatggcaccatgtcccagagcaaccagccagccacctggtggcaggttgattgcattggatttgctccattatggaaggtcagtggtttgtcactgctgcgatgaatgcttactgtacgtttggatttgcattccctgcccaccatgtttctgtcagcaataacatggccttattaaagccttattcaataatatgacatcctatataatattgcttttgatcaggagactcattcacatcaaaataagtgaggcaattggctgtcaactacaggattcactggtcttaccatgttcctgttgtagcatattgtattctacctggaagatgaaaccttgtgacattaaagtagtttttagttccataaacataatacaggggtctatgaatcaagaagtggaggtagaagtgttgtcttttacttcacatctaatcacatgttcaaaatattttttcatcttgcctctgcaactttgaactttgctgacacactgaggttttagtgtgaggaaacaatactttcacatgggaacatgatagtcgttcaattgaactggacatttagaataacctggccacattactgaactgtataactgaaacaacaaatgaaaaaaatgaagatgctacgctggcaaagatgattaattttgattattgggagaaatagtattgctactgttaggaggaagactatatgtctagaaactaggaggaaacctgggttgcctccttgtagcagggtaaaatgagtgagtaccttgtctaagaaagggaacatgaccaaactgaacccagaagacataggaaatctaaacagatcaattaacaccaaagaaacgggcattttttggtacttctaaaaaagtaccagactgatattttcacagagatgttcgttatacccttaaggaacaggaacagaaaacttctatactatttaaactattttagaggatagaaaaggaaagaaaactccagattttatttatagaacttgcatgaaattgataccaaattctgacaatgcaagttcaaaaaggaaaactagagatcagtgttacttatgtcaaacagctcttaatagaatagatggatatggttatcaacatgataaatatgtttatcacattttaaagcctacatggagaaacatttgaggttttcttattctagaactgacaggaatgtcctttattatgagcactattagtcaaatttttctggtggaactaatgtaagtagactgctgaagaaaatgaatggtatgaacattggaaaggggaaattaaatgattattatttacagataaaataattgttaagctggaaaatccaagtgaataaagggaaggcctacaattaagcagttaaggaaagggctaggtatagaaatcaatagttttgatatatgcaggctatagccagttaggagatcagttaggggaaaaacacgttgacagcagcaacgaaaagctgataaacctagaattgttcaccacttatcttaaaatgtttaacatggtactgagggacacaggagattatttatgtggaaaaacataccatgtttctatacagaaaaattgaacatcacaaaagtattatttgatcttaagataatttatatttaatgcaatctcagtgaaataccaggagaatgtttttaagctagacaaacttatttcaaagatcatatgtaaaaataagcaaaaatagatgtgaaaaattctttaaagtaatgagagaccagtcttattgactattaagtcattataaaactataatgtttaaaagatggtactgacatatgaatagatcagtggatctcagatgggcagtgcagaaagagatccaaacacatacaaaaatttagtacctctaaaggtggcatttaaaatctgtggggaaagatggattttccaatgaataatgttgggataggtagatagccatctggaaaaaatgaaagtcaaatcccaactttttaccttttatcaaaatgaacttcagatacaattgaaaatataaaattgagaccataaaagtattagaagaaaaatgcagtttttaagtctcaaaaggggactcttaaatatcatacaaagcccagaggccataaaagagatgattgataaattcaaatataggtccgtgtaagcgaaaactttcagtatggagaaaacataagttattaaggcaaatgacacactaggaaaagcatttgtaactcataacaagcctagttttcttactgtgtaaagtactgccataattgacaaagaaaatatgaagaattggcaagtgacatacatagaaagttcatggaaaaaataactcttaaacatttacaaaattttacaacctctcatgaaaagagaaatggaaattgaaattagagtcacatacagtatttcacttttcatttgtcaaagatcaaaaagtttgaacatactgtgggtttatgtttataaggatgtaagaaaacaggcaatctaaattccttgtagagtgtaaattggtagtaataagagaaaaatttactgaatactttgtgccaggtgcttttctaagcactttacatttaattatctcaattaacttatccagaaagtaccattatttctgtattacacgtgaggaatttgaagaaaagttagacaagtaattcaaagtcacacagttaataaatgacagagtgaagatttgagaccatttcctttttctcaagtgtccacttttggtcgcaactctgctgtttctgtagtgagtgatttaacactatatgataaaaccttaagagtacgtactctttgatccagtgattctacttccagaagtttgtccattttgcatcaaatagatggagaatagcattcattgcattgttatttgcagtaaaggaagattggaaacaacctgaacatttatcctcaaggactcatccatacaaaagaattgaagtaaattcatccagatgaatatgaggcagctttagatagagtgagatggcatcctatgtagtgatatggagtcatctttaaaatacagtaaaaggaaaaagcaagatacagaatagcatgtagggaagctgctgtctatgtgaaaagctgtagaatatacgtgcatttttgtatatgcatagaatattcctagacaaggacaaacatggtggttcatacctgtaatcctagcactttgggagactgaggcaggtgattcacttgactccaagttcaggatgagcctggccaacatggcaaaaccccatctctagaaaaaatataaaaattagctgggtctggtggtgtatgcctgtggtcccagctacttgggaggctgaggcaagaggattgcttgagcctgggaggcaaaggttgtagtgagccaagatcatgccactgcactccagcttgggtgacagagcaagacaccattcatctctctatctcttttctctctctctctttctctgtctacacacatacacatacccccccacacacatatatatacacacatatatgtgtgtgtgtatatatatgtgtgtatatatatacgtgtgtgtatatatatgcgtgtatatagatacatttctagaaggattctcaaagtgatatcagtgattgttgtgcaagaaggaaactagatatcagtgaatgcgctaaataaggtgattttgaattctgtagcatgtgtatgatttacctatagagaaagcagtctagcatgagcgtgggtttctcaaatatagaatgtttgcagtgaggtcacttggtgaaaagtatagccatgtcagacagatgtaggttcagattccaggacttccaggactgctgaaagggaaaggggctttggatctccttcagctccaggcagcattgctcctttcccagctttgacattagctggagggaagacaagttcttagagctctatgtgcttgggacaagaccccttccccctactgccttactcgccaaccataactgctgcaaacaattcttacctcttccaccccatgtcactgcctaaaacccttcatcacctggcctcccatgcctctaagtctctgtacatcccctagcctgatactgtccccaaccctcctcaactccagacaccattttactctaccctctggaattgtccattattagcaaaatctcctttattttcaacctcctttctaagtatttcccccacattcttgttgtaatagagacacagctttcccaggactgtatagctttccttgcagtcctctaaagtggtaactggtttctctgccatacatttcataccactggtcctggagatattgtcaatatcttaatgtcttccttccatctcacttaaattttgagaccataattcctttttcctctcttaaaagttctcagtgttgaagctcaatccattagatacctctagctggcactactagttgcagtcctgtgcagactactgagtcattttctttactccctgaagacttaaactctatcttactctcactctctctgacattactcctattaaaatgttatgtttctttagctattctttcagtttttggtctcctctccttcaacgaggatgatttctagaatgttggttctcaaaatgtggcccctttgcagacatcgtcagcacctgggaacctgttataaatatgaatctgcagaccacaccccagactactaagcccaaaattctgggggctggagcccagaatctatgttttaagaagcacgtcaggtaattctgatgaatatgccagttccttagatcttgttattgtcattactgacaactttctctgagaccacaatttgaatctaccaatttttcactagtactcacccatcttaagtccttactttccccttaccagccagacatttgaatattccttgactcttctctttcacatactatatccaaagagtcaacaaatgctgtcagctataccttcaaaatacatgtagaatctaacttttaacctccactgcagtcacttcagtccaagcacaaccatttcccacctggagtattgcaactgttcttgtttggtggcccttggccctactttatctactttccgcaaagcagccagagtgtttctttcaacacctaaggttatatggcttcattgattgaaattcaccgtgcttcacctctttctctacaaaagccaaagtccttgtaaatgcctgtaaggctcgagggtgatctgaccttccctggcctgtcgtgtttcggtaaaagtaagctgagtctttcatagttaaaggacagcaatattgtcctgcatgatattttaaaaacccaatcaagaatcacacattgcatttaattttcatgcctttagtctccattaaaagtgtgccctttgtattaataattggagtgatgagggacagagtttaagaatatataaatattttgtccccaactgactgtcactggatggctttggcacccattggtgattcttacctgaatcagtaattattgtgatgactgaaaatagtgatttttctcactgtataattcttctatatttattaattaccttaatattatcctatagaacagaatgttcccttctcatcttttgtttgtttagtgtcagtattactcatgaagttgggtgtttagaaaattcaatgttgtataatactgttattattcaatattgtattttctcagtttgagtcttccatctgcgtcctttcatgtaaatagtataaagatcagtaatagaggaacatagagtaaagtgtgagcagagaagccttactctgagacaaacttcagagaggtgaactctgttgctgattaagaaaggcttcactgaggaagtgttgtttgaagtgagctttgaaaagtcataaaattttgacaaaagtggggatggggtggagcttaaaggaaaaactgtctgaacaaaggaaggcccggcagactaggaatttggcaataatacagtggttttggaccttgatgaggaagttgaaatggaacataaaaaccctctgcatttagctccatttatttgctcaggcagctctcactgcctaaaattttcacccctgctgttttgctcaggggtgggatgaggggtaatgagggaggaaattttagggggtgaaaacagcacaagccaaaaaccctgctcagatactcccttctcttgaagccttttccagatccctaataagaattaaccaccctctctcacacactctgttgtactttgtccttctctgttaaccagcctctgtgttttgtgctgtctgtatttgtggatacatcttcctcctttaaagcacgaatcatatcttaatcccttggcccttcttcccagtacttagcacaagtgctcaatacatgtttctttaacgcgtgtaacagaggaaggcgaggagagtgagtgggattgggagcaggaggattctgaatgtcattttaaggggtttgggctcgctcttcaggcagcaatgagccatagccgcctttgaactgtgcagcactgaccagagctgtgatgccaaaggatgcagtggaaggggaggacagccagcatgcctgggcatggtccccaagtcagaggacatcagtgggagaagggagaaggcatggaagcaagtggctaccatcttatgaatctgagcactcattcaaaggtggcaaggaaaaaggaaggcattgagcacggttttgaggtttccagcctgggtgattggaggctgatgcaggcttcttaccaaaaagggccctaggcagtttcaccaggaatgtttaaggagtttatcatgaccctatctcttcctcgtctaaaactctccctaaaatcaaaacagtatgtcctgttgaaatactttattgtatcaaatataatgagaagtaaaatattctctctacttgatgtatgaaacactgacttcttgtagtggacaattttcacttgtctttttagtaatggtttttattaaaaatagatgttaataactgcttgtttaatctttaaacgtggccctctgagagcagcttaccgtaaaagaaacggttgtcagctttctttttgctcctcagtccctcctgccccttcctaacaacagaaaatttgctttgcacctgctccaactgggttcgaagagataagcatcttgcaagcccagaaaattgtagtatcaaatctcagccccaactgtgaggcagcactatcattgaatccctgctgagaggcgttgctttcccaattcccaaaagagttctttctcccctggccccttttcaggcttgaactctgaccgaaaccctctttttaactcccagcatgcactgcacttggtactgacactgacccatccctgcttcctctgttctgcactggactcatcagtaggtcaggcgttggtagccctggggtcactggggtgcccaattccaataatgagcacatttagctaaggagaggaaatgtacccttctatttgttacagtccattgctttttttccagaaacaaatgctaaaagaacatttgatatattgtggtttggtaaatacacatagcactgcctaatattcacaaagttgcctcttttttttgcatcttccttcataaattaaatatattgttctaactcatgatttattttaagagggatatacctatttcacagctaggaaaatgttttcaaataaagttatattcagaatactcttgcaagaatttcaaataaaaatagcaaatactatttaaatgcatataacattctaacagacttgtgtgtcattttaaagggaaagaaaaaaaatgatgacaaggactttacaactttgtctttaaaatttcttcttaggctttccaaacagaccgaagtcattaaaaatactccttaacccccaaagtcacaaaaaagaagctacccaggtttattatgagaaggttgaacctctgttgaagcttgcaggaataaaaactgatgtaacaagtaagtaattttcagaatataatttcaccatctacaaaaacatacaaaagcaaaataatctgaatttgtccttaatgcaaacttgggaaactacttgtaatatctatagcatttttacgtcttcataacctactgcagccagctcgagggttataatttaattatttttgttatttttattagaatattaatattttctctttagaattttttcagatattttttcagacttaaacaattgttagatataattacaaaggaagctgtatacttgtttacatcttcatggagatgtttgctacttacacgttaattttgcagttaggcaagaaattgattttttgctcacttatatagttgatgtctttccatggaattcttccttgggttgttttcgttctgactctgacccctggtggttaggtcaaaactaagcactgaactgctggttttattaatagatgaatttagagatgctagaagcttaaatttgttgtctaaactaagaaatgtacttaggtttgtgccaaggaaaatagaaacttgttaatgctaaacttaatagatgattagtaatatcctttttgatttttttaatttggtagtcacatttctttgtttctttgagacttattttcgtatggtggggaactgagtagaagagtcgatgctatggagaatcgcaaccttcctagctttatttctatgtggcttcgctaacagtggaaatttgcaataaattttaattgatgaaaagtattataaaataagcctactcaggggacaagcccagagtgcaattggaacttcctagtcccagttatagattcctagggaagggattcacagtgatgtggctttactcagctgtaaacaaaggagataagtttcaagatgttaataatatcattgaaacctacacctagtgatctgatggattgaggtagaagaaagttcaaaaaaaaaaaaaaagcaagttttgtaggaaggtcagcccccatgaaatgtgcctataactatagaggttcgagagaaactaccatgaaaaactcaagaggaatttttgaattaaaataaagttatagtgaagaagttaacctttatgtttgtgaccttcggcttatttagaggtgatttacaagtaaaagagaaaattcagatttatgttttctttctactgaagatttccaaagattggctgaaggaaaagtttgagatttgtattagggtgagacaattaaaagttgaataaacatattggcatactcaatgactattttgttcattgcttttacatgtgaatactacaaagcagcttaacatggatattgctatatagcattcacttcaggaatctcattgtatgcttgctctgtgttcaacatagtgcaggatgcgagatgaataagctatcatacttggatgactttctacattattagagattcaaaaaaatgcttaaaaccattataactggggtatacataaaagaactttgatgtctcagaggtgatattttgatcggaagattcaagaaaagcatttgaactaggcagtttttaagaggcagacaaaaaatgagggaaggaagtcaggctaacaggcatgtactgtaaaagttgggagggggggcggagagagagagtgtgtgtatgtgagagagtccatgtgtgttacacccatacatctggagagtttgtgccataactttgctctactttcctcagtttttacattatctgaaatcttactctatcatcataaaatagctgccagtgaatttcatcctttcttattaatatccagtgggatggggagaggtgtgcatatgtgtgcaagagagacccaacatgctttaatcctgaagatgaattaaaatttccttttttaagtttgggcacagatactgtattagcgcagtcaatctggaataatcatttatttaaccatcaagactcttcccaggggctgaggacagatccccttttcctgatgactgaaatgcctcagctgaatctggattctgttagggagaagaaagggcaaaatgacttctaggaaggctctcaacaatgtatactacaggaggtataattccaggttatggatggatccttaagctgcactcagcagtttactcatcgtgtattgatccacagttggtgtaaatttttttttatcatactgttgcaatctggtttggcaaagatgactccaccagcagaattaaaattaaaaaggaagagagaaaaagagattggagacaagaaaactgatatacaaggcctgaactaaggcagaggaaatcatctaaatgtgctttccttcttaattgtattggagacaaaactattatgttctaggatttttttctctaaatttgtaaatattactaagtaccatatttaaacataaaacaatagaatattccgtaaagcaaatttagaatttacttacatttgtgcagaatggctaattattagctgcctaacactcctcctacaggcaaatttataaaattacatcatttgcttataaaaccattttagtatgcatattggctcaatatttatgaaaaatatttcttgaataaacctgtgaatatttgaaaagttttagtcttcctgcctatcttacagtgttatttttgtagttgaaataatatatttgaaactttgtatattatactacagaaaggtggtcataatactgttagtttcagtttcaaaaattatgtcatagtaagatcgaattcgtactttatttgaaagtatatggaagagtaaagcagaaagaggacatatcttctgcatgtccagtgggacattgttttaatgtatccttgtgtgaatgggtgagtccaaatggaattggaattacaaaataaaccctatatgatgagttaattaggaaatagtgctatataaatatgaagtataatatgaagaattacagctagatatatacactataaggtactgtaattttttcataaatttattttaaaaatggatcttaccacattaataaaaacacacttctttcattttgggttgtgctgaaatcctaactacttctgaatatagatcagcatcttttgaaatatttgtgctaaagttgcatccccactctgctaccaccaccaaggtagtatcttatctaatagcatcagaaaaacttccgggagaacctggaaagaattattttttcctaattacctattcgtacacaaatcaaagaagagtatgaacgataagcccatgctggcatatgatatcatttctcttgcttctgaaacaaagcaagttttagagattgtaccattaaaggtgtgacagatattttgaggatcagagatccataggataattcatagtacaatagagtgaaaaagttaaggcagcagagaaatcagactgaaaagaactttcgaggccatatggttcaatttttctccttgtgggtggagcacaggtgtgtggcactcaactttggcttggccacctacactagaggcagagtacgttgttactggacaatactgtttgacattcttatgaatgttcagagttactgtacctttgggcagattagaaaaggcacctcctctgtgctgacttacaaaaaggtgccctttcttccagactaattcatcctttgcttataaaaccatttcagtatgcatattggctcaatatttatgaaaaaaatatttcatactttcaaaatattcatatttcaaaaatattcagcccaaggtcactagattcagcctaaagtcatttgttagattgcaaatccgtcattcccgttagccaagtacctttgtgctaggcataaactgtacaaaatgagaacttgtcagctgacattcgcctctttgtaatttttatgtactagagttaatgttatctcttgtagtaatatgaaataaatgtgccccatctattgtataggagtcattgagatatttgaagagagatatcctgtctgcccctcatctcttgttcacgataggtacttccatcgccttcagttactttttgcattaacagagctgctagaccttatcatggtcattatcattatcatactcaaagacatttatctgaaggaaaccttgatctctgccagctcagggctcttgggagtgcctagtcaccagataattttacctcctgggcagagttgtcaagaaagtggtgtttgttatcattttccccttctttctcctaaaatcacgcttctaacatggctgttaacaagcctcttcatagtgtttctctggttgtttatggctctacttgaagccttccatttcttggaaatgcctcttgcctttctaaatctcacccagcagaaagctaggccatctaatgaaactgtgtcacaaaagattccagtagcctgaggcatcactccttccaattttacctgcattttaatacaaaatctgaaaagtaaatgttcatgcatcatatctagctagagagaaagataattctgtgtaaaagattctttttgttacctcttaaataattgtgggtgtatatggccagtcctgttcccagcattcagatgtgagttaggaagttggaactttatacctggggacgatgaagactcactaatggggtatatacaaaaaagtgatatgattaaatatgtatctgaaaatggttattctggctagagtgggggagaggtttgagggagacaagataaaaggctattgtagtacaggtggagtatcccttatctgaaaggcttgggaccagaactgttacagatttaggatgtttttagcttttggaatatttgcattatacttaaccacttcagcatctctctaatttgaaaatcatggacacaggaaggggaatatcacactctggggacagttgtggggtggtgggaggggggagggatagcatcgggagatatacctaatgctagatgacgagttagtgggtgcagcgcaccagcatggcacatgtatacatatgtaactaacctgcacaatgtgcacatgtaccctaaaacttaaaagtataataaaaaaaaattaaaaaaaaaaaaaaagaaaatactccaatgagcatttactttgaacgccatgtcattgctccaaaatttttagatgttgaagcgttttggattttagatattctggttacagatacttaacttgtctacacatgaaagatatttagtgatcagatcaatcagctaatttagggaattagctgggagaaatggaggaatgctatggcataatttaaagacagaaacaactggccttggccatggagtggttctggagagtggaggaaagggacactctagaaagaagtcattttcctgtcttggggtagatgatggaacacaaaaagaacaatatatttgagagagaatatatttgaaggtatacataatggattctgttttgagcttactaactttaaagtacctacaggacaggaaagaaaatgacatttcagtatcatatcccacactagaattttatcaccaaaccaagaaatgtttccttatgtccaaatcaaatctcacctgattttatttcaggtgattttctcatcaacattgaatatcaaccttaagactttcttgtcttcctgaggaagttgcatttgcaccaaagaggggagggggaaattcccagcagtgagaattgtgttcaaagacctgtaaactgtgaaggcttcacatctcctatttagaaagagcacaggttggcaatctcataggaaaaggcaaatagatgaaagaagaggctgggttacattttttgaaattacatttatctagcaatcctttctttgtttgtttgtagggggatgatttgaatctggctgtcactgattccagggcccacaatagcctgtctaaatacatatttggtcctttctactatatttaaatagtaatccagatcactctttatccttttgcctaacattgttttgtataaccacctattacttcatattataattcattatttcattagcatatattgtctatctccagaatgcaaattcctgaggccaaagactaattcattttgttcattttgctaatatattttatagatgtagatagtcaggttcttttcattttgtttctttgttctagatctttgattttattggacttttgcaatgttacttaaaaaattgctattttcaggcaggttgcattagtgtataatcaaattccacccacaatatcaaaaaaagactattacaaattaaaaaaataaaaatagcattcaataataacacagttctaaagctcattattggatctgaaaaactttaccaatgtaagctttggtataaaagtaaggcttggtgaactgattcttagcataaatattttttcatgatattcttatttttaatgtgtatatgtaagatgttttattttgcattttaaggttgtaagtacttgctgtagttataaatgaatgatcagcacacatcttctttgataacctttcaactttattaatattaatgtttcatatgtagttttattatggctttcttctgattggaatttaatatagagaggttttattcatgtgagtgttaatggcattttgaataagctatgggagaattacaatgtaacactgctggatacagaatgattcttttagacaccaagactaataatttttaacaatatcgaaaaacattgtaggaaaagcttgaaccatgctggcaccagggacagacaagcatgaaagattaatgtaatcttgcatataatgacacacattcttacacaaaaaatccatctgcaatgtcatgtcagtcagcagaaatctttgatgggtggatacagctgggctgtctcttctggcagagctgccctggaaaatgctaaatgtggttgtgatgcttggtgccatctgcagtgtgcccgtttatcctgtcttcactggcatttacgatactgcatagggcatcagtgactgtggagacagcgatacagagtgacagattcatttcctcggagggtctgagctctggtgggcctgtgtgccaccctccttcttgggtctgggtctcttataattggtgttggctttactttgtattttcacatccaactcttcctctttttagtctaacagttccagtacacattcttctggtttgtaaatcttacactaaccttttgactaatttattcatgtaaggttgccaaaccgatttaagattgactgttcaatgccagctaatatgccttatttccaaaatactgctcctcctaagcctctgatttaaaggacatgtgtcttatttagggaatactaaacaggcaccaggacaaattgggtaaccactatgcgtgggatattcccaaatgactttatgtagttgaaacaaatatatgaccttctcttacataaagctataaaacatcaggccagtaacacttagtcctcttgcccatgattaaaatataaatattcaagaataaatgctgttttatgacttgaccatatgtttatcatattattttgccagaacaagttaaaaagtgtgatcattgtttaaaactgtcactttgtgtatgtgtgtgtgtttttttaatagtaatggaatatgaagggcacgctctgtcactgcttaaggaatgtgaactccagggatttgatgggtaggttatattattaatcaatatatgttatatcatttatgtattaaatgccttcactagttttagctacatatttggaacctaacatttaaaaatatttgtagtgtatgtactttggctctatcttgttcatatctatgtaataataattaatgataatatgacatggtcatctatctctcaggatctggcataggaaagcaaaaagaggaatctaattattaaaatactgggaaatgacagtgtactactctatacttactaatgtgcatacatttgcatctataattatttgcttttaccatatatctagagaagcactaatggaagatgttatactggtcacatggcataactatatgatgatcttcttttgcaaattaattgataggtttaatagctacccattggttaacttgtctgtgatagattgagggaagatattttataaatacaagtaaataaatacattatttccagaaacaataagaaataattttaattatctcataatgtagtgactacaatttaggtatgttattcacagtgggcatcggaaaccattgttcgcaatacattggagtgtacagagattgttcactggcatgcaaacgttagaaccaaggcaagtgatataaatttcattgccattttttaaaattaggtgaaccaatttgctaaagtgttggactgatgtgtaagactaaaacatattatattcctttagggaagttctttttacgtgagtagatatttgagaatttaaaaagttgacaagtgtgtgaattatttgtgttacatggtgatgggcagggggcaaagacccataaggtcaggaaagggagttaggtctgtactttcaccaaagtgaaaggcattaaccttcccaaagactgatttgaatgtgctggggagggaagtgatgcaatcaaaatggagtattggcagggctgtttttcagaaatgcttatttatttatttattttttggatgaggagaaaacaatagctgttgagaaagaaaatgtggtaagtaaaacatgatttttccaaaaggaatctaattgagggaagtaaatctagatagcaatattatataaacattgggaatcaaaaatatggggtaggagattacttcagaactttatacttagaggtagacaaaaacattaataggcttcatttagaaaattgtcttacaagtatacaatttaagaaaagtccttgtgggaatcatgcataccaactacctatttgaatatgctgcatagtccctcactagacctcatgagtacatgaaggtagctgcattgcaaatgagtacctgcttcaaaacttgattaaagaatgagaataaagatatcacagatattaaacttgttcttacacagcagcattacagaatgttctgctgaatgcagtatctatcaatatgttttactggtatttgtactgggtaaagggatgaaaagaactttgcagaatgaagaaagacgattgctgaagtgtagtacaataatatttttctctttacctgaacatatttaatccttatttatttttcatggcaggtgttgttatttttcagtgtagagctaaaagatgtatagatttttcagttattatattttataaaccaaatagtttggcctaaccattatatgaattgagttatgtaagtgtttctaaactctatggcatgctgatttatttcagacttacaataatttcaaatttctactgaaagtcatcttccgtgttctaagactctttaaatcaggggtccccaactccgagactgcagatgaatatcagtcagtggccttttaggaactgggaggcacagtaggaggtgagtggcaggagagggatcatttccgcctgagctccacctcctgtcaggtcagcagcagcattagattctcacaggagtgcgaaccctattgtgaactgggcacgcgagggatataactggtcatgcgagggatctaggttgcgtgctcttgatgagaatctaatgcttgatgatctgaggtggaacagtttcatcctgaaaccatccgtctcccaccccaccctgcagtccatggaaaaattatcttcccacaaaaaagtccttggtaccaaaaaggttggggaccactttaaatagcttatttatttttgtggggtcagttttcccagtagaagctgatatggtagttggagtaattatcttaataaactggcaattttaagtcactgtacttagaattacatagagagatatatgaggagaataatagaaacatagtttcttcaggtacttcaaaggaacaattctcttgcaagtaaaattgtttgaaaatggaatattctacattggtgagttttctattcctgaacctgttctaaagagtggctaaaggaaaattttgggggaaatttatagaaaaggtgcagagatgagagaaggttaaccccaaaatgctatggcattttgatgagagacagactcaaatttctttaagaactttggcctgaagcacctccgtctgacactagtggaactattaatagggagtgattaggaaatcacctaacagtttggtttctagatacaggctgaagaagttaagagccaagaaagattctatgtatagtatttagtaaagcaaaacaatttggtaagtaatgtttaagaaatgctatttcctaagattttggagttgtatttattttttttaatgaattacatatgtttctatgagacatcttgtgacatttctaaacccaacagaaacagtgtatcagcacttatgacagctagttctccactgcagtgtgtcctaggaaacactctaagatccactgttaaaccttatgagagcttcagattctatattgctccctattttactgggcatgagtaggaagttttaggaaggaaaataaaagaatatcagctgcatagacttgaagcagtaacacttgcatttataagtgtgagtatagttttaaaaatctatagattttatgcaattgtaaatatatgaattcctcgctattaatatttgtttcagaatttttaaaaaaattgttgagttacttttcttttgttcatttcaccattaattagacccataatgttgtagacattatttggattatattgacattttatcagattgaacatatctgtattacttagtaaggtaaaaagcaaaaacaaaaacaaacttttccagaaagaaaaaaaactgtgaatcaaaactacaacaatatattgaacatttcatagatgatgggttcatagataagtataaaaacattcattaaaaaaatctttatcactctttgaaaaaggatatattatcacccagtgtttcttttctagacagaataattctgtttggagccatggcaaggagtttacttattttaaaaacaagatttgtcacatgcaaaggattagttactctaaggtttatgttttagagtgacacaagtgtgattaactcactataaatgattgaatactttgctttttgcctttcttgtatatttagactcttgtgatatttttgtaagaagctgttgatgaaaaaaaccaaactgtaaaatatttaaagaggtttattttgagccaaatatgagtgctcatggcctatgataaccccaggggggtcctgagaacatgtgcccacagtagttgggttacaacttggttttatacattttggggatacagaagttatagccaaagacataaatcgataaatgtagggtattcattggtttggcccagagaggcgggatatcatggagctggtgggaaggggagctcacagatgaattcaatgattttctgattgtcagttggttgataagctttgctgaaagattagaagtcagcagaaagaaatgcttgagttaagataaatggggtggtgtaggctgggtgcagtggcttagcagtggctcacacctgtaatcccagctctttagaaggctgaagaggggagatcacctgaggtcaggagtttgagatcagcctggccaacatggcaaaaccccatctctagtaaaaatgcaaaaattagccgggtgtgatggtgtgtgcctgtagtctcagctacttgggaggctgaagcaggagaatcacttgaacccaggagggagaggttgcagtgagctgagatcacaccattgttctccagcctgggcaacagagcgagactctgtctcaaaaataaaataaaataaaataaaaaattataaaaataaagataaatgaagttgtggaagcacaggttcttgttatgtagatgaagcctccagatatcaggcttcagagagaatagatggtcaatatctcttatcagaccttaaaaggtatcaaactcttagttaaatctctcctggatcaggaaaagacctggaaagggaaggagattctctatagaatgcaaatttctcctgcaaatgatagctttgcagggccatttcaaaatatgtcaacaaaatacattttgggataaaatactttgatttcctctagggcctgctatttgttatttaatgctataccagagtcaggttggagttggggatcttattgctaccaagtctgttttgtcagtcttatgatctattttttttttttttttgagataaattctcaccctgtcacccaggctggagtgcagtggtgcaatctcagctcagtgcaacctctgtctcccaggttcaagcaattctcctgccccagcctcctgagtagctgggattacaggcatgcaccaccatgctcagctaattttttgtttctttaatagagatggggtttcaccatgttggccaggatgatcttgaactcctgacctcgtgatccacccttggcctcccaaagtgctggaattgcatgcatgagcctggccaatgatttacatcttaatgccagtgctggccatttgcgcctaaactccaaaagacaagagggtataaggaggcatatccaacctcccttcctgttatgacctgaatagtttttcagattttctttgtgaccttcatggccaaaaggggaggatccattcagttagttggcgacttagaattttatttttgttttacaaaacttatttcctaggttgagtcactttacctgaacatgatcttaatgattgaatagttgttaacataaataaatacatattttttctaactcacttaatttcacactggttctactggtaaactgtttttcaaaataataagattctcataaggctatttttattaggtttcatatatagaaaaggtatctaatatattgaataatattgtagcttctaagaccaaaatgtcttatttcaaatccctgttctattacttactagtggtacaatcttgaaaaagttactttatctttctatgttttagtttcctaatctgcaaattgaaggtaatattacctattgcatacagttatttctccacttaaatgagttaatacatggagagtgcttaggaaaatgtctgatatatatatatagtaattattcactaaatatttctttattgttataattgtcatttgtattagtttcaaaagatttaacacagaatgtattatgacaaaatttcagatgtttcagaacatgctcatagggaggccacctctaataactctagcaatatgttaacatatgcatgacgctataattgtatgcaacattctaggagttaagtgttcgcatcctatgtatgtaagggtcaagttatttggtgctaaattagatttttttgggtatgactccacatagtctttttggtcacacccatatgtcagcatttagacagccatggattgagggttacgtttaagttcacagattagaaatctcatagagatttttgaaatcaggtaagtttcaagtcaaaccttggtttttttcattcataaagatgggactgtggcctattttgcagacttctgaggatttaatagaaattagtaaacacattacctgatatatagtttgtccttagtaaacatcattccttttctctgaataggtggtcatattgcgaacctctggaatcagtttagacataagaataaaacacacctaatcaaacatgacctgggtcatatcttgagtcttctaaccagagtagccttggattgcccaggctatgtggagctagtgggatgaggaagatggggactagagggaatagatggccgagagaaagatggtgggaactgactggaaagacactttcagcctttggtcaccaccctccagagcttcctaaacttagagaaccagtaactactgctgactgtggcccatagacagttttgtttgaaatagtgtttttaaatatattgaatgctagttgcttagtatttacaaattaggagactcagccttaaatcagaatctctggcttctgtagaaaaaccagatctgggtccattaggcctcacacgtgatgtgagtgggccacagcaaagaagtggctgcgcctttagattgagcctactcttccattcctgctgggcccttgtagcccttgagttgtgacacctgctttcactgaggcaaaatccactttccattgggttaactggtgacattttgatacgtaagaatattttgcttcttttgaacataaatgattatgaaatgaatttctggtacttctgtgttattttaatggattctgcccccatagtctacttgatataaagtcttaaaaaatatactagtagtactatctaggatcaaaggctaatagtattacatctagaagcaccgtatagcaataatgtcaaggagatgaaattcaggtcaggtttgtaattactacattcatatagtaatgataattagcagtttcttaaagcttcatattttatatgatttttattgctatctgtcttttcagagctttattgagaattagcaggattttatgactttggttggtgttagttaaatgaattgcagatgacagtattattaacaagaaatgagaatgatatgcttttggatgttaacagagcaaaacgctggtcagatgtgaattaacatgttcaaaagttttcatatctcttaacacacttaaagctattttgtctatggggaattatctagttattatatttgtgaagtaaacttacctgtgttgtgtttgtgttgtcttacccattgacacatattaacatgtttaaaggtacatgtgagcagttatgcacatagactacaaattagtaaactattttgaagtctagatttcatgacttattaccaatcattctgaagttttgccttctttgcttgatttgtatttttctagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggcaagggagtggctacagattcattaaactgacccttctccctcttttcctttcttacttgctaatctagacagcacaacacagaattaatgaacagactttgaaagatccagacttctggcatccccactagcaaatgtgagacttttgacaagtcatttaatctctttgagccttatttttctaatctatagaatagggatcacagatatattattcactttattacaaggttattgtagtactaacgtttggtttagtaaagggtttaatatatagttaaaccatcagtatatggaatggttattattctcccttcgcataaaaaatctgttgattacacagtaccaggtaagaagtttcaaaacagggccactccagtctagctgcttacaattccatatgaggtgaatatggtaacttgcataattgatgtataaccagataaccttgagaatgccaaaattacttgtgactggaagggaggataaggtttggaagggtgagattcttaagggcaaggctttttaatctttctactcactgccatttttcagcatctagaatagactatgccacagtgatgctcagtgaagcctattaagtgaatgcatgtaaagaagactttatatagtaaatgacacttggattaggtcttaaaatgggttggagctggcctgaaaaggtgagaatgagttattttcttggctgcaaaagtaataaagcaaaggcaaaacccaggagtgtttgaggaatagtgaaaaggccattcagtggaagataatggtatcaaaataggcccaaccatggaggctcctacatgccacagtaaggtctctgaattgtatttgataagcagtagggaataatgggatgtttcagagcaagggggcaacctgattggagcttgttccaggaggattcattttgcctcaccgtgtggaatgattagaggttgggagcaggagaaagtagaggtcagagacacggagaaccgttagagcaacactgtgatccagaaaagagggaaacatcattcaaaagctgattgtattacacaatcactcatccctatttaacgaacggtgctgggaaaactggctagccatatgcagaaagctgaaacaggatcccttccttacaccttacacaaaaattaattcaagatggattaaagacttaaacattagacttaaaaccataaaaaccctagaagaaaacctaggcaataccattcaggacataggcatgggcaaggacttcgtgtctaaaacaccaaaagcaatggcaacaaaagccaaaattgacaaatgggatctaattaaactcaagagcttctgcacagcaaaagaaactaccatcagagtgaacaggcaacctacagaaagggagaaaatttttgcaatctactcatctaacaaagggctaatatcctgaatctacaaagaactcaaaagaatttacaagaaaaaaacaaccccatcaacaagtgggcgaaggatatgaacagacacttctcaaaagaagacatttatgcagccaaaagacacatgaaaaaatgctcatcatcactggccatcagagaaatgcaaatcaaaaccacaatgagatatcatctcaccccaggtagaatggtgatcattaaaaagtcaggaaacaacaggtgctggagaggatgtggagaaataggaacacttttacactattggtgggactgtaaactagttcaaccattgtggaagacagtgtggcaattcctcagggatctagaactagaaataccatttgatccagccatcccattactgggtatatacccaaaggaatataaatcatactgctataaaggcacatacacacatatgtttattgtggcactactcacaatagcaaagacttggaaccaacctaaatgtccaacaatgatagactggattaagaaaatgtggcatatatacaccatggaatactatgcagccataaaaaatgatgagttcatatcctttgtagggacatggatgaagctggaaaccatcattctcagcaaaccatcacaaggacaaaaaacgaaacaccgcatgttctcactcataggtgggaaatgaacaatgagaacacttggacacaggaaggggaacatcacacactggggcctgttgtggggtgggggaaggtggggagggataacattaggagaaatacctaatgtaaatgacgagttaatgggtgcagcacaccaacatggcacatgtatacatatgtaacaaacctgcacattgtgcacatgtaccctagaatttaaagtattatatatatatataatatacagccttatgaacatatatatatataaaggaaaattaggcaaaatagcattacttgaggtactcaatagcctggcagagcagacattaagggtaagagagactggacttgaatttcagtttggtacttgactttgggtgggtaattagcctttattagtcttgattacacatttaaaaggtttaataaggccgggtgcagtggcttatacctgtaatcccagcactttgggaggccgaggtagtggatcacctgaggtcaggagttgaagaccagcctggccaacatggtgaaaccctatctctactaaaaatacaaaaatgagctgggcatggtggtgtgcgcctgtgatcccagctactggggaagctggggcagaagaataacttgaacctgggaggcagaggttgcagtgagctgagattgtgccactgtactccagcctgggcgacagagcgaggctgtctcaaaaaaaaaaaaaaaaaaaagtttaataatgtccatccccatagggccattacaagaatcaacttttaaaaagtcacacattatcactaaaaaagcaaaatatttttccctatgattatagaaaataatgcacattgttgaaaaaaattcatattttgataaccctattcatttagtatggattttagaatacttagtattgttgataagttgacagagcataagatattcaaatgcccttttagagtgtaaagtctttcagaaagtcagaatttaaaaggagagagatattcagatataatctgataattctagagtatataggaaaacctaaaatggtttctaagtagaagacaccaagatgattttgactcaaagagaaaaatgatgcattttgggccatcttttcatggcattttatttcttgacctttttgctttactttagtagttctgactataatggtggaaactttccaacatttccttccatgcaaagtggatgtgcttaggacacttcattagtacttaaattcctgaggtcattcattgactgccatacatcagaaatagaaagatgggtgtccctacaggtatgcctttgacataaatttggtggttggctataaaaactggtggttattcttatgttttagtatgtaattcagattttataaagaaatagcatttagttttatcactattataattttgaagagtatttctgatttggggagcattttatgtattctttggatatttgtagtaatgccattttaacctgtcttgtttagaagacacagtatgctgccaaaattctggtcattgcataggagttctagcattctaattccatctaataggaggggaaagtcatgtgtggggtatatttaatatgatgactgtatgcctagtcagggcttttgatagagaatgggaactagaactaggcaggaagttttcaagctgaacatgaggagacagtgtgcctttgaagccatttgcctcctggagagagacacccagagggagagtgtttagtaaattaatccactgagccaacagactaagctgctgaattatggtcagactcaaatggatcagatgtggagaagcctgtatttgaactgctggccattaggaatggtgtttgttgctatgggaactggtgctaaggaactatactgagagactctgattaaaagggggagggggaatggagaaaaaagcctgagaggacataaaaataaaaaagcaatccagttgttgtaaaacaaggctcaagccacatactgatggctgtgaaccatatattcctatagagtttgcataaataaattcatgctttccaattaatttgaggagaataaaatattgccgagggactgttaatttctatgatatttcaggcaaagaaccaaagtgtaggtgccgttttcatgagaattttagatatgcttgactaggaagtcattacatcacatttatctgtttggatgtgggagacattaacagccttatgaatattcatggtatctggttaattaagttaattgttctgcagaagtgcttgcacttccaaggacattttttttttttttttttttttgcctccatagtttctccctggtatttcatcagtaattctttacatgaactgctacttctgtccttacttttttgtatttggaacattttagcagctctcaggaggaagtggtaggcaaagtttctggtagtgttaagaaaaataactttcaggctaattaaaatgtttaccttgaggtagaacatttatagcttttgtgagaacattaaaattacgccattgttatttatgtgagcagcatgttcttttggcatgtagacatcttttcaaatagagtacagtttcctgaaacaaaatgtaatccatctttcagattatcccaacaaaatatagaacaagctatcgttttgcaattttacatatactttctcataaactttccttttttcttcagagtgtcaaaaaccacatttaaagactaagatacagattaatgagtagtcaatgactaaaataattttctgacttctagtcatgtctgttatcactgccaacttctacagaattagagaaaagttgcaaagcctgagaagacataaacaatttttaaagccatctctagcattctaaaaaaattttgtacttgggcatacccaccgtacttcaaactcacagggaataaatggtctttattttcttaagtcatgatatgtgtcattctctattgcacatgacattacattatgttttttaatagcctttctagaggaatgcttttacggtctactcataattaaccatggtaatggaggaaatgtgtttcatggagtactgtaatccatcgataatcctaaatatctgactctaattatgtggcctcctccaaaatctttaccacaaatctgattgggaagcacaatggattgacttgtttcttccttttctcctgatccattccagatttattagcaattagatggtcaaagggcaggctgtagagggccacaagatcattggaaagaccttgataaagatccactgagtaacaggtttctacactacttgttctcaaaacttagggtccatagactcaccttgtgaacttgctaaaacagagatacctgggtcctccctcctccaaacacattctgagtccatgagttggaggtagaacccaggaatgtacgtttttaacaagctcccaggtaatgatgctgcttggaccatgcattccagaggagtttctcaccaagtcactgtgcatacaaaccacctggggatctaataaattgcagactctgaatcagtgtgtctggaatggggcctgagaggcaacattttaaaaataatatattttttacttccattaatactgctattactgttttaatacctattatccttatttttaaatggacaaaaattgtatgtatttattgtgtacaatgtgatgttttgaaacatgtatacattgtgaaatggctaaataaagataaacatgcataaaattgacataatgatcacatactgattttacattgagaacacttaaaatctcccttagaaatttccaagtatataatgcattgttactaactattgttttagcctgttctcatgctgcaataaggaaatacccaagactgggtaatttataaaggaaagaggtttaattgacttgcagttcagcatggctggggaggcctcaggaaacttacaaccatggtggaaggcaaaggagaagcaaggcacattcttcacaaggtggcaggaaggagaaatgctgagtgaagtggggaagagtcccttataaaaccatcagatctcatgagaactcactcactatcacaagaacagcatgggggaaaccacccccgtgattcaattactcctacctggtctctcccttgacatgtggggattatggggattaaaattcaagatgagatttcggtagggacacaaagcctaaccgtatcaactgtagtcactaggttgtataacagatctcttgaatttattccttttacctgaaattttatatcctggaccagtatctccccagtccttcccacccattagccccagtaaccactattttactcttcgcttttatgagtttaagtttttcagattctacataaaagtaagtatttgcctttctgtgcctgtcttatttcacctagcataatgtcctccaggtttatccacgtgttgtaaatgacaggacctctttaatgccaaatagtattccattgtgtatataaacaggctgattgtccctaatctgaagacttaaaatccaaaatgctacaaaattagaaatgtttgagtgccagcatgatgccacaactggaaaattccacacctcatgtgacaggtagcagtcaaagtgcagtcaaacctttgtttcatatagaaaaatattttaaatattatataaaattatcttcaggctatgtgtataagatgtataaaacttttatgtttagacttgggtcccaccccccagatatctcattacaccaacagtgtaaaagtattcccatttctccacagccttaccagcatctattgtttattgactttttaataatcgccattctgactggtgtgagtgtggttttgatttgcatttctctgatgatcagtgatatttagctttttttttatatgtttgttggccacataaatgtcttcttttgagaagtgtctgttcgtatcctttgcccactttttgatggaatttttttttcttataaatatgtttaagttccttgtagattctggatgttagacctttgtcagatgggtacattgcaaaaattttctcccattctgtaggttgcctgttcactctgatgatggtttattttgctgtgcagggattgttttcttgatttctttttcagatagttgtaagtgtacagaaatgctactgatttttgtgtgttgattttgtgtcctgcaacttaactgagtttgtttattagctctgacaattcattcatggagcctttagggtttcctaaataaataagatcatgcctacaaacaaaggcaatttagcttccgtatttatgatttgcaagccttttatttctttctcttgcctaattgctctggctagaacttccagtactattttaatgacagtggtgagaatgggtattattgtcttcttgaggaacaagacattgtttctcaactcatgagagtaattttaataagcactcaagtattgtcattcctgtttgacagtaggccgtattttgagtaacaagggtcacagcataacttgccttttggtgaatcagttggaaccagtttgccatttagttaaaataaacttttctttgcactggtattactagaagtaattgtgcttatttataattaataataattaaatatgcttattcttagttacctaaaaaattatgatattaatgacctcttggttgataatggctaagctgcctcagcttctccaatttagcaacccaagtacatatcagttcaaagtaacacaaattgaagcaattatgtatgatcacataggaatgcttctgattaacaaaatccagaggactggtctttgccttcataaccggaacacaccacatgcatggtttcacagctcttggctattattggacttacttattatattctttaattcaagaaaaattgtagcttcattcattctgttcttaataattttaaattctctttagcctcctgggaatgggaagggctagctggtatagtcccctgtatctcagatttcagttacacataaacattaaaggggcctgacttagggcgctctttgcctctgtggactggtggggaaaatccaggtgtgtcttaaattctaataatcatgaaaatcagaaatcataatgtttcaaatacaaatcttcatacatgggaaatacaattgaattaaacattttcttcaatgtaggagacatttgtcagataacagaggggattctcatttggctaagagcttacctctaagattcattaaatgtgtttagagcatattttttgtagtttgtagttattttatttttctgagttattatttggattattttctcttttatttatgtatgcatttgtcactgctccccagaggcacctcattttggcattgaagctaaaaacccattcattaaggttgggatggagtgggctttgatatagctagcatttgggaggtagaaaatagacattcgtgatcaaaaaagctgtaagcggttactataaactatttttaaatttctaagtattttaaatattgaacaaatgtgtagacatttgatgtgcatctatactgtgaataagaacttaaacttctaatattcacattaactttcctgattttataaattctcgtttatttttcatctgaacattgaagaatgacatctacataaagtaaaagcaaatgttagtttgaacacattctaccctaatagtgcatgttttaaaattgctttggcaggatctaccaatgtattggcacattctcttcatggagttcctcatgtgataactgcaacattgcacattataatgggtaagaattcttccaaagcagttcatattttataaggaaatgttgatttatataaggaaggccatcttatttccatcagactttaagaaaaggcaggttctttgtctcttagagtagagaaatgtttgactaaaaaaccaaaaggcaatgctttactatgtggattgcctgtcttttcaaaatacttgctttgtaaagagcagtaaatgaagttttattgtaatctgtacagaaaaaaaatattgtagtgtgctcaaaattataattttataaccagatgaagaacattaatgaatactccttaagtatatccaacactgatgtaggactgtaccaagactctaggactaggattatgttattaatgaaaaaacataaccagaaaaaaatttcagccagtagatgtctatagatattttattatccctattggtaaaaagcatataagctcaggtatatgtaacactaaactactgttaaatctgtgtttaccttgcctatctactttaacttcgtttctttgaccatgttttataggaaatagcaataagctgaaaaatttagtactctgtgtttcttcactagtacctgaacaagttaaaaatggtaattattgtagttataggtaaagggaactgaagagaaagtgaggatgttcatggtctacagtacctttagatattctcctataagccaataaatatgctctcttatgtttgctgttttgatacaagtcctactgtactcactgattaatatttaatgtaatattcaagggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaagtaagtctttttcttaaaccaaaaattgtatcccaggttcaatgactgttaataacaaatttcattacattttagggcagaagactgtgaaatatcatttttaccatttaacagctctgatgatgtgcaagaaaggtaggtaaaaactcaatgtaatacagataacctgtatctttaaagcataaaacattctgacaaacaattgatcagacttaggatctttggttatttttctaacatagtagtaaagaatatagaatcacagactcttacaggtcctagtaagcaaacaactactcactcagcctttttctctttttccttccttctttcctcccttccttccccctgtctctccctccctccttccgttctctttttcccttcccttcccctttctttcctttcctttgtttttttccctttctttccttttccctttcccttttcttttgagtgcctactatatgccaggcactttgaatacaacaatgcaccaaaaaatgaacaaaacacacagttttgtccctcgtgataattttggtctagtgtgtaatacaaatattaaagccatattaaagaagggttatagtctttaaagaaatagtacattattattccttataatactagtttacctttaaatgaatcaacacattatgttggcagcaacaaaattgtacgtttttacttactatctaattgaagaaagtatttaacatatataatgatgagttctctaattttctcatatttaatagatttgtgtgtgtctgtgtgtctgtgcgcgcgttatctgttttatgtctttgttttgttttctttcttttaggagggcacagggatctcccaaatctggtgagtcgaaaagtatctccttgagaactgtgccaggttctgttgacattttgttctggtgagggaaaataaccaatcactttcattacctttagactgtaatgatcaatggcaaatgatccagggtcagttcttgaatgtcagcattatggcaattccttgcctgtgttcagtggcacctagaggcttggcacctaataccaggttagtaagcatttttattgaattgttgatacatttcttatagaccattttttttccagggtatccaattaactgttggttagctagaaacttaacaggtagtttatctttgtatattagagattctaagggatttgtcatcacagtaggttgagaacaactgttgaactggaataattatcagataatcattgactatttaacgtcactgaggctaaaataatatttcctaagttttattgatagaattttatgcctactttacttgatttattcatttagttgtggagaacattatattaaatactgatatttcttgtgaatgtctttgctttccaactttaatgcaaacataaatatccttagcatgaaaatcacacatatgtatatttgatactgtattagtctgttttcatgctgctgataaagacatacccgagactgggtaatttacaaaagaaagaggtttaatggacttacagttccacgttgctggggaggctccacaatcatggtggaagatgaaagtcacatctcacatggcggcagacaagagagcttgtgcagggaaactcctatttttaaaaccattagatctcatgagacttattcattaccatgagagcagcacaggaaagacccacccccatgattcagttatctcccaccaggtctctcccacaacacatgggaattatgagagctacaagatgagatttgagtgggaacacaaagccaaaccatatcagatacttttagtcaaaagaaacatttcagttctatttaatgtgaatagtagtgcatatcaatctcctgcccacattttcaattgaataaaatatgagacatcttatatatatctttttatccatgggatatagacattccttctcttgcacattcttcttaatcagctgtccattatggggctgaaaatatttctttcctgaatccaatcctgtagagtgtaggagaaaggatcgtgagtgttgtgaaatataggcaataaacggggaaatattcaaagttagagaagaaaaaagagaaactgcaaacttcgatattgaaaacccagatggcaaggtcctcattaattacatctagtgctaaaacttcaaaggagtattttgaaccttgtgtgatttagaaattgagcctggtggttttccccgacaccttcagaaatcctagatagctgtgtgctttcataatgtagtttccctgactaaacttgaagacgtggctagctgaccaaggagctatgtttggcaggacttgagacaatgtttatctaaccctgtttgtttaaggaccttcttgggagggtagacctgctcttctgggaacaatcgattcatagctccttcaaagccactccataaatgttctgcttgactagaattccactgttgactctgcaggcttaatcagtattaatgaatttttcagagaaggatgactaattagagatttcttctgtggtttataatcacaacatgccatctttgcaaagaccttttgatcaagactcatttgaccggagatttttcagagatgtagcttctgatgattcaggatgattgaacaggagatttcactttcttctttttcccccaccatgataaataataatttatgttagaatatctcagtgcaaattgccagtaggaactaatattcttatattctaagtattctaagattaaatgtgttcatatatgtgagacatttaaagcagtgccagccatgtaagttgtgtttctatttcaagtaaatattgcaaagcaggcataggatagtgcttttaatgtttataaattatgcaattaaagatgcacagtaacactaccatgaacgttttggtgctgtttatttttaattgggaagaagaagcatgatggaaagcatactgagcacctggagtattggtgctgatgaccattttttctctgtgtgcctttgaacaaatcacttaaacttggagttgtcttttccctctacatgaaatgagcgaatgatgagataatctctaaggtcccttacagctctgacttgagctttcataagatactaagagctctttttttattttgttgttattcttaaattaacttcatgtttgcactgaaatcaagctagaagtcatttgtatgtatttctgcaaactgcattctatagcttgatgcatttgtgagtggctgttttggcactaaatcacacctctgaattttcactctcttatattggatggaacagttatgcaagattaaaatgttcagtcatttaactgaacatgtgtggcagcatttgttcactccatttcatccatccaaaggccactttgatttatttcatttcctatgtcacttagaccttctgtctataaataaatatttaaatcacactttagattttagaaaatgttgagctatttgttacacaacttgtgcatattaactcttctataatacatcttttaacaacatagtttcacatttagaatttctaattacattgtattttaaattatgtcttgatatgtgagtaggacgcttgatggtttgctttgtaaaatgctctaatgtaagagcttattgagaaggaagccagtgatttaataaaactcatttgaaagcctgcatcatttaaaaaatagcaagatacggtttatgaattttaggtaaacgtaacatggtgatttatctatcttgtccaatactttcagtaaacagtatacttgttataaggaacagtatgtcataatttttggtataatctcttagtaaatttcttgatgtctaatagaaatatttaatttcagattaaataatggaagtatggctcttataattgcccgaaacacttctcggccagaatttataaaacacctgaaaagatatgccagtgtaaaaaatcaggtatagtaaattctttttgttacttatttgcaaagctattaatcatgtagaaaaagatgctgcaagaattgacatcgaatcctgcctcataagaaggttttattttcttctgaatatattaatcttctttttcccaatctatttcatccaaattttgaaaagcatccgccaggattaatatagattggccttttttgaatgatgaattagtggttatgtatctgtaaccacaaagataaaataggaaatgtagtgttatattgcaatgtgaaataaattaaggataaaattccatactcaggctgttcttcagaatgaaaagaagtgaaatttgagagtttagccttcttgatattatggcagcagactttctaaagttatgatctttagatcttcctgacatttgtttgcatatctgcattgattgaaatagatctgtagatatgtatttaaaaatatgacagttttatacaaatattcattcaaaatgagaatatgtgaagatatacatttccacttaagtgatttgctttaaagagaaacagtaactattacaagccatattattttggcagctgttttgacctgattattaggaaaatgatccttgaactatgtgaatttctgaaattgtgagtctttgaagtacataggtatggttgtaaaaccctatagtttcacactttttctttttctttctttttttttttttttttgagttagagccttgctgtgtcacccaggctggagtgcagtggcgtgatgtctgctcactgcaacctccacctcccacgttcaagcgattctcctgcctcagcctcccgagtaggtgggattacaggctcacacctccatgcccagctaatttttatatttttggtagagacagggtttcaccatgttggtcaggctggtctcgaaactcctgacctcgtgatgtgtccacctcggcctcccaaagtgctgggattacaggcgtgagccaccacgtccggcccacacattcttaaaggtataaaatggtgcttggatagagttgggagataacagacgggaggaggaggagagtaaacccagccaatgactggcagctgaaccttgcttatgtaccttagccatagcaagtctctccatttttgcctcattatattttaaaactttcttaggccatcttcatgaagtttgatctgtcagtaacattatttgatcctcatgtattgaacaactaactgggctgcttaggaacttaaatcataaaaaattacagtcccactttctttatatgtcaaagtagatcagcaggtataatgtaggttgtgagcctacataacagttttatgtatgtgtttgggtggaatatggagatttattgattttcaaaggaatatatgccctttcacattttaataaatttctaaacattaaaaccaatttttaaaaaacccaaagcactatatattcattgctgtttttaagtcagaaaatagaaacaagaaaatgattttaaagcactcaaaattccatgttcctcaagattagtgtcattaccttggtagaattttttccgaatccttttttattaaataaatgagaagtaaagtaagtattaacctcattcatgtacctctatttgagaacttaaatagtattaacctattaatgtacccctgagaagttctgtatttattttggggaggtgtatgttgcacaaattgtttatggaaggtctcttttgaaattgcctatggggcaagtctctcaggcaatttttgtaaacattcttcttcttcatttttttaaatcaatatacctttcttctgattttaaaagcaatggttaccttacacataaagacagacatacagaaaataataaaaatctgtatcgataggaagacgttttctaagagataatattatgcaggatttatcatattttctcatgtactctacgaggcatatcttgcttttgacacaagaaacagttgcctgtgtgtgattcactggccttaactctgatttatttatcaactttcaaaaattaaaatccatgctattttttttttttttgcaaagaattctaaaatattttgcatagtgtatatagtaagaaagattgattcccagggtgactgctttcaagcaatgttaatttgatttgttaattatccacacaggtgtgtttatttaggctctttccttcatggtgacattaaaaatgtgaatttatataaattttgtaagattatgaaaatcagatctatgtaaaaatcatgtctactgcataattcatagcagtgctggtattcaggaaggaaaatgtggcaattcagtttaaggagagtaacatctgcttctctgaaccatttttaccaggttgaataagcgaatgttactgtataacactgtaaaatagattgaaaccaccatgtgcggagtggctcctgttccttccccatctctgtgtaaaattagatagaggctgaacactacccttcaaagtccttgcagctccatcctattgctttgccccccttctcactgtccacacttttctctttcattgtgaccatttttggtagggagtttaaaaccttaaatgtgagtgcttcccccaggatttctttgcagccctctcatcttctcaggatgccgtctcctggatggcctcattgcccctcacttttgaactgtctgaacatcatgcactcccaagggttctgtcatctcgtcttatctgcaggacctctgtcttcttgtatgctgaagaggttctgaaattcaccggcatctggaggccaacatgtctacagccgaccttatcttttcccctaaagttgttccttctgcgttgctctgtgcgggtcaatggcaccactttctacccatccaggttaccctgaactgttccttcttcctcattcctcactaccagtcccctaacttgttctgttggtctcctcttaaatgtttctaaaatttctccctcaccttaattcaaactttaatcctttcttgcttacagtagcctccttttggccttcaggttctctggtcttgtcttccatacctctttttagagaaacttttttctaagacacacattggatttctctcctgcttaattcttcagtgcctttctcttgttgtcagaataatatggaatatcctcagtctggaacacgtggcctttgtatccaggtccctgcctgtgttgcaaccccacctcttattaccaccctccaccacattcccagtgttttggcattttattcgttggctaaggttgccataacaaataccacagaaaagatggcttaaacaaacagaaatgtatttctttcatggttctggaggctagagctgcaagacaatgtcagcaggtttggtttgtcctgagtcttctctctctggctggcacatggctgctttctcacagcacccacaagtgagtggtctttcctctgttcatccccgatgccttttcctatgtccaaatttcctcttcttataaggacaccagtcgtattggatgagggcctaaagacatcattttagcttaatcgtctctttaaagatcttatctccaaatatagttatgttctgaggtatacagagcgaggatttcaatacaggaatttgagggccaaggggcatgatgttgagcacctaggagtcacactgaattctgtgtagttgcttgaccatggtttgcctctagttttgtaaatgcttcctctctccagactttcttctccaggctaaatcttatatgttctttaaggctcaattcaaatgggaagctttcccaacatccatagcctgtttgcctcctcttgtttcctctgttgaactccacacttgcaccatcatggcactcccctgtatcaaaattgtaactgtttacttctcctccccgtgccccaaacataccctcacacaggatactaagctcttggctcccgaaagtcccacttaacagcgtctgtggcttcacagttaaagcatttgaaggatggctagatcttcattttgtgaggagtgcacatgacaactgctgatttaagataatagacttactggtggtggctgtcaattcttgacattccttggcttacagctgcatccctccagtctctgactctgccatccttggcattcttctctcataaggacatcagtcatattggattaggtcccgccctaatgacttcatcttaagttgattctacctgcaaagaccctatttctaaacaggggacattcacaggtaccaggggttaggacttgaacatagttggggtggtggagggaaatataatttagatcataacaggcagttgtgtgttttaaatgaattatcaactaacatgaatgattatgtagataattctacaaggatgaggcatgtagccaaggctttatacccgaggtaggaggtctaacgcagttactgtcaaacagttttgcttggggccctctaattctgtacctcagtcacaacagctgatgccatcatatcatctactgtttaactgtgtttacagtataaactggaaagttggctggaccttggtatctacatatgtaaaatatgggtgttggggaaaatattagttttctgtcaacttttaaaactgtttcattgaggtttacatgtggaaaaggggaaaaactatgtagatgatgtttaattaggaatgtatctcatgtcatttttctgaaaactgaaatgagtagttatacatttctgctcaagttatttggctatattttcttaattatgtcagaaaatacatagtgctttttcagtatagtttccttaggcaaacaagaaaaaacgcaagttgaagtttaccttgcaccattctatagtggtaagtaaacagtgatcttgcagcttgtgtccattgttaaagtgggaatggggcaggcaaacaccttttaaaatccatatttgattggctttctcttttaaaagaagacatacatcccattttatcttcagaagtttagacttgcgttcttccaaattaaattccaagtgtgaaacttgtactagtttgctttatgtcagctaaactaattgacaagttgataatggattatatgtcttctgtatctacaggccagtattaaagattatctttaattgaaaaatctacagtatcactattttatgtaacttctcacagatatgtactatttgtcataaaacaagatttctaggtgctagatctaaaagaacccaaaaggctttggataagagattccttcttccaaaaaaacttggagatccctgttcatagtctcaaagctattaaaatgtcagcatacatgctgatatttacttgtgagagagggctcagtgaactttgattcgcgttagtagctagagataaaccaagtataatgattatttgtatttatttttagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattaggtaagtctatttatttcaccgcttattgtcaaccagtaaacataaatctaatattacaacgaaagctctcttctctgaactatcaaagcaggcagttggttagtttttaaaaaatcagtaaatcagggaagcataaagagacatgcacaaatttcaataaataaaaagcaactttacatttattcaactgttatgtagacccaaggcattttctttggttatgcgtgtctacattggctttctaatttattgttgtgcataaactacagataatgtctacaacttccattttggatttttaaaaatggatcaagatcttaaatcttttagtggagccatctgaatagtaaagtgttagatttttatccttccatcttagtttcctctcactcataattactgtaacatgttttgttcagtaatttgcttttattaggcctttacagagcattcaacttcccttgggaacaattttacatagcaactggtataaacaggtttaggaacctgcaaacgcattcttggtaggcattgtgacactcagtggttagaagaagcatgcaggggtgcccactagacatgggtgttctagaggcataactgactgttttacagaggtaatggagagcattggacaatcaaggaagtcagttaaggaggttttagagcaattattgttgttgatgatttatcaatcagaccttctcagttttctagattacagctctgttgggaatgctgtgtttgttatcaatttgtatttggcattggcattgtgtaccatacttattaggtgtatgtgaaaaacaacaaaataagttgatgaaataatgtattttctttacagattgcatccaagacttatcagtctttatggaggaagcatggaagaaatgattccaaagtaacatgtaattgtttctaaaagaaatgtacaaactagaattttaatataaagaaatgtggccatgctttaaacctgtggtccccaccctttttgggaccagtttcatggaagacaatttttccgtggatgggggaatggtttcaggatgaactgttccacctcagatcatcaggcattagattctcttgaggaacatggcactctagatccctcacataccagttcaccatatggttcgcacttctatgagaatctaatgctgctgctgatctgacagggggaggaactcagtaatgctccattgctctaacctcctgctgtgtggccaaacggatatcctaatagaaattgatgttactaacaattagcctctagggctttaaaagtcaagatgaaatatcaattcaaattctgtttttagatatcaattcaaattcttttttttacaatgtgtttattggacacacaaaaaaactttgcaaccatcataatacatcaatatttaacctagataattctgaaataatttggattctttcatttttcaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttcttaaagtggtagggttttaaaattcatgatacaagtaacaaagtaagttgataacaaatactattttgaactgggcaaaatctagcccaatatgtaattgtgttccccttgtatctgagaggcctgtgttggacaaccatagtactctgctttcactgtgctcagataacctgaaatatatagttgtttctgagtagttctgagtaggaaagaaccaaatgtaaatttccttagagaccatcctggagaagacagttctaaatcggggcttgatttttcatctatgatcctagatgttctcctgaaagaatgactagcctttttataacgatacaaagttttttaaaaatacataaatgtcataaagtttattcctgtgtatacacactctgggttcaggaggttttgtgcttacatttcactactcaaatgccttcgcaaatctcagaacattcctcaccatcactgcaggcctgtgaacagataactttcatcaattaggatggctggctagtggcagggacttcatataaagaaatctttcccagaattgtttttccacattgccttctaatttgatcactccctataacagatgttcaaaattcggccacagctctcttatgaaggcagagtcagataaaatgatattctgcaattatctagatcataagcataaaataaatattacaaaaatgattgtatttaaagaaattttttaaaatccagaaagtcatttaaaatagaacctcatatagtatgaacaaactataaaaatattttacatttca

SEQ ID NO: 13 - DNA, 145347 bp, Homo sapiens
  mutation 89951: a/g SNP in reverse strand
attgctatttgggcaacaatatggctccttcagaactggtcgagaatttctgtggtctttgcttgaccttcaagttgggagtttcaaatcagaggctttgaagtctggaggagttcgcagccattaatccttccggggttgtgctaaaggcgtttctagaaagagatcggaaagacccgttcagcacaggcccattgcatcttctctttgaaaacgcttgtctgaatcaagtatcttatacagacccgagactgaggggagcaagagcgcaggtccggctgtggcgaggtgtccaccaccgtacttgtggtcaatgcctggactagagagccgaggccgtccagggcgggctggccagggaaccagaagcgtccctggactggctgagtgagggtgccctttccagcaacccagtggccatggttaaaaggcagaatacaaccgtcaaagaagtccccagctcccacataagagagcgcaaaggccaatggaaccaaggcctcctcgcgagaactagctcgctttgaggacaagatcctggggatggaggtggggactgacgtagtgagagggtctggaggaacagtcgtagctgaaggtcaggacatgaagaattgcacgtatggtagggatagaatggcaggtacaacttttctgtactgaaggaactgggagaggacgatccggttagggaggttggggaactaatctcaacgctgcgtttacagatgaagccgcttttatatggcgtatatgtttgcttagaggggccgacggagattaggagaagccatcctttggcgccaatgatcaaagcgtctgccaaggagaagaagccaagggatgggcctttcagagagggcaaggagtcatgctgctctggatgccagtgtcaggacaagaaatcgaaaggagcgaggactcttcactgcgtgcctcagtctccccgcttctgcctctttcacctctgtcctacttccggcgcgaaagcaggccactcgctctgatctagacctagttaacattagcttttcccttccttccctcaaatcccctcccccctctatccccgtcccttctgccgcctgaaagggttaatctctcctgcgggtaaaaacaggtccgcggagtctctaactggcgacagatgggccactttcttctggccacaaaggggccggaatggagcgctccgcggcatacaaatgggcaggtcacgtggttccaggctcttggctggaccgggaagaccatatggcgcatgccggggaggaaggaggaggggcgggggtaggggtggagggtgaggggagcggttgtcggaggagggcgggagacgagcaaggcgtggggagaagtggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaaggtaattacagttctttcatttttttgccccagaatagaagcaataactgaagactgatgaacctacatattctgtatgtgtgcgtttgcgagagtgtgtatgtgtattgagaccagcatccccctccataattgcccataagtactcacacataatgagtcgtgtcactcaagtaccccctgcaggctttctaatttaaattttaaaaatttgggtttcttttgtggatagcataggagcttcttggattttttaaaagaatgcacggtaactatgattatctgctagtgctgattttaaagtcccaaaagcaataatgacttcactttctcacttcttacagtaagaaaaaaaaatctatgttatcaatatatattttgtgtgcatgtattttacgcacattgggagtgtcaagctgtgttttcagtgaatgaaagggacatggataccttgagtattcacaccatggaaaataaatcaggttcagagatagtttagttgagaggggggaaagtggagaaagggagagggactcactcctgctacctgttaccgctccagaggcggccaagtccccagcagccactactggagccagaaattcagttgttttactaaaggctttttattttccttactagaagcggcaacttcgcggttgccaatcgctgaccattataattactcaatcttttaaagggaggtttgaggcgaactttgaaaagccccaataaagagcgggcggccctttcaatgggctgtttattagagaggagccttccgcacctgatccccggcgcgtgggagagcgctctgcgccgcgcccccagccctcgccctgcagctagcgcttttgtacaaggtggaaatttagcggtgggccagagatggaaggcaagaaaagaaaggcgagggaggggtggaagaccctgtccacttttgttgccaaatgttacattgatggtgaaacaatttggtggaaactatttttcctcctttctgcatttgcttttcagtatcccgtcgatgtaatcttcttaaaaatcgctgccagtattagtaaattacgcaatggctgttcaacttaaatcgctaagtatctggaagccaggacagaaatggaagtagaatgtgtgattttacagcttttttttttttttatggagttgtgagtaactttgaacacatttggataaacatgaagtcgctgaaatgtacagtcatttccacacacattatcctgtcgggcaaccaccataaacacatttaagttaatcactaggatacaaacacatatgcgtgagtggtgtacacatatacatattcactaccctcccccagtcctgtcctcactcctacgtactagcggggcacacgcacgcgccattataaaacactgcatttaactttttctcagaggcattcattttgtaatgggcaggtacttttcgcaagcatttgtacaggtttagggagtggaagctgaaggcgtatctggcttttgaatatagcgtttttctgcttttctttctgtttgcctctcccttgttgaatgtaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaaaccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtgagagcaattgttgcatttcttcttaaagggattctgtttttatttttggggaaagtagttgcttttttgctgagttaaaaaatactaaacactatatgtagaataaaagaaaagaaaaaagtttaccttggcatatgctcttgtctgtttatcttgcacagggagtcaccagttctatgtagataatgaaaagacctaactgatatttcattatttggaatatgggactggacggcagtacaaacagtgtgtttttttctttgttttaagtggcttagcctttaggttttttatttccatttttaaaaatgattgttacatgttttcttctatttctttttttaaaaggtggattttaataattattaacaagcaagacataaacaagtatcctagcttagtttgtctatacatttaagatgtataaaacattactattttcttggtcttctgttatctgtacatttttctgaactaaacagttttatcttgcaaactagtactgtcccagaaaaatttatacacctttaggaagtaccaaagggaaatgagttaattaatttaaagaatccaagagaagtaacattttataattgttctattaacatcttgtgatgatttccatcatttttccaagaaaaagcataatggattatttgtactgaagaacacactatttgtactgtatttaggaaggtgtaattatttcctccccccaccctttggggcactattctgttgtttcatgaacacaactcactggaaaaacttatggatgattctgtctattgttaagtccacttcaaaaaaaaaaaaacagtttggcatttcttttcctctggatgtattgactgacagtcatgattcctagggaatatcattttggcacttgtgccctggctctactgtggtgctctgattactgtcattagtaactccattgtttctactctgattcgggtgccacattggatgactaccccccttcccaagcttgttcctttaatctccttctcattggtgatttaggggttccagaaagctgacctcatttagcaagctgctccagaaaaatgtgagtaatgtaatggacaggaacaattagccatactaataacattgccaatgaggctgcgtcaagctgtgacagaagcagtaaggaatacttcgacgttaaaaaaatgtttgagagcaatttaaaatatattattttaacatgttttctatcagccttcatcacatgacagaaatacttttaagttagtcccaactttatctaaaatgcagcaatctcattccaagtgaatcagagttgttattttggaatcaagctgttgctttctatatcctggattgttctcactgttcttactttaagagacataatactgatatgatacttgaatactaccagccttccagtgtaggaggtaatgaagtgagcattcagatctgatctaacctattaagtagctcaatttcacctgcaattaaaattagacatcttcatgcaaactaaaatctgttgctgtagtgaagagaagaaataaaagaatgccattttgagaattccagcttccaaaatagcaaacagggaaatctagactgtgttcttttgtaaggtagaaatgaagactaaaagttaggttttttttttttttcttcccattttgccaatacaacttcattctaaaacatagggattctttcagtcagtcaaggagtaactcacatgccaccatcttttattcaaaggcaggcacagatgttccttctgcaggggaggatttaatttatgaaaatgatattgtttatgcatgaatgaactgcatgcactctgcataacacatagcacttccatctgatcagagaaataccacagaaccagtgccaatgtcagaaacatattctacaaatttactcacttaaatgtttaatgaatatttggaaggcattttcaaaccataagaaacattttaaattatcttcttttatgaattcctacccatatttaaaagagactcttacagtttttgtaattggctaatgcttatacccagtttgtaagaaaagaacatattttactaaatgaaaaccaaccaaaaaaaaatgctggcaagtttggcttcactggaaaaaatatttcgtttagttttgctgtttaatgcttgtcatgaataatatttgggattctatctgtttcttcatcttgagccacgactattcctatcaaataagatgcttaggtatacttgtttaatgtgaaaatcctatgaatagttatttctagaaaaagctggtatgtaaaatcagggggaaatttcataaagatgaaattgggctaaatattgtaacatgcataattactattgaataggaacacttcacataacatattttactttatataaccaattgcagctatatagtatgatctatctacttttaatcattaaaacaattatatataaattaaaatgaaagattataatatcaagagtgttctactaattttaggtttataatatgttacagtaaaataccatttgaaataaattttgtgttctaatttatcttaaaatctctctgtttttacatttgaaagtccttacattcttacaaaattaatgcattttctgaaagaagctagcaattactaaaatgatatatggatcattagctaacagtttgaatcaagctgttttagttctataattatacaagaaatttaaagtgaaaatacctattaagcaattaataaaactaggtttcaaaatattggctaattttctcctaatgggaaatgtaaaatagcaaaactgcttcttaaactacacaaaaacctcctcacttctccttttctctctctctaacaccacttatttcctgaaaatcatctaaataaaatatttaattccagggtctgatgaagaataaaagagccaatgcaacatcttgtggaacaccaggactgagaactcttgttgttaccattgcaaagaggcgttctggcgtcagatgcacagtgatttgtatggtggcataatcattggctcctggccaggcattatgtttcagaggacactattgtcaagaaccattcaactagaaatctgcactgtatgcactcaaaagttgagatcatctgccttcctatgacaggaagaattctgtgctggcaattgactcatggactctcttcacatacactaaggcttggtccagtggctctgatggaattaactgtgcagccaaactagtggcattgacaagacagggccacagtctctggggacttcaggagaaattgctaattttaaaatgcagagtattatgttaatgctggattaaatcttcagatacattaaatgtggatttggccatctaagcattattatgttatttgcccagttaatttagaggtagatggatggtgacaataaccatctctacagatccacaattctaagagatggatccaattgtgaaatgatatggagagatagagtaagttcaatctagcatatatgaagtaatttggtaactgacttttcttttaacaagatcaaaagctaacctgctttacactttcatgtctaaggacagccaaccagagagatggcttcacacactagcccactgctaagtgcttttcattcactttcatatttcatcatcaaagcaccctcctgccttatttatagatggggaaacttcaggaagttgagatacctagatatttgcattcctgtcttcctttcttcattcaggtttttctttcattgccacttcctcaaagaagcttttactgattcccatttaaaatagcaactgacttcaactccaccaaaatcactgtattgcccctccctctttccagagcatttgcctatcaaatgttatcttatgtatttacttgtatagcttaattttaaactatctatctctaggtcttctgagcacctgagaaacagagacaaagttgtctcttctgtgtgttgctgttcctctggtgcttagaagacctagaggatcctcaataaatattaactttccaagggaactgaagagcactaatgtgatgctaaagcctgttgccttaaccactatgctataagtcaaatcagttgagaatggagaggaccacaaattattttcagtccagcaagtgttataaacattaattctataaaaagaaaacaattgaaactaatttcttattatattgcatggcaccaaactccccccacttcctttttgaggatcatgagttgtctgtcattgtttctttttattgatatcaattggttaaatataatctggaattggaataaaagaaaaactattataggctttttccagaccatgtatttcaatgcatattattttttcctttctgttcattattctttcagtaattgcacttgttctatttttagtgttatgtaaaattactgtagctcataatttctattttgaagggttcagtgtataaacttagcacatcaatactatctttttagtgttcgcgctcaatggtgtcagttaagagatcaccatcacttttggtgacgtcaatgaaggggtattgcaatgcttaagagaactgttaatccctttccactggtgtcactaacaattgtagtgcttgtttattcatagcaggtacgtgactaagtaatgttaacatcaaagcagaaagaggataatagagtgttctaaaaagaaaattcggtggttgggtgcagtggctcacacctgtaatcccagcacttttgagaggccaatgggggtggatagtttgagcctaggagttcaagaccagtctgggcaatatggtgaaacctcgtgtctacaaaaaatacaaaaactagtggtgcatgatggcatgcatctatagtcccagctactcgggaggctcaggtgggaggatcacctgagcctggggaggtcaaggctgcagtgagacgtgattgtaccactgtactccagcctgggtgacaaagtgagaccctgtctcaaaaaaaaaatgatttgagataacatcacttgtcattgtttgttaactgaataatctttattctagccagtgcctaaatacataataaatgatagtacaaatggatataaattataactaaacctaagtagtgatatttatcacaatatttctttactagaagaatttctttgttaatagaggcaaggctacttgtttagataccttaaaataacataagatttttggataaataaattaatgattctttgattctgactggcatattaaaaatattaagcgaagagatctttgcttcccaggttttattttttgtctaattaactactggtgcatttatattaaaacatattgtcaagggaaaacgtatatatatatatgtgtatatatggtgtgtgtgtgtgtgtgtgtgtgtgtgtgtgcacacatatgctatacttggttgagtagtatccccttcccttgcccacctctctcccaaatttatgtccatccagaacctcaaaatgtggcctcatttgaaatattgtctttccagatttaattaagatataagatgtaaattgatacaagttcatgctggattacggtgggccctaaatccaatcactgatgtcctgataagaagcagacagaacacacagacacacagcatacaggaagaatggcatgtgaaggcaaagacagagactggagtgatgtgtctacaaatcaaggggccccaaggatttggggcccacatcagaagctgggaaagagacaggaattctcagcttctccttctgaatccctaagaaggaatcaaccctgctgacaccttgattttaaacttcttgtctccagaactgtaatataatacatttctgttgtcttaagctacccagttgctggtgatttgttatggcagccctaggaaactgataggtatactaaaatctctaatgaattgatgttaaatatatataagtataggagagttcatttaaattcttctgaaaatgtcttcttaaacttttaatgatacagtatataacaaccagtatacgtagttggtatcgggtttgacatttaaacaagctgacaaaaaacagctgtttaataaacatctgaattatataaaagttttattgtttattattcatgtgaatgacttaaactgacatctacatttagtgaagtgtgaatgggcctagccaataaactatgggtaatttttttaaagtctcatctttgaactcacaaaaaattatcaaatatcagctattatgtattcttcatgtgaagaaaatgtcatatttatttgatttgtggattagcatatatattaatagagcttttgaaagaacaaatgtagcactttcccgatttcatagacactcatttaacacacaagttcatattttaaagtacataattttaaaaaaattctagtccaaatgaatttaagtgccatgacttctaaaaattctgtctctatttttgggttttataggaccttgagccagtactcttctggtgagcttaagaggctaagacttcacctttagttatatggggctttcatctgattatttgtctattttgattgctctaaatacaagttagtgtgtatttcatctgaatgtatttcattataagttttggttttatgtagatctggggatctgtcttgtttttaatcttgattggtctgtttgttttgggatagttggtactttcatttcttatgcttgctttctttttcattttgtgcccacctttagtcaggtgaacatcagtaaggaataaaattttatttttttaagccactgaaaaaatttaaaaaccacatcataactctgcctctgctgactgataaaaatgctaacttattaagacaaaatgttatgcaagaagactttattggaatagagaaacatcctttttatgtaagaaatatcaacagagacatgtgcctttcttgtgacaaatgtggtatgtgtgtggattagaggtctggaatgtggcagcatttcagtacttggaggggagaattagagtagggtagaaagatagacggggagcagaggatgattctcacccagtagaaagcagagtgaagaaagaaaggggaattgttttttgcattatattatttgaactgtggattaagtctttccataagccatccctacgcctctaagtaggttttattaacttaagctggtttgagatgggtttttggtcacacacaagaattgcctgatacaagagaggctttgattttgttgttgcttgctcatttttatacactaagatggagaaaaccctggacatagtgaagacgaaattgaggaaggtgttgggtagagtggagggtagaagacctgtaacataggtacagaattacattaaactggaaggacttatatccagatataggagtcagggtagaaagagagaatgttagcagtaagggtaacagagtagcagaagtttattcttaccaggtcctgttatgtgacagtggaggcatgttgaccttctgactaggggagttaaaggagaacactgaaggtttagaataatgtctctaaggatagaaagagaaagtttcatcaagactcatcaataatagggcagcagggcttagggccaagcaaattcagagaccatgatattatagtagtttgtagtggtcttaatccatctaatttttcagcattttctcaatggccaatacttagcagtggtagtgttttatggcatttggacaacagaagtgaaagcactggtaagagagacgttgaagtgaaacaccatggggctcagaaaagcagagttgatccatctggtacatgggcaaggatggtcctgaacaattctgcagtaagttggaagatagaaaaaatacctaacgaacttgtagatctgggtaaggagatttttggcagaatattgtaaggctaattggcttctcttaactatatgagatagggttttacaagggagagataagcgagcataatttagaagaactatagggggtcccaggcagactctctggctggaaaattattctgatagcaagaaattagccccaaagcaaagatgaaaagtagggtacttccaattaaacatgtcataagggcaagcctcaatcaagagtgtggctagaaggcacagctcacctggacaaaagtgcttctaagcatattaggagcatataccacaataacctgacttggacccaaagttgagagaggccagtctcaaaaaaatttgagggaattgcttttgcataatatgatactttatatacatatctgttacatatcatatatatcatattaaaaagaaaaaaaaccctgtttttccttccgttctttcatataacccttctgacaacaaatgtggagtttttcacacactaagcaattctttagttcttgctggacacttcctggatgtcctacaattcaactcgattctcacacaactgcccagagtcagtgcagacccgcagattaaaggcttagccccaaaagactaccccccactttagatgtcaatcacaagtctcaacttcatttacttctgaaggacgagctatacattggaggaaacccctctttctttcaataatttgctagaatggctcacaaaactctgggaaacatttacttatggttaccaatttattataaaggatataactcagaaacagccaaatggaatagattcatagggtgaaaaatgggggagaggcatggagcacaactctctcagcacctccatgtgttcaccaacccagaagctctcagaactccttcatttagggcttttatggagctttatcaagtaggaatgattcatgaaatactggcattggtgattaacttaacctccagcccctttcccctccctcaacattgggggtgaagctaaaagttccaactctgtaatcacagggtgagcttccctggcaactagtcccctgatccttagggggcttctgaaagtcacctcattatcataaactcaggtgtggttgaaagggatgttttgaataacaaaagatgcgcctttttcctttatctttctgagttgtttcaggagctagggacaaaagactaatactataacaacaacaacaaaaaattcaatttttgcttttatctcttgggaattacaaggattttaggagctctgtccagaagccagtgatgaagatcaaaatacatatttcttattatatcacaattcacacatgtacatgatatccgtaagataagtgaactacataaagtaagctcacaaagtttctgtaggagttttgtccatttacaaacagtttgtaagctaaaagtatctgtgacaagcctcagtcaatttagaagttcatttttccaatgttaaggacatgcctgtgacacagcctcagaaggtcctgatgacatgtgcccaaggtgatcaggctacagcttggctttatacatttagggagacataagacatcaatcgatacatgtaagatgaatattagctcagtccagagaagcaggactactgaaagtggaggcttgcaggtcacaggcagattcaaaggttttctgattgggaattggttgagttattatcttaagacctggaattaataaaagggaatttatcatgcagatgaagctttaggtagcaggcttcagagacattagattgtaaaggtttcttatcagacttaaaagagtctgttctaacagtctttaggtctcagtgttgatgttaatgctggtcagctgtgcctgaattccaaaagggaggagagtataatgaggcatgtctgagtcccttttcccatcatggcatgaactagtttttcaggttaactttggaatgtccttggctgagaggaggggtccattgagatggttgggtggcttggaattttatgtttggtttacaagtttaacattaaaagcctctgtacctccaatgttttatggacaaaaagaaggctgaaaaagctacttggctgtaatcatgggccatttcttgctgaaaagaagaataaaatggaggcagaaccaaaagcccagaggctagagccaagagctgctgagaatgatgaattagggaaccactctcagagagcagatctggatgtgagataggaacattttctttctcagggtctatgaaactggcaacatatgctctcctgaatttcagaattgctatggaccagtgactgtgatatgctttctatatttttcccttttgaatgggtgcatctatcttgattatcctctgtctcattattgtatgttggatttgtgtgggacgataacatgtgtttttagttcctaggttcccagaataagaggagcacactcaaagagcgacatttatgagatactggatttttcacttgatatcataattgggtgagacttgaaagaaagtgaacatattttgcaaatgggagggatgttaaccactgacaaccacacccacagggtccactgtattagcctatctgcaaagacggctgccaaaaattccttctgtccatatatacattcccttttttaatgtgactgtttcacctgccagcaactgaagggctttatttccatttccccttgtgacttgtttgactaacagcaagaagcaaaagtaatgctattccaattctagacctgggccttaagaggcatgacagcttctgcttttactctcttgaaactcaatgtcattttttaaaagctcaggctagactactcatcatgagggaccacatgaaaagagataggcccagctagtttccacccattccagccgctccagatgagatgccagacatgcaaatgaagccatcttggatatttcagccccagctgagcttccagctaaatgtaagtacattcagttgatacctcatagagcggaactactgagctgacttcatccaactcacagaatcataatgaataacaaatcattgttgctttaagtcaatacatttaaagtttttttgttatccagttgtagatgaattatacagcctggggggaaaaaggagatagcacactgttagttgcctcatcaatattcatccccaaattctttttcctttttagtaggtctcacctcccacctggaagctgaaaacacctttcccagtctctctggaagctacagcacaggcatgttgcccaattctaaacaataggacatgataggaggtctgctgggtgggatttttgaaaatatttttttttctggttaagaaaaaagaaatgcccaaggaaaacctacaaatgccccttccattcttgcttttggacattttttgggagagggtatgatgcttagcactcctgcagccatctcggggccaacaatagaatccttgttgctacctggtgatagtgaagtagaaagctacaaagctcttgatttcttttcttttttttttttttttaaattttattattatactttaagttttagggtacatgtgcacattgtgcaggttagttacatatgtatacatgtgctatgctggtgcgctgcacccactaactcgtcgtctagcattaggtatatctcctaatgctatccctcccccctccccccaccccacaacagtccccagagtgtgatgttccccttcctgtgtccatgtgatctcattgttcaattcccacctatgagtgagaatatgcagtgtttggttttttgttcttgtgatagtttactgagaatgatgatttccaatttcatccatgtccctacaagggacatgaactcatcattttttatggctgcatagtattccatgctgtatatgtgccacattttcttaatccagtctatcattgttggacatttgggttggttccaagtctttgctattgtgaatagtgccgcaataaacatacgtgtgcatgcgtctttatagcagcatgatttatagtcctttgggtatatacccagtgatgggatggctgggtcaaatggtatttctacttctagatccctgaggaatcgccacactgacttccacaatggttgaactagttcacagtccaacagtgtaaaagtgttcctatttctccacatcctctccagcacctgttgtttcctcactttttaatgattgccattctaactggtgtgagatggtatctcattgtggttttgatttgcatttctctgatggtcagtggtgatgagcattttttcatgtgttttttgactgcataaatgtcttcttttgagaagtgtctgttcatgtcctttgcccactttttgatggggttgttttttttttcttgtaaatttgtttgagttcattgtagattctggatattagccctttgtcagatgagtaggttgcaaaaattttctcccatgctcgtgggtaggaagaatcaatatcgtgaaaatggccatactgcccaaggtaatttacagattcaatgccatccccatcaagctaccaatgactttcttcacagaattggaaaaaactactttaaaattcatatggaaccaaaaaagagcccgcatcgccaagtcaatcctaagccaaaagaacaaagcttggaggcatcacactacctgacttcaaactatactacaaggcttcagtaaccaaaacagcatggtactggtaccaaaacagagatatagatcaatggaacacagcagagccctcagaaataacgccgcatatctacaactatctgatctttgacaaacctgagaaaaacaagcaatggggaaaggattccctatttaataaatggtgctgggaaaactggttagccatatgtagaaagctgaaactggatcccttccttacaccttatacaaaaatcaattcaagatggattaaagacttaaacgttagacctaaaaccataaaaaccctagaagaaaacctaggcaataccattcaggacataggcatgggcaaggacttcatgtctaaaacacgaaaagcaatggcaacaaaagacaaaattgacaaatgggatctaattaaactaaagagcttctgtacggcaaaagaaactaccatcagagtgaacaggcaacctacaaaagctcttgatttctaatgacatcatatgggatgaaccaacccaggaacagcctgactctggacctcttttaatgtcagaaataaaatcttatttgtaaaccactcttagttgttcaggttgttgacacaggcactgaagtgcctccaaatggtgatgaataatgaggcaaaagtcaaagacagcaagtctagtgtcaaattttttgatgcctatgggtaagaagttcaagaaagtgagctattttctttctttttaaaatttatttttatttttgtgggtatatagatgtatacattagtcagctattttcaatagtgagaagggatgttgccacttagtataatgcctttttcatagctatcatagaaaccatatatacatatagtatagaaaatgaggatagatttctgacttaaactgcctatttcatttgtgtgcctggttacacctaattcaagactctacaatacagcattgctagcaattactgtgagaatatttcaagctccctatttgctggaaatacatttcatttttttgttccaagtttatgaatattagaacctatctaaaaaggagcttttaaaaacttgaggaaaggaaaagggagggcctacttttcttgcctgtgttatttcttgttactgctgattgagatgctagagatcatattgggtgagatgtgtcttagaatacagctgagcaattcacttttaacagtttccatctgagtacaaaaaactggtatgtgcagaaaacttgatattctgacttggcgggattctaggatttgttctatttttttctgtaattgttgtagggacatatggccctgtaccttttgggcagcaggagccagaatagcaggaacattctgacaaaattcccactcagcatgagagggaagcagtccccttgatacactgatgatgtgcccacttagcattacaagtgtttgagaggtggacacaactaaaactcacctcactcaaaatatatattgacacggagaaagtaaatacaatttgctgttattaacctttcttctcaccattgagacatgttaaatatctgaaattaataaaggaattaaatttaaaaagtttacttatcatgcatttaacacatttattgagcatctgttatataaatgcactgtttcaggcacaagagatagagccataaataagcagattaaatcactattctcaactgaggtactaatctgatataagagaggagacagaaataagtaaacattataaatcaactacatacttttacatggtgtaaagtgcaattaagaaaatattattgaatagaggtcaattttggaatggttgggcagggaagaccttctgaggtgacaagaagttggcctgggcaccatggggagctctaccatggtgaaaagtgttccagacagagtagacagcaacagcagaggccctaaatgagaatgcacttggcttatctggagagtagaatgaaggccagtgtggtaggacacatactaataataggagaaaactgatagaaaagagggtttgagcaggtgggcaggaattggacaacatggtgtctcatatgtcataatagaagtttggattttattctacctgcagtgagaagttcttaataaaaaaaaaattctataaactggagtttgagaaagaactatgttgatgatagcataagccctcaatcacttgtcacataaactccaaacttcagcagagactcagggagatcaaagggactaccacaggattacccactggctaaaattcagatccatggcagttggtcctgactggaattagacttccttgtctgttgccctcattgcagtgggtctgaatgtctctgtcggctgtgaatttttctccctctatctgtggcactgagaaggtggcccagacttccagagtctgtctcattggcctattacttggggatttgctgcccttcttctggaagtttgggtatttgttttcagagcatacttaaaggcctcctgaaagcaatgttaacaatagcaggatatattttacagtcttctactcagacttggatttttaagaaccagggatggagactgtgtttccagatctagtcaaatcccttccaaacataaagcaacaaagtgccttttaaactaggacctgtactgtttaatgctctggaaacaaatacccaagcttcagccaaaggagggaaagctatgttcaggaagcttcctgaaagttttttgaaagcaattttcatgcattagtattttacatatatatatatatatatatacacacacacacacacacacatatatataaacatatatatatatacacatgaatcactaatgagacaattgatcttcaggaactaacgtgaaataattggggtatcttggtattattgttatagataaatgttgaagaagttcattctttcagatattaattgagcacttactgtgtactaagaactgtgatagatactggggatttaatggtgaacaagataaattctctgccatcagggggcttatattctaacaaacttaaaatttactgagtgttctctgtatttcagtattgttactaagtacactaacttagtggggaagctagacaataaacaaagaagtatgtaataagaattaatagtaagtgctgtaaagaatactaaagcaggttatggtagagagattaatggcagcgtgaagatgtccatgtttcaatccccagaacctgtgaatatgttaccttacatagcaaaagaggctttgaaaacataattaagggttatctgggcaggcccaatgtaatcataagagtccttatctaagacgggggacaaaggtcaaagacagaggaaaagagacgatttaaggatagaagcaaagaggagagatgttagactgctggctttgaagttggaaaaagtgaacatgagccaaaacaaacaaaacagaacaaaacaaaatccacaggtgacctttagaaaaggggtccccagtctctgggccatggaccagtacctgtctgtggcctgtttggaaccaggctgcccagcaggcggtgagtggtgactggtggacaagcaagttttaccacctgagccctgtctcctgtcaggtcagtggcagcatcagattctcatagcagcctgaatcctactgtgaactgcacatgcaagggatctagtttgtgctccttatgagaatctaatgcctccaaaatgctcaccccttcaaactgcccccatccgtggaaaaactgtcttccacaaaaccagtccctggtgccaaaaaggttggggactgctgctctagaagccagaaaagaggagatatattttcctctagagcctacagaaggaatatataggcctgctggcaccttgattttagtcctgtgaaactgattttggatttctgacctccagaaatgtaaaacaatgcattggttttgtttcaagtcactaaatttgtggtaattagatacagcagcagtaagaaatgaatacacaggtttacaggatggtgaattatggagggtgctcaggaatggcctctttgaggtggtggcctttaaacagaaaaatgagcaaagtgaaagaatgaaccatctggtggggagaaaagcattccagtcagagggaacagcaaaagcgaatgctctgagaagggattattcttctcaatgtgtttgaggactggcaagaaggctttgtgtgaatgagcaaggggaaaaagttagtaggtgatctcggagacatagccagggtccagattataaaggacctctcgccttgctaagcattttgactttattccaagaataatgggaagtcaatggaaggctgtgagcagggttatatgctctcgttattttttaaaggcacaatgtaactccaaaatggaaaattggctctgggctggaggtgccagcacaggggaaaccgaaagcagagagctgggttgggagagcggagactgaagttgtccagctgaggggtgcagaagtgcagactgcaatgacagcaggcagaaaggactatatgttctagacagaatggacaggatttgctggtagattggattgaaggcatgagacaaaggagacatggatgatatcaaggattttgatactacagatttgaaacattctgagagggacaggtttgtgatggaaaatcatgagtctggttttagatatgttttagaagcttattggacagccaagtagagatgtcaggtagggagctggacataatacctaaagttcaggagagtggttggagctggtgacatcatttgcagaaccctggatggtacataaagcacgggacagtgtgtggatagatcctaaagagagccctagggcactccagccctggaagaaggcagcttatcaaaggaaaaagaaagaaagaaggaaacacaatccttattacttccatcttcaggacaattcaaagccagtgtttttgacttcctggcttgagtgaagcttgaaaaatggcaacttgcccctttgcaaagctcctaaggagtagccattggcttggcctgtttgcactggctctgggtgagcttttaaaatgccagtgagctctaattgtgttgattgcctaacagctgtgaatacaagatgctgactccagaactgcaactcattctgcgaagggcaccgtccttttccctctaatgactgctgaacagagccacctgaagcctgcatggggtttagcagcagctgcacttctgctctaagaaatagctcactgcagtcagatcaaactgaagctcttccttgcttttcctcgaagcttgggtacttattgtcggagcattaaacagtaagagtcctagcttaactggtgcacagtgctttatgtttggtagggatttggttaggcctacaaaccgtctgagctaagaaccttgagaaactcctgctatagttagctctttctgtgactctgcagtgtgaccaggaatgaggacagaattaagaatttgctgcctctatgatagaactgtttaggcactagaacactggaactagatctacaaccctatgaatttaatttccttttcaactcccctactccttcttttcaatatgatgataatgatcttgtttaaaaaaaaaaaaagccttctgctttacttcccactctgctcctcttcccagggactcactttcttcttgactgcttccccattacaagtactcagctccctgttttatcaccctgcttagagcagccattatcagccttggctgaacattggaattacctgggaacttttaaaaatccggaagtctgggtctcgcctccagagattccagcttagttgtcttgagcgtggcctggacatttgggttttcaaaagttccctatgtaactttaatgtgcaaccacaattgagaatcactagcctccagactctctgtgttatcaaaattaatgagcagctgattttagaaatctcagttatcaggagaaaagggtgaacccccccagggctcttctccttttccaggtgacacttctttatggcagtgcgtgaaagtgaagccctgctgcttgtaatctccctcaagggagtgcaagatccaggcaaagacaagactgcagaggcgctaccttgggggaaagtaggaccctaaatacttacacctggaggcacttacctttaatactgaatttgtcagatgcaaatttgtctatgcaaaccagggccttatctctagcttcccctcaggggttttgggaagtgcgctactactctgaaacagggttgtaaagcgtcacctgtgctctccagggaaccctctggaaaggaggtggaaaaacagaggcttccacccttgcaactctaagtgtgttccttggccagtgggatccatcacctagtattttcttagatatgtggtatctgggggccagtcccacacctatgcaataagaatctccatttgaacaagatgcccaagcgattatatgcaagtttaagattgaggagggctggtttaactcgagggtaacgaaaagtacgaaatcgtactttacaggagaagctaggcggagggagccacttattcttcctcttgcagctgggtctttttgtggtgagtggcgaagcggcgaggctggcaggccagggtgctggactgggtcaggcgcggccccgcctccctcctgggtccctgccctgcgcgccgttgctgtggcagcgctggacgcggctagagctggggctgccgcgccctccacctccttctccaaaggcctccccggacccctggctcgggcccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgagtgcccggccccaagcgtcttcgcctccctccgcgcttcctccctctccccggcccaaggcctacacccacgagcttttgctccaccctccccttttctcgcctcccctccccgtgctcgcctcactgcccggacaggttaccgagtccccaagtcgccgcctcctccttcccaactgggaactcacgcctctcgccccatcccagaacccccagggattctttcgctacctagccttttcccgcctccgagaccttccccgggcaaacgtcacaagcagcttttgctcagagtctcagcagaaaatcttgagccccaaaggggaggtaatttacaaatgtgagaaggtcaactactcctcccctccaagttgaaaaagttttaatccattaactttgatggtacattgaaactataaacatctcacagattatgcctacacaagagttctgaatccaactctcattttgctgacttgaaaatgtaactccagagctttgggagtgtttctgggtttttttctgcccctcaccttccttgccattgtctagaattaagacttcttcaggctcggtctagaaacttttgatttttaatattgaccctagattattggatcacagttttgcgatgcttagttacgtcaagcggtttgcttaacgtttgccttttattgacttaaaattttagttacctaaaaaagttataatgctgtagtttacaacaaatacttcgagtctattttcacgtcttagtcaaatagccttatagacttaacagatattttataaagaccattttgcaagtcttataagtagactttcatatagtcttatttctaagtccaaactcgagaaatactccccattgttgaattagcttagatgtgagcggtgaaagacagatgaaatgggggaggaactacatcaaggttactctacttgcgaggagatgacttgggggagatggaatttggtattcaacctcttttagctaaatacaaatttatgaaattaaaaaaattgccttcccctgttggaaaacaagacacagtgtggtatttatgttacagaatagactcactgtcttaaagtcttgctcaaaagtctaacaaaatgaaaccaactagccagggattcagcactggttgcgattgtgaattctgcctgtgctgcatgtgccatgctcgctcgcttcacgaaaacagtctttgaccttaaagtgttttcaggtgttttaaaaaccaaggtgtagtattttcttgaaccttttaagttaaaagctagggatatagctatggaattatttgtaagtctttcaggcaattcgagttatgcaatatagaagtttataattacagtttggattagcccaaagagccagtttaacctacagtgcagctgaaatgctatagaattaaaatgagacattgtgcaatgagaggtcatacaaaccaatgttgcagtatttgtgtacaaaaaaagcaaacaatgacatgagaaaagaaatgctgttttatattgagtggtgattaaggtaaaataggtttaattagtgcacccctggcagtagagtttaaaatacatcttgacagatttgtaactttaaaggttgcaagtactgattctttgtttaattatgccctaaaaccatttggtggtcttttccttcatacaggtgtaccctttttctttgtaattaatacctggtattcaaaccactttgggcctctaaaattgggggcacagaagcctagagccttagtaagtacttctgtttatggaagaaaccaagagatgttttatttaggtaaaatatagccaggcgtggtgtgtccctgtaatcccagctacttgggaggctgaggcaggtgaattgcttgaacctgggagttggaggttgctgtgagcggagatcacaccactgcactccagcctgggcaacaagagtgaatctccatctcaaaaagcacaacaaacaaacaaaaacaaacactgggaaataagaaggagatattaagagatgatatatttaaatgttagaaatgctctgttgttgaataagcttagatgtgagtggtaaaagattaaatggaagagggagctacatcaaagttactgtacttgggaggacatgatatggtaggatgtggtggggggagagcatgtccattgctggttggcaagtgactggctgcctcagaaaaggatgagggtgggtaggggagatcactggagattattagaacatacgtatgttttcaagattgcttagtttttaaacctcatagtactttgttttcactgatgaaataaaatactatgtgatctttttctaattttccatcttgagtaataagcaaagacattaatgtattttatgaaggctctgactgccaaaattgggacaaattgatggtcttgttggcagggtaaatgagcataaccgtagtaattgtagttctttttattgggttcagggatgacctggaataatggatgtgttattacccttccctgtagaagtgaggctttcgaaaagaggctataagtcaatttgggaggcacaaagtatcagcgctttttggggattttttttttttttaagtagagaaatattttaaatgtgtgatataaagttatgcatgtgcttcttaagcacattaactcaaccagatccaacagctggtctaataactttttaattgtttaaaaaaatttaattgacacattgtaattgtatatatttatgagatactatttgatgttttgatatttacgttgtacaattatccaatcaaagtagttagttatccttcacctcacactttcattatttccttgtgggttagaacattcaaaagactctcttctagttattttgtaatatatagtattttactgttaaccatagtcaccatactatgcaacaaaacaccagaatttattcttcctacctagttgtaactttgtgtcttttgactaacctctctccatccttccttctcccctccccttcccagtctctggtaactattctaatctctgccttatctatatcaaccttttataatagaaaaagattctacatgtgagtgacatgtggtatttgtctttctgtgtctgggttacttctcttaacacgatgtcctccaggcttagcattcacaattgacaggactttattttttaatggctgactagtattccattatgtttctgtatcacattttctttattcatccattgttgtacgcttaggttgattccatatcttggccattgtgaatagtgctgcagtaaatatgggattgcagatctcttcaacatactcattttatttcctttggatgcatacctggtagtgggattgctggatcatatgatacttctatttttaattgttttaggaacttccatgctgttttccatattgactgtactagtttacaatcataccaccggtgtgtaagtgttcccttttctccatatctgtgtcagtacttattttcttttgtctttttggcaatagccattctaactggagtgaggtgtatctaattgtggttttgatttgcatttccctgatgattagtgatgtcaagtatcttttaaatgcacctgttgatcatttatatgtcttcttttgagacctatcaattaaagtcgtttgcccatttaaaaaatcaagttggccaggcacagtggctcacgcctgtaatcccagcactttgggaggccgaggcgggcagatcacgaggtcagaagatcgagaccatcctagccaacatgatgaaaccccgtctgtactaaaaatacaaaaattagccgggtgtggtggcacatgcctgtagtcacagctacttgggaggctgaggcaggagaattgcttgaacccaggaggtggagattgcagtgagccgagatagtgccactgcactccagcctggtaacagagtgagacttcatctcaaaaaaaaaaaaaagtcattattattttatctgttgaattaattttcttatatattttggattttatccctttgtcgcatgtatagattgcaaatatttttctcccattctgcagctgttttcactttgttaatagttttcttcaaggtgcaaagttttttagtttgatgtaatcttattttgtctatgcttttgaggtcttattttaaaaatccttgctcaggtcagtgtcgagaataatttcccttttttcttgtaatttcatagttttcaagttttacattttaaatctttaatctatttttatttttgtatatggtgagagggaggggtttaatctcattcttctgcatgtgaatatctgattttcctagtaccatttgttgaagagactgtctttttcccagtgcatgttcttgacatcttaaaaattcagttggctgttgtaggtgcaaaaatttatttctgggctttccattttatttcatgggtctgtctggttttatgctagtaccatgctgtgttgatatagttttatcgtatatttcgaagtcaggtagtatgatacttccagttttgttctttttgctcagggttgctttggctatttggggttttttttgtggttctgcatgaattttcagattgtaacatttctgtaaagaatggtgttggtattctgatagcaattgcattaaatccatagatcactttgggtagtatggccattttaacaatataattatttcaatccatgaacatgtactatcttcccatttattgatgtgggaagataatttctttcatcaaagttttatacttttcagtgtagagattctttcacttccttggttgtttatttctaggtatctttttttttaaaaaagtactataaatggaattgttttcttgatttttcacatagtacaatattagtgtatagaaatgctactgatttttatatgttgattttgtgtcttgcaactttactgaattctaacagttcttttgtggagcattttgggttttctatctataagatcatatcttctgcaaacagggacagtttgacatgcttctttctaatttggatgctcgttacttctttctcttgcccagtttatctggctagaactttcagtagtatgttgaatagaaattgtgtaagtggccatcctttccttgttattgatcttagaattgatctcgttattggtcttttcccattcagtatgatgttagctgtggatttgtcatatgtggcctttgtgttgaagtacaaactttccatacctaatttgttgggtttttaatcatgaaattatgccacattttgtcaaaggcttttaatgcatctattaaaatgatcatacagtttttgtctttgttaatgtgtatcacatttactgctttgtgtatgttaaaccattcttgcatgcctctgatcccagtgatgaatcgcacttgaatgtagcaagttatctttctaatgtgctgttggatttggtttgctaatatcttgagaatttttgcacctatgttcatcagggatattgtactatagtttcctgtgttgtattgttatctgattttggaattagggtgatgcttgactcatgaaatgagtttggaagtattccctttgcttcagttttctgaaatattttgagaggaattgatattggtttgttaaatgtttggttgagttcagcagtgaagccattcgtttctgggcctttctttgatgaaagactttattactgattcaatttcctcacttattattggtctggtcagattttatgtcttcctaacttaatcttgataggttgtatgtgtcggggacttcgttttttctatgttatcaaatttgatgaaacttgttgaaaaccaactctaaattttgttcatcttttgaaattatttttagtctctatttcatttatttctcctctgagttgaattacttccttacttctaccaactttgggattagtttgttctgttcttttttttctttctttctttttttttgagatggagtttcgctcttgttgcccaggctggagtgcaatggtgtgatctcggctcaccgcaacctctgcctcctgggttcaagcaattctactgcctcagccttcctgagtagctgggattataggcatgtgccaccacacctagctaattttgtatttttagtagagacggggtttctccatgttggtcaggctggtctcgaactcccgacctcaggtgttctgcctgccgtggcctcccaaagtgctgggattacaggcatgagccacaatgcctggccgattagtttgttcttaattttgtagtgccttgaggttcatcattaggctgtttgtcagaaatctgttgtcttttttgatatgggcatttaatactataaacttacctcttaaaactgcttgtgctatgtttcgtaggttttgttatggtatattttcattctcacttgtctcaagaaaaattttaatttcctttttaatttcttcactgacccattggttgtttaggagcattttgtctccatgatttgtgaagttgtcagtttttctcattgttgatttctagtttatttcttttctttctccttccttctttccttccttccttccttccttccttccttccttccttccttccttccttcctccctccctccctccctccctccctccctcccttctgtattgctttgtctcccaggcccaagtgcagaggcacgatcttggcttactgcaatctctgcctcctgggctcaagcaatcctctcacctcagcctcccaagtagctgggactacaggtgtgtgtcactgtgcctacaggtgtgtgtcactgtgcctggttaaatttgttttttgtttttgtttgttttgttttgtatgtttagtagagatggctttcgccgttttgccatgttgcccaggctgttctcaaattgctgggctcaagcaacctgcccaccttggcttcccaaagtgctgggattacagccatgagccactgcacctggcctgatttctagtattataacgctgtggtcagtaaagatacttgatattatcttaatcttttaaaatttgttaagacttgttttgtggcctaacatgtgatctctcctcaagaatgttccatgtgcatttgagaagaatgtgtatctgcagctgttggacggaatgttctgtaagtgtctgctaggtgcatttggtctatggttcagcttaagtccaatatttcttgatctctctgtgtgtgtttgtgtatgtatgtctagataatttattcattattgaaagtgggctgttaaagtctcttactattattgtattggagtttatctctttaggttgaatatttgctgtatgtatctgggtacttaggtattaggtacatgtatgtttataattgttatatcctgttgttgaattgatccctttatcatattatgaccttctttgtctctttttacagtttttgacttaaagtctattttgtctgatatgagtattgctactcctgctcacttttggattctgattgcatggaatatctttttccatttcttcactttcagtctgtctttaacggtgaggtaagcctcttttaggcagcatgtagctgagttttttttccagtcctgcagctactttatatcttttcattagataatttatttacattcaaggtttttattgataagaacttatttctcccattttgttacttgttttctggttgtcttgtagattctcagttcttctttctctcttgtttacctctgtggtttggtcattttctgtggtcctaagctttgttttccttctatctcttgtttatgtatctgttgtaattgctttctttgtgggtaccatggggctaacataaaaagtcttgtagttataataaactattttaagctgatagcaagttaactttggtcacataaaaatactctagacttttttcctccgccatccctaatttatatttttgttgcctttatttctttagtatgtgttccctagccattgtagctgttgttgtttttgaccagttgtactttaaaccttcatctagaggatcgacaggtttacatagtaacatgatatcactggggaattctgagttggatttatacatttacctctattggtgaggtttatattctcacatgtgttcatgatagttatcattttttcatttacagctgtagcactcctgtaaacattgcttgtaaggctggtgtaggagtgaattccctcagcttttgtttgtctgggaaggcctttattctcctccaggatagttttgctggatatagtatcttttgtccttggccgagactcgtttttttttgttcttttagcatcttgaataaattatccctttctctcctggcatacatcagtaatttaatgttactgatgagaaatctactgatagtctaattaggattcccttacatgtaacttgatgcttttctcttgcagattttagaattctctgtcttcaacttttgacagtttgactataatgtgccacagagagaatctttttgggtttaatctaattgggaatctttgtggttccttcatctggatgtctatatctcccccaatatttgggaagtttttagctattatttcattaaataggttttctgtgcctttcttcaacttttctccatctgccagttctataatgcaaaaatttctttgcttagttttttttaaactttgggttatttcacaaaacctattttcagattttgaaattctttcttctgcttgatctggtctattcttgaagctctcgattgtgtcttttattcactgcattcttcagatttctgtgttttaaatgatagatcttgttttaatttctcattttataactttcctgatttcattgggttgtttgtattctcttgtagcctgctgaatttttttaagatcattatttttaattttgtttcaggcattttataaacacccttttctttggggtctgttactagagactcactgtgttcctttggcagtgtcgtgtgtccttgctttttcatgtttcttgtgacatctgcacatctagtggaatagtcacattttccagttgtatgcagtagctttcacagggagagacttttcctgtagatgggtcctagagtgttggttgggtatggtacattggctttggtttggggtggattcagtaccatggtctctgtgtagtttcgtcagctgtaatcttcacagcaatgtctgatttcctcagtggcctaggctgcaggagtttttgatggtggtatagttttgctagggacaggcatgtcatgctagttgtcaggctggacacttgcaggctcggagggctgacaagctgtcttttgggctccccagggaagagaaagtatgattttccagcttttcttctatgtttatttaaaactttgttgtctggctcacagtgttctttatctaaagtctagccagtggtggtggtcatattgcaatcattattacagcttcagactttctagaccttttccattttagtgaccttcagccttcattcgcttccattcatgaccacagaatagatgtagtcatctctattgaaggcaaacccatcccatctcttcagcttcatctagaaatttgtttcatctgttacactttctttctttggtttttagccttcattctctaccagctctttcacttaagcagagatatgttcaagactctcccattctaacagttccctgccttgatcctacaagcttttctctttagctgctaccttgctttttatttttatttttttctcacttgctctgataatctcctagaaaaattggcttactctgaccatctccattagttcacctcttaattattcttcaaccatctgagacctggctttgttctttctctactgaaactcttcaggcagagattagcagaagtcttctaattgctcaatgaagtggaaattttcagtccttattttctgtatttctccttcatttgactttgacttaactctcttggtttttgtaataccaccagcacctagtttatcagtctctcatgggaacttcattctatctgcctgccaaatggtggagtcccaaggactgtggtctgatctgctgttcctcattacatgctttctggtcagtattgcacactgtggttctcatctaccatcatctacctccagaagtgccatatatttagtaagtttacaagaaaagcaactttccttgctccgtagactaactctgatcttttgttccctatcatggttatggaactcactaattattcagcatcagctgtcagaatgtttaactttgctatttaggtttgtgtaagttatgggacaataactaggataactagaattagcttgtagcttatgtgggttagataatacaattgcatatgtaagtagtgaatattttggcttaataagtgaaggagtatttaggaagctatctggaatgttatctaagtcaggattctgaaggtaactctagcctcactgtcccttactcactatttctaaacacccaccaatcctgcctactttatttacttggtatttctccaatctgccatccttctctgtccgaccaatcactaccctagctcaggccttcaaagtctctcacttgacctactccttcacctcctttgaacctgtgcacaaatgttagcttcttagtaaggctttctctggtcacctgtataaaattcccatctgctacatacttcctggttccctgtattgccttatattcctcagtggcatttatctccttgtatactatataatttctgatctctgtcctttctattaccaccccacttcaagatggcaaggatttgtctgttatattagtgactgtcctaataggaaaaaaaatggcacatttatattagagtaacttgagaagaatttttaaaagtcagtatttataaagctgtagatatagagatagtgaagtactcttgggactagtaatcattgggcaggtgataccatttttaagcccaaaagggcatagtgaaagagcaggtgcctgaacctggattcagagagactatgtagaggaggccactaggcaggagctgtggcctttgcctcagcttggctgattacctcactaatcctcactaatcctaaattacccaagttccttcttttctggcccatttcacagtccaaagccaactttaagccagagggcaaggggagcacttgatgcagtccatgcagtatggcctcccagtgaacagggcaggtggaggatagaaactaaatctagatggaggagagggaagatattcagaatatgttttttctttactgtcagcaccttgaagagtgcctggcatatagataatatttattgaatgaatgaatttgttactggtttactggcctcatgaactttagttttgcctattctattataacttggtgactacattcctatatacttgataccaactcctcattaactacaaaggcagtattcccctctccccctttttaaacatcaaaactcttttttaaaaaaaattcttaaatgaatcgccagtatataacacataaaagtatgggtgccttgattggagtggtgggtaaatgatcctgagtctgtctgtttgggttccctctttgcctagcaggaatgtgactgtcttgtttaaagcccactgaagtagaaaacaggatgagagacacactcttcaacatggcataagatttccatgcttggctcctgcctatctctgcatcctcatttctcagtagtttcctcatattttaccatcctgtaattgaaagaattacaaaactagttctctacacaagctttcttgctgttccagctgctgggaattagcttcctttgtgcttttttttatttgaatgattcatgtttacattcattaaaattaatgaagattcattacagttgttttctctttaggcataattggatctcctatactgagacattgaatgcaactttgattgtttttttcccccattatatgttaagctccttgaggttcttttcaactttgcgttattccaggatttctatcgtaagagttaaggttcatccacttctctgatgtgaggttcatggcaggaaggttccatgttgctcagctgcagagtagaaaatactgagcagggcttaaatagattaggatgctgccattataatataaactgtgtttacgaaagagcatcatcaattcagaaaatatctttttcattgactacagtggtgcctgatgatctttctattacaatcttaaattatggtcattttaattatagaatcatacatgggtttatttatgttaaaataaggtaattatcaagctagctgtgacctatgagaaaaatcctgaagaaatgatgaagggatcaggtgactgtttttgaagtcaagtgtgaaaggtcagaccactctgggtcatgggaccctgccaaggcagagcaggtcaagtgctgtgcccagtggggccaacccccagtatggtgccagggactgggtgtgagaagtcaaaaattaagaatacacctcagaaaggggacatggacagatgccacagacttatttgcgtatttcatgatttagcccttagcttgtgctgatactggatcagatattttcagagttcagtattttcaaaagcatcgctgatcacctgttggcattgttttacatctcaaccaaggaaaaacttttgggacatctgtttaacaaggggtaagcttttatttgaaatgttcgattaaagcagaagagtcaggcatttttttgtgcctccccaaagaaagatttgtttactgtcctgtgtgaataaatataatgtcattatttcccgtaaaggaaaagctgatggggagagtaagtaatgggtaagattaggcaatgttaagctcatatattagtatgtttaagagtgatcaatttagggatctctgtgacagagatgccaaatgctcacagtgctatctcatgttggaaacatgtgtctcctccacttttcctcagtcctctgaaatgacggccctttagggattgacagatactatacagatttctgtgctgatatgtgatttgtctaaaacaaaagtttcacaaaacaattcttaccattgccatttaagagtcactctgatatgctctgtttccattgcaaacaaatgctcattatgatttgtgaaattaacttcacaatttcctaatggataacaccttgaagtatgaaaagcactacaggatcttttatagcttccctcctccagctctctataatctgctcccatctgtggtgtaggaaagatttcagcagtggccgctgaaggccctaagatcttgtctcaacagatagcaaggtgcataacagactttggacaggttgtttaacatgtctgagttactgtttattcactggcaaaatgaagggcttatattatattgtctctaagtactatcagttctgaccacctatgaactttcattttaaagaaaatacctatttctatggcctttaggcattagggaattttgtcaaattaaataaatctcagtaaggtttgatggtcaatggggcccactgtctggtgtgtgtggaggggtgttgtattttacatcaggaacttcagagccctcatgaatttctaattagaggaaccacctgggaaatataagtcaaagccctttgctcgccttactcagctttagggcacagtgactagaggtgggcaatcgctttggtgtaggtattgtcattggaaaggaagaaaccattttctggaggaaaagaattggttgaggctagctttaagcagctatttcatgatggacaaaaggactagctcatccattcttcattcgtttctctgtatcctctatcaaatttctgagtaaagattttatacaatgcttgattagcattcaaatagtatgtttcaaagattttaaaaaaaataaaactaggcctttgaatcataattatggcttataactctatttttcatatacttactatctcaagttacaaatttcatgttatgtttttttcaaaagagtattcctgccacaactcagagctcagctgaattagagcagtgactagaaaatctgagaaggctgagcttcaaaataaggtctggaaagtgtttcttattgttacaagagagtcaaaatgattttcttgagctttaagtttatgtaagtatttacttgacacttagcagtttaaaagataatgtgcaaaaatatgaaaatgagaaaaaacaatttcaaaacaagagttggtgattacgtgagacttagtagagcaaagtatattctaagtattaatctgtctaagctgtttgggaacagatgtacgtgaaatggataccgggtgttctgttgtgtacaccccaagtgagacatctgttggtagactgtgtggtcagaaataatggaagcaggggttaaaccccaatatgacctattactcatgtgaattattgaaggactaattactcagtaaaacatgatgctttgattcatcagtctacacgttaagaaaaaagcctctttagaaaaaaatttagttctgtttctaagctgtcaaatttgaggaaatttttaagatgtatgcaaagactcaaatttccatagtaactgcaaatactatctgcttataaagttttaaaatgttttgacaggtctactaatttatcataaaaatagcctcaaaagttttagctttttgttagggtaggttgggtctcacagaaaacaaatgtagagtgaattttctaaagcagggctgtccagttagacttcctgaaatgatgggagtgcactatatctgaagtgttcaatacagttaccaccagctacatgtggctattgaacagaaacatggctagtgtgactgagaaactgaatttttaattatatttaatttttattaatttgaattcaataactgcatgtagcaagtggcaactgcattgtacaacacagctctgacacatggagagttgaaaatgtttgtttactttcttcccaagttttcattttagtctttgtttctacatagaaaggaagatatagcttttgaaaaatgaacctgaatgtagaactgatatggttatgcaatttgagctgcctatttaaagataaagcaactgagtttagagatttcaaagtggcagagtcctttaacatatttcgtgggctggccacggtagctcatacctgtaatcctagtactttgggaggctgagatgggaggattgcttgagcccaggagttcgaggccagcctgggcaacatagcaagaccccatctcagggaaaaaaatatgtgtatatatatgtatatatatatatatatatatatatatatatatatatatatatgcatacacatatatacatatatacacacatatattaacatattttgtgtgtacaaaaaatatttttattatgtgtagattagttggttactagtaaagttgaagtcttgtctatagaaatcattgtatttttcatggtcattgtgatacattgtttgaactgaaatttggcaaattcaatctgtttcttactacaagaatagtacatagatttgaaatggtaactctcttagtctgtgtactctgaccctgtgaacgtctggagactaatgttattcctaaatatgctatgtccacatggcagcatctgaaggcaaacactttttaaaactgatctacttttgtggacccttcctctctctctttcctgcatcccggatggggccctctggggctggaactggcacagaactattcccctaggagtgggttcattgaagccaagggacacacaaattgagaatcagatagactggaccaaggtcattaaaccagagagggcaatccagatggggttgtccaaagtaggaagttctgaagtgaattgcagaaatccaaacatggcaaagctaaaggaatagagaaccagggcaatggatatagagaacagagcaattgggtatgcaggaagatgctattgcctagactggatgtttttgtaccctctgtaatttgagaaaatggaccgtccttgttgaaatggtcagggatgtagtagataaattcattgcagttgtgtaatctcagcactagaatactgatcataaccatatcacttgttatcccacctagcctgccacttgattgggttattagattacatttcagacattgacaagtctacaagcatcattaaaatcctaaacacagacttctgaccgtattcctacccaagttttagaagcactatgccaatgacgggggtagtatatgctgagcaggtgagttttgattgtgtgtgtctacatgtgtacgtgggtgtggtgagcaacaggaaggaactctcagccatgactctaaatgctcttgtgttggccaaaattggtataagctaggaggagaaacacaaaggagagagaggcatgaagttgaaggacattaaaccatttgcaaacttttggcatgcaaaccagaatatgaggaaacttagtgtaatgggtgactgaattcagaggtagacaggcaatcaggaaggtataggcaccaaaaatagttaccattggtgagcgtttttgtttttgtcattggcatggtgttatgaacttatgttaagcctaagggtaagtctaaaataatgtaccagctggcatcagggaattcccatgtacattcctagattttcattagaaacagtgttctggaaactaccactgctgctacacagcagtgcccagtgcttgactgaaaatagtgaacacttagatttgtttactctgccaggttctgtgctaagtatcttatcttgtttaaccttagcaaagaaactatgtagtctagatagaatttttatccctagggcccagaggtgttaaataacttgcccaaggtcataccagtaatttcagttgctggggttcaaagctaggcagtctgactccagagcctgcactgtccccatttggttatgttgcttccccagttaagcaagcaagagtctatctgacatctgagttggtggtagtaaagcatcatggtctgaaccaaaataataaaaacctttgaaacaacattatctgacttctttcaggcttttaagacagttccatcatcaacagcttattccatttctctggccacttccagtttctgaacaaatgaagaaaatgggagtgataaattggagtttttaacaagtttttttaaatctaattttttttatggaaaccaccaaacatacccaaatgtaggaataattatgtaataagtcctcatgttcaaccctaagaggggtgaagctctatgtgacccattactgagtttaaacagttttcaatttatggccagtcttatttcatctatactctacccacatcccttcttcccctggaatgattgaagtaattcctaggcatcatataatttcatctgtaagcatctcagcatgtatctctaggagataaagattttctaaaaaatcatattactactcttcaaatttaaaataatctttatagttttacatatccagttagtgtccagattttcctgatattttctctattttttaaatatgtcaaccttgaaatgaggtccatattatagctgatggctatgccttttaaattttctcatccacagattcttcttccttttttttcctttcaatttatgttttgaacaaactagtttggcctatagtttctcatgggcaagaataaccttcagactgggatggccatcactctgatacccgtaaaggggatgaggcaggttggggaagggagagcctcagaccatgatcagatgtcacaagatttttgcttacctagggtgaggacttgggaaaaagattgcccattaggagtcctgccttgggcaaaagtggccaaacttcagctgtgctgtcacaggctgtgggctgccttggaaatgtaggacctcaactcctctgaagttgaggtggagcttgagggtacgaatccctggtggccattataatgactacactcattgggatggcatggcaagttcatcctcaaagatggatcctagcatccaccatgaccaatgaggtttttttattgttatgatcactataaactcaaggatttaaacctattaaatgtttttcaattcacagcaatgattatttttactgatcttcaaattgtcacattttggatttttagaccaatgggagccccttcatcttgacttctgagttcttttgacattcactcagctgtctgatagcttccctgctttctggaatggcaagatattccaggttcatcttgaacatttcatgcttgagatatggaatcaagctcatcatcagagggtcctggttccttttactggatagtggtattagagacctcaatttgagaactaagcaacatcattgctaaaacttcccctatgtgtaccttgttacttaggtttttcaaagaacagagctagaaaatatgttgggtttttttgttttgtttttaaagaaaaaatgtatcataggattatgctgatacttccaattcaagtgcaggcctaagcttttcacattgtctcttttctcctacccttaaagtcctgattcctaactataacaacatcattactcatttgctttatcctgcattatgtagacacaatagagtaacaacaccaatgctgccaatcaaaagtataattactgaaacccacttaagatagtcctgcaatttttttttttgttcatagagtgtacactactagggaggtgtagtcaaattactatgttttaaagacacttggaataattcatatctgtgaagttatacccccaacttatttgttttttgtattattgtttcattttgcttttgatgtttaggcatttcttttttaaaaatcaattttataattacgtgaaatacttatatggttccaaaatcaaatctactaaacaaactatattctaggaagtatagcttttatgtttcccttctatgcttttccttccttcctgtaggtaggaaagcttatttgttcctcaaagctctgggttgttcttttattttatataaataaacatgtgcatatattcttttcattacccccacagtacccaccgtcttaaacacatgtacaatatatgtgtttttctaccttgatttctttcttacttagcaatatgcccagaagttcactctgtagcgctttacatcagcatcaaaatccattatgtactatcgtttattgacctctctgttggagaaatttggattgtttctagtcatttttgttatcgcaaatagtggtttaataaaaaactttactttccgttttttgtttttcaatgtgcttttaggatagatgcctagaagtgagattgttgagtcaaagaataaatgtgttaataattttgctcaatattaccaaattctttcaaaagggttgtgcaattttgctttttaaaatcattattgtataagggcatgtatttcctgaaaatttctccagaagagtttattgccaaactttaaaaaaacagcctgatacataataaatgatatctcagcatagtttaaatttgcatttttcttgttaaatcattcatgtttttactgtagtcctcctaacatttagggagcaccaattatggggtctctagaaggttccaggattctgtaatcaatttgacatgatttctgtcttcagatattcacaatcttcaggaagatatattgacaaaagaataactacatgatctattttgtgtgcaacttagtacttacagagcattataaatgcacatggaaaaataggtaaaggagaaaatcattctctgttgggcgggctgagggggaagtcaggaaaagctacagagaggttcgagggtaaactttaatgtgggccttgaagtatgatttggagttagcaagacagacaaaggagcaaggaaaccattctagaaaaagaaaattttgaaaaatctccagaaaaggatgctttggcctatttggaaaataacattgtcttatttatgggggagatgacagtgctttgtttttagtcagtagtttatacaggactttgaatagcatgcaaggaagttggcgtctcaacctgaaaattgaggaaggtgtgacaaaggctgggcattaggtgagatcaagtatttctgtttttttttttggtaaattaggtagcaggatagattataaatgggctccacactgaggagcccagtgtgatggctgatccagcagatcagggggcagtggctgcaaagctgggagaatggcaaggtaagcctggatgcaagggatattgtcaaagacaaaatttgggggatgtgaggcttaaaagggaaataaataatggtgatggtgagatttctagcttgggcagtgggatagatagtagacgctgcgcaaattcgtttttaaatcagcagaatgagaagcatcttatttgaaatatattctaccaaatcttagcatcaaatgtgctagtgactagcaaaatatgtaaacagaagggaagtagcttgaaaagtacacaaactggagaaattgctcctgaaggactgtaagttgaacccttttaagcctaagatctgtatttcctatgagccctaggctctttccttgtgtatcctgtttcttattagagtagaggctacttaaaaataatcatagtttaaagcgctctattttcagaaaacattattcattagatgttagtaaataatgtaatctttatacattcataatatttctgcattattggagtgtaaaaagtcagtgaaatagtcatttgtaaagatgtcagtttttatctgtggaaaatagctgttcataccattttaagcttaaaagttcttcatttacttcttaaaatatccatgttggtattattttgtctaatacaagtaattaatatttaccccaaattaagcttttaagtttactaaatgttacaaacataattcaaagcactgtttagtgtccatctgtgcaggaaaaataagatcaatacaattgagcagctgttagcatgtattggtttccttatattttaagtatgttttcatgttttgaaggtgtaaagggatgacagtatgttttgttgtggttttcatcatacagataaaaacttattacagttgaaatcttggtgaacataatacattttaaaatttccattcctcacccatttatctagatatttagacacagtaaaataaataacatggatacatttttgtcatgtgatttatgttttttaaaaagtagaaataaatttctctaaaagttatttttattttttaaatttagcatttttcatatttgaggaaaaaacaatatgtcttggtaccctagcttctgaactaataacacacctgtcattttacaggttattttaatgtttttcattgggatcaaacctactctggaaatatctcatgggtgagctttatttttatgaaatgttcttggcacttgaagacctttgtaggtacatgccagactcatcttacatccagttcttctgcatggaaaatatgtgcattgaaattctaagtgccttttcaaatttgaccttcttagagaataatatgagtcccaacaattaggaaaactatggaatgccttttggcctttacttttcaaagattttcagtcagtaatgtttaattagcattcattgtgtacattgtccttttttgtgtgatatggctagttccaaaggaatattctagaagatctcagccttctgctattgaaggtgataatacactactaagttatgtgttgctttacattaaaataatgttgcagcagttacttattgcttaactagcgggtataggacatcaggttgaaataactgattttgaagtgaagagttcttgtttatatcttaaactaaccaagtatgttcattaactttgagaataacaatgatctttttcattattcttgagtagactggataaatcagaaaacccatgttagaggtccctgtaaaaacttcagtcttatttggtaagtccctttataagagtttcaataaaatcaggtaaatttaaactctgaaaattctacgtactgtctatcatgttcaatttactgttaaccagtactatgcactggaaaaaatttttttcaccttaatgagaccactggtcattactgctgctactgatgctcttttgtctgcacatactgttgcaacataatgtgttgtgcatttgatacggatattatcatattgccataaggagctgctattattttagacaccaactgattccatgatagtgtcagatttctttaacatatgcttatgtttttgtacaaatgaccccaagaaacatctgctagttttgtggtggtatctactgtttcttttttagaatttgacctgtcagtcactttttaacgtgaatctacaatatttgagttgtattcctttctcgtttttatgctattgatattaacaaaattgagtcagttttatggcataattcagagagaaaccgaagctgtctatggatgttattttaaaaatacctttttcatgatgattgtgcctttaaatttttgtcattgattgacactttaaaattgaaaagtgcccttttaatggatcctttaggttccaaaatcttaagttgaaaatttctgtctattggtcctgaaagtactctctgaatttgataagtatgtagtagttgtggtgtatccttggtcagtttatatcctgtgctaattgctaatcttacttagtttctttgatgcgtgtgtgaagacaggcaaagaaaaaggaagtggaatttctacaaaactgtgaaatctttactttatggagactagagaaatttctaagtaaaagaagacactcattctattgtagttaggatcccttcttttacttgcttttcatgatcttgactgaaaagcaacaattgagatttccattgcccgacgctttctcttctgcttttctttttgtttctcttgcatttttaaagacagctatttattcaaaaacaatatgaacttttatttattggacttaaacctggaacatcaacaaaacaaagaacaaacaaaactacctttccaaatttattttattagaggatgctatcaatacaattttgtattatgttcacacttgataccaaacctaaacccaagaaagtgtgtcctgtgttacagcctatccctctgtttaagataataactagaacaatttacttttattttctactcatctgctttctgtgtatcagctgttgtcctccctcagcctcgaagcatgtcatcatttccatctccgtgctcattcagtcatccttgctgctcttagtcccctttttgtcccttgggtgacttatgtcattaggacaaccttctgtccccacttggctgaaactgagctgaggcccttgccagttgcattaggtgtggcacctttcatggctcagtttgggcctctgtgatatctgtgtgccttctactccaaactccattctgccagaggtggcagggtgactggaagctttagtttcagtgacaaaacccaagcgtggctatgctgagtgtctaagtagctttcatttaggcctgaaataggagagtcaggcgcctctgtgtcccctgagaaagagagatttccctcagctctctgggcccagcactcaaccatttaagtcagctggttagtataatttccctaaattgtggtttagtttccctatgagtaggactggagtaggaccaagtaaggaaagtccctagtgacctttctgcctcctgaggagcaggccatttactttgagttgtagcttcccatctgtctgtccccactaccctatccaaggccctggaggagccacaggatgagggaggagattcatggaaaagcgccttcaggtactgggtatgtctggagtaacatttaaagtttaaaagactctttaacaattttcctctgatacttactactgcctatacttgtttggttttagtacagtaagttttgcctatcgtgggggtgaagaaaatagaaatattcccattaactttgtatggtgcttggtatgacaccctgaacaggtgcacccgtaattgtttacttgatgttctttttaataagtcaattatatcatcggaaattgaagaatagcaaagttaatttgtttaatcattctatgggaactcttgcatgctcgttcactagaggaacattgcgtttctcccttaaaggacaaggctttgttttgtttttaataagacacactctttataattaaaacaaaatcccagtgttaagggatttctgttttaaataattggatttctttcctttgttcctctaatccctctatatgagaaaaaaatctaatggtgtcttaggataaatatttttagattaaaaagttctcttaaccactgaaatttaataatacttctcaaagtttatggatgatatagaatgtaatgtaaggttgagaattttagatttggcaaaggcaaagatacaaaaactagtgaaaaacaacaaactggaaacacttttaaaatactgatgtatttatctttgcaataaattattcagaaatataaataaactcactatttacatagttttatttaaatttgtcctcaaaatactaaatttagtactatatattttcttctttcagataaatgctttcctgaaaatggtattttaatatctacagatggtttagtttaacaatggttggggtaaaaatgacatagggaaaagcaaaatgtgacagcccagcttggttacctttagagaaactcagaataaactctattcccatttccttctctttcccctttccatactcgagagcccttttctgagactcttaagtcatgtttgggccttggagaggataaatagcagggtgggtggtaaaaggggagagtgctttgcttgaggcaaagttttcctccatatgggaccttcctcaagccctcccttcaaaccctttaaatgagagcatgagctcctaggacagaggtcatgtggaaagcagcattagcatgaaggggggtgctgtggaggggtgtaaggtgcaaaaagcagcattagcatgggggaaggtggggtggaggggtgtaaagggaatgagatgtgaagtggttaaagggccatttttctagttggcctctgggctttgatgaaccttttccagtgtgcctgtttctccacttagccctgggctaatcttgactcttaactttccaggtgtgtatctatgctgatttctcctgggtttggaagctctgagaagctctggttctagttcaatcacaagacttttaaagaaccagaaaaataaaacaattttttaaaaagtaatgaagaaaagacttttaaagaaccagtgaaaacctgggagtaaaaatatagaagacttgagaaatttcatctttacctttcaagtgggcagcatgagaaattcttgtaaatggtgctttcaaatcttacacaaggttctcagttacctttatttgtactccctagactgtattgcatcccttgctatgttgactaattcccacctaaaataattcaatggcctcccaatataatctggcattctaattaataagctaagaaattatttggtttttcactcattggcgttaaatattcttcagtgcccacatttggaaatattggaacacagaaatgaaaaaagatacaatcagtttctctgcttgccatgttttccttgatatggcaatacgacaacaggtcaccctttgaagaaaattcagagatgctaaagtagaaattaaaactgaagataagtcaaggcaggatagtataggagtctgctacagctgccatagcaaaatactacagcctgggaggcttgaacagaaatttatcttctcacagttcttgaggctagaagtccaaaatcaaggtgccattggggttggtttctgaagagggttctcttcctggctttcaggtggccaccttcatacagcatcctcacgtggccttttctttttgcctgcatggatagagatctctggtgtcttccttgtaagaacaccagtcctattggattaggaccctatgctatgacctcatttaacctaattaccctatttaaggccctgtctctaaatacagtcacactgggggttagggcttaaacatattttaggggaacacaagtcagtccataacacgtgatttgctatagttttcctttacctaaatcttttccaaccttgagagtggattttggccaggtgtggtggctcacacctgtaatcccagcactttgggaggccagggaaggtagattgcttaagcccagaagttcaagatcagcctgggaaacatggcaaaaccccgactctgggggggcagggggagtgggggaattagctgggcttggtggcgttcacctctagtcccacctactcaagagggtgaggctgaggctggaggattgctacagcccaggaggcagaggtcacagtgagcagagatcacaccacttcacttcagccctgggttacagagtgagaacttgtctcaaagaaaaaaaaaagtgggttttattcttccccttaaattcctattaatagtgaggtgaggcttcttgtgttttttttttttttttccaagacaatggttaatgtgtgattacttaaaaatgatatataacactaagaaataaagaattgttaagtgagaaggaacatattaaaatggcttggaaagatgggtaattttttacattttaagtaggttttctcaactctaactctgtggaacttggtcaatctaatcagtctaaatatagcacaaataataatagttatatggacaggagaaatagtagccctcaaagatagtgaaatacatctgaatatcactaacaatgtcatgaatttgcttgttctaaagttttctgaaagtatgaattcataactgagtttttttttttttgcctatgactactaatgtttgaggagagagtagtgtcagaaccacccccccatttattacatgtttatttcatattttggtactgaaatcagtgtttattttgtgtcttcctgataaatcttgccaataagtaattaccttccatactgaaaagttcttaggattaccaggttgctgggggcaaccttaaaaggccatgcagaacattgacttaggtggctattaccctgctttattcaggtctgagcatttactttcctactacaatcagaatactgacctacatttaaaagtgcaacactgccctgttatctaaatccactgtgttcctgagaggaaataccagaaaagagggcaccaatattatttttctgctgttcttgatcataagtgattacctttttttttggttaggcattctgcttctgaaagataactgaggttgaagttaatagaactaagattcttatataaaatcataggaaagataattttcaggattattgaatcatattgaaaaatgatataattgtgttaaaagataaggactaaaatgagttaattcaatttggaaatagttaaattagaatttgcttctgtttttgatgaatactgctttttgaaaaatcttctgagtatttaagcttttactactctagtcattctctctaaagtagacatagaagcgtgttcttatcttgatttggtaaggctctgaaaatgcaaagcaacagatgttgtacccagcataattatatgtatcctggaaacacatctttattgagtgggatttgttcttggggaaacaaaaatttggcaaacaaaggacattaacttgctgatctcagcagtaattacttgggttagattataataatcttgtgtaggtggtaactgcatgcatatattacaaaatctaattctaaaatacgtacattaaaaggaaaatgaacttgcgcaaactttagatcatgtatccccttgaagagcagaaaagatctcaatttcattatttgaaagttgtttgaacagctttttggaagaggtttccaggattccaaatcctaatatgtgtattgatactgaggctttggactaatctttgggggttactgccttttttatgcccactgaaaatagagcatttcaaacaaatgaactgatctctgatctttaagcatgccagtaactctttggaacaaatccatagttatttttaccaatgactgtattaaaacagtactttctgtattatctcttccattccaaggccattttaaaacaccctctttctcttctcccaataggtaaagtacgacagagctccttaggactgggttatggagaattatctggaggtcaatttgagaaccactgtgcaaaccatttcttaaataagtagctacaaggttgtccttacaaaaatttctgaagttgatggtgttgcgttttggagtctgaagcttaaataagagtttgtcagtggtcatggtctaaatagctgattactaccaaggtcatctaatttttttttaacacaaaaaaatgttctgagcacaaatgaaaccttcaggacaagacatttatgttttgagaatgttcttaaatgattcctgtcgtgtatcttattttacatatcttaatgatcagcatgtattttttgttgttgatgatgattttataaatgtgctatcacctagtttctaattcctaacagctccttcatcagtagaatattgctgtagcacagttttgccatctgttaagaaaagatggtgactaataagagtggcacatttcagggctggtgtgctatcgcaacatctagtgttttagtactgaggacagtgatgtatgcagtgttccttacagccatggggtgtgggaatgttttcctcttcggcaaagtctgtgtatttctatagctgaactctcaggatccagaggaaaaccacaagatgatgaaaccagatgattgtcatcaaatttctattccccactacatgattattagttttcgtcaaaagaaatactcatcctatcctgggttggaattggtaaagaattttgcattgtgactaggacacctaaaagtttttaggatgagtacaaatggaatttgatagatttccccaaaatgtttgggaaaagatttattcctccctaggaacagcaagagtagcagcatcacatgaggcaactcctggtaattttttcttcttgctcttatttcaatgatatcttttcattcttttctgtatctctcaatttctatgtttctcctcttaatgtatcctgtaaatttcttagtagaacctttttactaatgagggtttcctagtttgctttaggaggcactcaggatgcccccttttgtaaggcagtaaattgaaaataagaacttggtgaaggtccacgtgacggttagtttccattctccattgtaccaaactgctacagggaaagaaccatatttaatcaacctcaaatcctcaatatttaggtcagaaaacacttggcatagaagagacactcaaattttgcagctaaatagattattgatagaaaatatgtttcttgcctctacaagcaatatgaaaccaatacaatctctaaatatcttcagactactaggggcaaatactgtattataagaataattcttcagaaaggaaaatccagctactctcatatcacctctctatgttgaaagctagggaagataaactggcttccagccagtgagagtccatgtggacctagtgctggctggagatccctaatccaaaggcaagagccagatactggttgtctgctgaaaatcagaagatgacctctctggtagtaaggccagtgactcatccctgcatcttttatcctcttctgatttgtataaggatctctcctttttccccagtacccactctcaagaattgctttcctttttaacatgatcataccaaaatgtatctaacagtaccttgatttcctttctgaggaatttagggagcatatttactttgtcagactcattagaggtttggcttcttggtcgggttcttaaatggacaacttgtttgggtgatttggcagagaataggagaagccagtcccctctgatagagcaaacctggggagctgtggttgacccacctgctaactgtcctgtacaattaggcatgtggcatcagtgggtgactgaccagagccaccatctcaatggcggctgttctttccttcctgtgccttctcagatctcttttttgttcttgttactccactatattggtttttcttgagtttttttcaagcaaatatcattattcacttctactgcagttcctctgttgttcgctttttctcttagtcttcattgttttccattttgaacattcagagatccatcaaaaaaagtaaaataacaggaagggagaggtaaacaccagtcaaatgaagtattataatagtgtattactatactctttaaagtaattgaagggtggttttttggggtcagaatatctgttagaatttggaatttgccactcttgagactggggcaagctatttaaactctaagcttatctgtccttcctcacaatctgtaaaatgggatcataataatggcacccagtttatggtgtagtgagcattcactgacacaattaatctaaacttatttgcactacatagaacagaatttttgtctattaaacaatatagcgttttaggcatgaaagaaactttagattaaattaaatatcatttttcttaccacagggtaagtttctgttttgtttgcccctgtttctctaactcctagaatagtttccagcacatagagattaaacaaatattcgttgaatgaatgaatgcatctattctaatcctcttgttttaggaatgacccgtcaggctcaaaagtgaaagcatttccctcaagattggtgacagagttggggactaaatctaaggctttctcttcctacaccagtgtcctttctgagaacacgatgccattttctcaatatttgtttatttatatggtaaattggtaggaagctgtgtggtactataagaggataaactttgataatgaggtatacttgctatcaaattctaacattctcatttaaaacatggcataccatttgtcttctacattttcatatgtaaagtgaggtgatttctaccttatagaactattgtgaggattaactgaactaatctttgtagagcacctggtcccatttattttttttttttgctcaccccaccccccaactttctagctagataacttatacattcactctgtttttcattccttcttgaatctcctgtggccagacttgacccctgtcactctacagcttactcgtcaaggtcagtcctcatctgacttgacctactaagagtctgacaagtagtcacactatgctccttgatacagctttcttcacctaccttcttggatgtcattcttttggttctcctcctaccccattgggctgctttttcccagtctccattcttgggtattctcattttcccatgtctgtcctctgacttcttattgtctctgtttctgttttctctggttggaccttctctagtttctggcttcaaatactatctaaatgctcatgtctttcaaatttgtaactctagtctagacctctcctctgaattccagttttataaatcttctacttaaatattagaggtctaataaacttctcaaacttatgttctacaacaaactccacattttctcctgcagcctctaaatatgtacctcctatagattttcccatttcagtaagtgggaacttcattattctgattgtccaaaccaaaaacacttggagacttgctacattccaccctttgtctttcattctacatccaacctatcaacaaatcctgttgcctcttccttggaaatatatccacgcttgagcagcatcattgtcaccacttggtgttatacactctcatttctcacctggagtattgtatttctcatctggagtagtgtctgtccaacgatgtcccccatcagtctgttctccatgtagcaatttcgtttttgtttgttttaagattgggtcttactttcgccttggctggaatgcactggtgatcatagctcgctgtagcctttaattcctgggctcaagtgatcctcctgccttagcttctccagtagctaggactacaggcacacaaccacacttgactaatttttttttttttttaacttttactagagatggggtctccctttgctgcccagtctagtcttgaactcctggcctgaagtaatccttctgtgccagcctcccaaagtgttgggattataggcatgagccaccatgtctggcccagatgttaattttaaagtgtacattagagcacatcgttcttctgcatgttcagcataaaatccaatgtccttaatgtagtctatattaccctacatgggctacttgtgcctgatccctctactcttatgtcttatccctctcctgctttctcactagcaccagccacatcttaccgttccttgaacacaccaagtatgcatttgccacaggaccttgatgcttactgttccctttgcccagaaacccttggaaccagctatgtgttaaaattcagatatttactgattttagagagctaaaatggggtatatataatatattacataacactcacagctggtttgtggtagcatttcataattaaataatatttctgaatgaaacattaagaatgcccatgctaagagggatgagtaaagactcaactctcattgtcagttcagctgcagaatgaggtcagctcaagatttgctgccaaatgacttaagaaaaaaatgtttttggagctttggggatttcagaattgcagatgagagattctagacccgtacctacacagcatgctcccttattttgttccaatctttgttcaacgattatttattgggtagtcaaggaagatctctgtctaaaaggcttctctgtgtggaacaagactggcatgtggaaggtttccaattaacgatattgaaagagtgaagctcaaatcatttttcactcaaatacatactatttagaagacagtggccagtttaagaataatcattattggaaacaaagtactatttgattagggatagttaacacaaacacttattagtattagggatatgtgaaatacttaatggatgagtcatgtgctgacataaaacccattatccattttagttcctggtagcctaactggttgaactctgttttattgatctattattgatttggcctgtaacttcaagttacattttaatgtaatttcatccttttctgatcaccttgtgtcttcaagcatttttaagcagttgatagatagttgaaagatattatcactatttcaatctaaaagatattatcactattttaatctacttaaaatttttactacattcattttaagtatgacttatggaacgaatcgaaaatacaagatagtgaaaaacttgtgaggatcacctgaaattttagcattcactttccttacatagaggaacttagtctctctaaagaattatgagtaataaagtatcataatgatatttgtcttagttttggttaagtgtactccacaggagaaagttaggcatgagcaggaattattgtagtcccacattctcaaacagttctccagtaagaaagattttatgtgtttccagaaatcattttcctcctcttcagagctttgggaccataattgtatttaaattgctaatctgttttaaggaatcataataaattgtttaacatttatattcaatcaactttgtaatttgtataaatttttcagggtgacatttgaacaatttttaagaaaatgggaaatacagaagtattcttagttttaatatattttaaaaagatgacatgtgatctactgactgaaatccttcaatcatttttgtttttctccccaagattagatagaatggatgtgattttatttttaatttgcattatggagagtacttttggggggttttatgaaaaagacttcatttattttgttagtggtacttcagttgcataagaaaatgttcttttaaatatagtggtcatttgtgtgcagccttcaagttagcaaacatgcctttgagtagtcactatttttgaaggtctttatatctgattgcaatggcttatattcaatagtcctcctactaaatgaaataaaaatggatgcctcttctgccacagaggcacaggtggacatgttggtagcaagccccatgcggtgtgacacatggcacagcccaacatgggggcaaagagcatgcggcttgagctaggagtcactttatggctactttagtgtagatttgtgtttttctgtggaacagccattattgaagacatttatatagtatgatgtttgtttttcattaaatgctgattgtgatttcttaaaaatagttaagacttgattagcagaacctatttagaagccagagttcccctgcttcacctcttgctatctatataaatgatatttttgactctgtcctttataatgttggcaccctgtgcatattagatgtaatcagggctgaaaggaaacttgaatccatctggaagcaataaacttttctaaaagactgcacagtgttatttaatcctgtgacttcttactgtgagtgaaattaaggtttgatgcagttgtgtcacatcgtattgatatcaaatttatctttctaaaaaaaaactgacagtattacagcacagaggagaagatggcttgctgtaatcctgtaagctattttacattgattacatgctacataatgtacctaagtatataaaatacttgatctagaatgtttatgttttctccaaaattttctcatcaggtaatactttctcaacttcacctttagttttggcttcttatcatagtactaactatgcggtagtaattgtgttatgatgaaaggcatggagaagaaattataattttaaaactattataaagtggagacacacttgtataattaccatctatgtagactgccaaggtataaacatttagcttattttagtatcagactctttgaatcaatttaaggctttttcaataaaattggcttcctctaatttctactccaaaatggttaaaattttgttttacttcaaatacgttgtagggtatcatatttcatgtgactaggagcctaaactatatcagctgactggcataatttgtgaattatatgtgtgtttattaaaatttaaagtttttattaagacttacaattttattaagacttaatttttttccttacattttgagtaagtccaactgaaaataacttagagacttaggaaatttgactacattttataagtaatttccttgtaatttttctttcttgtggaaacaattcttactgatttacttaactcttttttcaatggcaaaaatgaaaaccaaatatatttgtcaactatattcttttaattgtggaaatgaaaggttcatatcccccatttgcctagcatattaaaaataaacatgacctttgtcttgaatgttgttaacttggattttaaaaatcaaaccaattataagctatattaaaattgcttatcaccttccctttgtcttcagtaagtctgggcctaaaaatactcatcatatgaataaataaagttttacaaatactttttagaacatcttgaattatatgtgtgtttgaagcttacttttggatgttcggtcaacaaggcttctgacagtttctttttatcttccctctattccctgccactgtgcaccccaaagtgatccctgaccacagtggtcccattgctggcatcaggaaggtagactgaggagttcaggtatcctagaggctgttaggtgaatctcttctacctctttcctggtcctaggaccactggacacttcaagtaaaaataacaattactttaatctctcaggtaaagtttcttctcccttccagcaacacagatctgcctgtgccgagttcaaatactctgaactttcaacagttgttctgaatacttttttgtcatcttatgatcaaatattgagagcattgaggggataactgaatgggcatggtataaaagtcagacttttagtgtttctaagtagcagaaccctttggacaatttagagggctgtgcgatatcctcaccgtgactgctgggaagtaatgggatctgacctgcagaggtactaccttggctgacaataatgacaaaagtgagagcaaagtacatatgactatccttgaggtcctcaggaaaaaaagagtattagtgagttgaactgtatgtaagggtctttaccaataaggaagcccatgcccagacataatccttacaccctggcaatagaaaccatcattgtggtttacatctcatcctgttcctacagtccagcaagttcaggccacaaaaggtttaagcactttttcctttgttctcatagcaacagttgcccatggaggttcagttacactaatattaacattttaatatacacaaagaagtgcctcgaatgtagtaggtattcaaacttgttaaatgaaagaagtaaactttcagacttaccttgaactactacagttttattctttctctaacctctcccactactaccatcttaaaaccaccatttaattagtattttataacaagttattaaaggctttcaaagacctttgaaccttcaccctctggtaagttaataacttctgatatgcgattaaatgtcaactgagtagtagtgggccctaagagctcagagggactgagaaatgaaggttattgtttagaagagtggctcaatgtgcttcgacagttggttaatatttgaaaagactagagtcaagaaagccttccatgtgctaggaaatgaaggagcaaaggtccagaggtggaaatgtatacagtgtgattaagggattttctgattgatagtaaatacagtcaataaaaaacttttattggaagcctagcctgtgtttgaagcattaagctaggtgctgggatacagagattagagatgaagataatgatgaagatattgttgaagtgaattgctgagaagctggagaaagggccaattaccataatctgaggctcaggaggaattggtgcaaagatcatctggtatgatatatatgaactgtatatacaaactgatctgtgtagctgaactgataatgccaaaaaaaaaaagactaggtttttgattaagatgaatccattaaggtcatgttttctgttggtgccattcttggagacctcccccaaccctatacatttataaatgtttttcctgagggactgagatggaagtggacatataaaaggaaaggtctgggcaaatacataagtaggtagtaaaatcaaggaacaaatgatctcaacaaaattgcccttcttgaaatgaatgaaaatgatgaaagccaatcacattgcatgatgaacttggggtatagaatatgaaatatttaaaattgctttatttcatgatgtttcagatgtagtaggaacttgttgcatagatggtgtaaaaacaatctagtaataaaatcttaggtatttaatacaaggtgaagaaagatgcaatgcataaatcatgccattttaggcttaattttcataaggctatgcctgtctttataagactatataccaggagttctcaagctttttggtcttggaacccttttatactcttaaatcgttgaaaaccacaaagaccatttatttaagttataaccattgatatttgttgtattagaaattaaatagacattaaaaatatttactatttaaaaataaccaaaaagatgggcatggtggcccacacctgtaatctcaacactatgcgaggccgaggcgggtggatcacttgaggtcaggagttcgagaccagccaacatggtgaaaccctgtctctactaaaatacaaaaattagccaggtgtggtggtgggcgcctgtaatcccagctactcaggaggctgaggcacgagaatcacttgaacccagggagatggaggttgccgtgagccgagattgcgccactggactctagcctgggcaacagagtgagactctgtctcaaaaaaataaaaaaaataaaaataaaaataacagtaagttcattgcatattaacataaataacatatttgtattaaaaataactattttccaaaacaatcaaaaaagcagtaccactcttctattttaaattttttcaaatctcccttttctaaaaaaaaaaaaaaaatattgtgtaagtttaaggggtacaagtgcaattttgttgcacggatatattgcttagtggtgaagtctgagaatttagtgtatcttcacccaaataacatacgttgcacccattaaataatttttcaacacccacccccttctcactctcttgagtctcctttgtctatcattccacactctgttcctatgtacacattatttagtacccacttaaagtgagaacatgtggtatttgactttctgagttttttcaactctggcttaatagaagacagctgaaatctcagaatgcttcttcatccagtctgttgtgaatatgttgctttgattcaagtatctaaggaaaatacagttttacacagatgtgcagctgaaaaggaaacatcttttaatatgttcagataattgtggatattgtcctttgatactatagcaaaacttatcaagtgctaatttcttaaaggctggttataatttgaaatctgaaaacatatctatttaattgtagtttgctatttgaaaatttattggtctgtcttgtactttgaatggatattttgcccacgtatgattttataacatcctgtattggccttttggaaaatttggtttactattatacagtttctaaatgttgataatttttattataatatattttaaaaagtctaatgtcactgccagtctcatcagaaaattctttgagattagaaagctgttaagatcatcatcacacttacaagttttacaaaattttaattttactcaaaactttatattttatcattgacaaagctctcagttgctttgcttagtgactgactcactttgttcattttccagaaagtgtttaccaaatgctgctgcctcaataccagagtctgtattgtcagttgatctttcaagtaaaaagtggtgttctatgaaaaacagctagttcagctgcgactgaaatgatataagtgtttctcctggagcaaaccaccacttcgatttgtagcagaaatgctgtatgtatactttccattgttattactcataacatttttaaaaatatactcaagggtggagatttttttaaaaataagtgttattgcttcatcaagaacagttaaatgaaactggattttttaaactgagtttgagttaatgaagaatgcagcaattattagtaaaatttggtgctccaccttgattcatactgacactccaggagttttacccactatttcttttgtacctttagtgcaaatgttaatatggtaggaatggtaaatgacatctttagtattattataaaaatcgtttttaccctgtatactctttgagactacacattgagaattgctgatgaaggtgttttaatttatcataagcactgaaaagatttacttaattcaccaatttctcctgaatatttgtttatataaaacaagactatgtgtatacacctacctttttattaatggtagagatctaggaaaattaatttctaagaactagccaggatatttggaatgtgaataaatcatatatccagaaaaaagctttagaagattgtctatgattgaaagtcaaacagctctcatttctattatactgttctttttcaaagaatttaccaattttatgtggtatttatgattaaacatacaccatgtaatttaacatttttaatgtcacttttacatcataggtattaaagattagcatttttattgtctgtattttaaagctcaaagaataacatttaggctgggtgcggtggctcacacctgtaatcccaacactttgggaggccgaggcaggcggatcacgaggtcaggagattgagaccgtcctggctaacacagtgaaacaccgtctctactaaaaatacaaaaattagccgggcatggtggcgagcgcctgtggtcctagctacttgggaggctgaagcaagagaatggtgtgaacctgggaggcggagcttgcagtgagccaagatcgcaccactgcacttcagcctgggtgacagagtgagactctgtcttaaaaaaaaaaaaaaaaaaaaaaaaatttagatttttgactgtttcattgattcatcttagacttcacatgaaaatatctgtatatcctcaaatgcttacattcttaagaagtatctcagccatttacacatgatagaaacaactaaatggaaaaaaattgcagttggaaattcactattttttatttgatccgataacaatgtgacatttgcgattggactgtaattttctgtctttctctctgaaaataagttcaaaaatttccctctaattcttttactagataagaagcctacttcgttgtaactcttgatatatgtatgtatttaggaacttaagcttttctgctaataaatgttatgtcataattcttgaggatagtattatattgtgatgggttttcagtaaactacaggagcagccctatttgtttaaaccctagtttaacctgattattaacaattaaattgtgttttcttctaacaattaaagtgtgtttaaatttattggtcccttgcttcacagatttatctcagtatgtggtgtattcaaacagaattttgtatttttaattaggggattagataaccaattctgaagagccaaaaaaattgttagacatcacattgcttaaccatctaatataccataagtgtgtgtatacactatgttgtgggagccatctatcaggcaggcctgtttttcaggcagtattttaaaaagtggacatgtgcagaaactgtgagcacaattagcgccaagcagataaatccagctctaatcctgtttacggtctacatcagacagatgtgccaagattgatttagacaagcccgaggcttacagtaatatttttaaaagtgccattcgctgttctatttttgttaaacctttgctaaatattcttaagtcttgttggttttgctcttcttattaaccaccgtaagtaacctactttaagcaggtcccgctttgctctcatggtgacaaggtaacctgccaggagaggttatctttattccctgtaattaagttgacttttccccccaaaaaaatacaacaataggaagtgggtgctgaattaaataaatagcatgatacccagtagatgtatacttaagttccttgcaagaacagatggtccccagtatctctgtaagtaatgtgagaggacagttaatgttctgaaacaactagctataaccagtatgatactaatgaaccagtagatttcaaataataaaccacatgccgccaagcaaaattatatgtcattcataaggatttaattatcataacttgcaaaaaagtgtcaatagatgatttctatatttttatctactgatatcaaatatcaatttatgaatagagtttcacttcatattttttaccaataaaggtatgttttaacattaaggtagaattaaagttatatttaaaatacatgccccaaagtatgtggtgatttttttttaactcctcttttactatactgtctgtatgtattgggctgtatatggaaatgtagcttttacatacaattaggaaaacaattgcttttatttctagcagaaacttgtactataacagaagtggctagcatgggaatcagagtagttatcttgtagatgacaactgaagcagacataaaagatgtaatattttttcagcactcaaaaatttataagtaaaattttataaacaaaaagcagtatttttgtgattcatatggaaaataaaatgagtctgagtcattcttaaggtgataccgtaaaggtgtatagataagaagtccatttttaaatatacccaagacaacagttttttctctcagtatggtttgttttcccttttttctctttaattatgtttcccataagtatttgtatattctaagaatgtccaaaaaataaatgttttgcagtgggggttgaaaagaaagaaagacctttttagatttcagctgatcttatcagatgatctctagaaccttgaaccttcaaccttcactgaagttagctggagggcttttcacctggaaacctgagaaacctcagaagccttctgctttagctctctctcaagtctaggaagccagtggcctgcgaccccacagagccagctggtccactcctcatataagaacttcggtaacaatacaaagacatagcaaagcaccatctaatctgataactcattaaacaatatttagatggctcaagactttaaataaaaacattttaagcttgtttatagaatactaacaagttttattcccaaagactatattcagagtgagaaaacaattttccttaaaactaatattatatacatgttcatatatgttaggaactagttatatgcaaaatcaagtgactcttgtgattagaactggtcacatttattcatgtagcataaatggttaatattgccaaaatgagtaatagatcagattttctatgtgagatattgacacctgagagatttacagtgtttcactgttgtgaaaaatggagtgctgaagaacatttgtctattgttatacatttgtaaaagaattcacaaattactaatttcaaataagaactaaatatttcttctaagcctatagtttttctttttaatttcttctaagcctacagtttttctttttaatttcttcttgtaacattggcaaaaagaccattcgtgtgaaaacctcagattttgatctgtacacaaatgcaggagtagagattggaagcttgagctggaaaagcaggaaatactgctcagagccttacaaggattttcagaattttcactgttgggtcctcctggttgctgcagtctaacctcgcatctccttgaaggcagccccagtttctgatgaaatactcttcagttaatttatacatatgctgtcttgctgttttcctaaggactgcaggcagaactgtggttcacctactgttttaaatttggctagatttaaaaacagatgatctcacttatatgtggaatccaaaaaagtcaaacttatagaagcagagagtacaattgcggttgtcaagagctgggggaggggaagcaaggggatgatggttaaaggtataaaatttcagttagacagaatgaataagttctggatctattgtatagcattgtgactatggctaataatgtatacttgaaaattgctaatacctgaaaatcactaagagactacgtcttaaatgttcttacaacacaccaaaaaaaggtgtgaggtaatgaatatgttacttagcttgattttaatcatttcacattgtaaacgtgtatggtactgatcttgtacctcatttcattttccatatgaatcagaaaaatactgctttttctttataatatcttatacagcatagatacaatttttagtggtcaattatattgtaatatatacataaatatatatgattttcattggtcaattatactgtaataaaacagcaaaaaataaagttgtaattaaaaaataatttggaagaaaaaattagcaagtggttggagattgaggaagatgggaccaataagtcctccaaggagagtcatacattagttttttttaaaagtccattattaatcttataatatttaatatgtttaatttcttgacacttattaatccaattaagtatgagaacactgtggataaatctaaaaaccttaaagttgagtaaaataaaccagatacaaagaagcacatactttatggttacatttatatgaagttctagaaaaggcaaaacttagctatagtaaaaaaatcatggtcctgagggaataactagagagtggtatgagggagctttctataatagtgggaaaattctgtatctttattgggatagtggttatgtgagtgcatatacttaaaaaaactcatggaattatgcccttacaaatctgtaatttttgttggtaatttataccttaataaaaaacaaaacagatgacagggttagtgattgtttccttgaagaaggtctttacatgggtctgttgttaacgagttgtagtaaaaatcatccaaaatgcttggattcaaatcttagatctgttcctaccagatgtgtgaccacagacaagttacttacattccgtcttcagtttcttctcttttaggaaaaagcatctagtttttgttgtagagattaaattagataatacaaatgaagtacagagaacagcgtttggtgtgtaacacatgttcattattagctacccttattttttagagaatggaaatttttaaatttaaactaatcaaactattttaggataagcaagtgaaacaatctttttttcaatcgatcacagaaatattttcactgaagacaaattagacatttatataagcaaactacagtgtcattaccattcaaattttcatatgcatattcatgcttacatgcatatgaaagcattacacatatgtattctataaatatatacaaaacagtaatggaaatgtgctgtactattttgaacatctttctagtcagcccggcattttatttacttttgagacagggtctcactctgttgcccaggcttgagtgcagtagtgtgatctcagctcactggaggctggaggtcctgggctaaaggaatcctcctacctcagcctcctgagtagctgggaccacaggaaagcaccaccatgcccagcttatttggtttattttgtttgtttgtttattttttatttttttgtagagatgaggtctcactatgttgcccaggctggtctcaaactcctgggctcaagttatcctcctgcctcagcctcccaaaacactgcaatcacaggcattagccactacactgacctctacattttaatagctgagtagccttctgttatatgaatatacttttttttaacaaaaccaatactccattattgtacatttaggttgtttccaagtttcactcaaataatgcttgggtaagtaagtatttttatttattattattatttttttgagatggagtttcactctgttgcccaggctgaagtgcaatggtgtgatcttggctcactgcaacctccgcctcctgggttcaagcgattctcctgcctccacctcctgagtagctggggttacaggtgcacaccatcatgcctggctcatttttgtatttttagtagagatgggatttcagcatgttggtcaggctggtctcaaactcctgaccctgtgatccgcccacctcagcctcccaaagtgctgggattacaggccgtgagccaccacgtctggcctggataagtattattttagctaaattgtgcatatttattcccttagagtaaattcctggaagtaaattgctggatcaaaaccaggtatattttaaagaattttccttttctacattaaaaataattataattctgattacaagaaaggaaaattatggagcttcataagaaaaaattagtctcatatttcatacctcatattgcatatttaataggtaaccagtgttaaatttgttgtgtgttttccactgggatttctttttatctcctttaataaaagcaggatcagatccctcagattactttgtaacttgcttttattctactttttcatacctcttagcatgaatgtctttccagaccagaatacagagatttcacttactcatttatgagctgcagaagatgactatgatttattcaaccattctcctattgaagagcatgaatattgcttcagatacttttgttattataaatattagtgcaattaacattttaaagtcttttgatacatattcccaacttgttctccagcaattaccatttttgcattcccaccagcactggggctacttccctttagttgcaccatcatttagcattatttttgatcttgtgccaatctaaaaggcaaaaagtggtatcttgttgttttaatttgcatttctttgattactaattagattgaactttttcatttgttcattggtcaatttgcatttcttcttttgtgaaatgcctgcttgggtcttttatgtactttaccattaaagtgtttttcttgattaaatagattatgtaactgtcatatgttgcaaatatttctgtccatttggcctttgcttatgactttttatgagtctttaggacttttgaggtctttattaggtattcaataattttaatgttaaatatattgatgtctgtcttcctttgtgtcttacggcttttctatttaaggttacgtaaatttctaatatacaaatattggtgtatattatgaaatagggccctatttttctttacaaaagattagtcagttctaaatcatcctttgctatttctagcggcgcttagatgccaccattatcacatcagtgaatttttaaatgtgtaattgtttcctgatctattcatttctctattcctagatacttctattgtaatagctttaccaaatatatctgatagggtgtgtactccccctcattacttcatttatttatttatttatttagagacagagtttcagtcacccaggctggagtgcagtggcatgaacttggctcactgcaacctccgcctcctgggttcaagggattctcctgcctcaacctcttgagtagctgggattacaggtgtgtgccactacacctggcaaatttttttttttttttttttttttagtagagacagggtttcaccatggtggccaggctggtctcgaacttctgatctcaggtgatctgcccttctcggcctcccaaagtgctgggattacaggtgtgagccactgtgcctggccccctcattgcttttaaaacattttcttactgtaatatatttattccaagagaattttcaaatattttatgagattccttgtccattccttacatcaaaaaataccacggagattttgattgaagttctattataagtagttacttggggtggggggaggggggagggatagcattgggagatatacctaatgctagatgacgagttagtgggtgcagcacaccagcgtggcacatgtatacatatgtaactcagctgcacaatgtgcacatgtaccctgaaacttaaagtataataataaaagaaaataaagagaatactggcatggaaaatatgtaatcttggaacttgttgtatctccacttattcaatcctttgtctctcagtagattttgaatggctctttatcccacacgagtctagaatcattttgctaagtttattcctagatataatatgctaattgatatgggaattttttttatctccattataccttcttcttgggtgtagacatatttgtagccagcttcctcactgcatattttttattaggcctaatggcattaagtttattattttggattttacaaaaaaaattatgataacatctttaaatagttagtttcaactcctcctttccccttaaatccatcaattactgtcttttatttcactttccttatgtactgactagaatgcctagaataattgaatgctatgagtaataataggtattcttgccctgtttttggaaatccttctggatttcagtaagtgtgatgttggcttttggtttagtatctttaaatttgcaatttacaagatattttacattggaatagtcattgagttgttaagtaaagcacaaacatgttaaattcagactgaagtacaggacttcaatgaaaagttaaaagagtttatttcatcactttcattttttctttccctcagtggctgtttgtcccctccccccaccccgctccatcccccagcttccttcctttgtgctcttattgttctaggtttgactacataaaaagagactctcaatttatatgtgatacaagaccataactaatattataaaattagtctagaagaagttatttgcaacctatataataagggactaatttcaagattatttgaaggactttaaagattggtaagaaaaaaatagacaaccgtttagaataaggcaaagcatgtgtagaggcaactcttaaaaaaaaaaaagtgagctgggtgtgatgatgcacacctgtggtcccagttactagggaggctgaggcaggaggatcacttgagcccaggagttcagggctgtagtgcaccacagtcacacctgtgaataaccactccattctagactgggcaaacataagaagactctgtgtcttaaagaaaaagaaatgaaaagatattcagtttcattaattgtttgactagctgatttttggaaaatacccacaaatataaccaagcctacaagttattttaaggtgggtaagagatacatcttatctatatgcattcacctatgtgaagcggacacccagtaacacccccgtgtggaagacaagcttccttaaacttcacaggacagtatttcccatgtagtccatcatagggtgaggatttttcaggacctttggtaagcctgcttgctttcattcttgagggtagaggaagggtgcaagacttccctggtctctcccaagcattttggggaccctggccataagcctacttgctcaacaggtgcaaatgactggtaatatgctgaccagatgcaagtgtaccaccaatgatttgctgtgactgagtttggtttcctttgcatatactatccagctttttgtttctaatatattcttccttaagggaaccaggacttcttggggaatccagatgagcttgaaacactgtttttataagagaagggctgttttcaaaaacatctatagttcgtaacaaaggagttagattgaagggactctcactgttcagtctgtgacaagcatgagtgttaaaatggagacaagaattttagttaattgtaatgttgaatttgtaaaaggctataacttcataatatgatcaaggggaacaagcaatctaaaatgtgttaaagtagcattttcaaagtgcggtccagggactctcagggttggtgaggtcacaactgtttttataatattgctaagaatgtatatcactctccttctctccaaggatacggtggagttttccagaagctatgggatatgtggcgatagccttgccctaatggagtgtgtgctttgtgctttgcatttttgtcctttaaaaatgcttggttttaattttgaatacaataattatagatagatataacctacataaaccaaagttatttgcggccctcagtctttaagggtgcacagtggggcctgagactaaagagtttgggaattgatgttctagagaaaagtcagtcttactgatgagggttaatcaattagtatttactgaccgggacaggacaaaccattcattttataaagacacacagagcatttcactaaaatacttttactctgattaagtggtgattttagtaatagtaatgattgtttgattttctgatacctgaaggaaaaagagcctgttgaattgatactttgagggtgttgagttttaggtcactgggtgactgtagaaatggaccaggagaagaactgaaacttgagccttctaagaaatagaagaccaaaaaatgtttagtgttaccctatcccatgaccacaataattgagaaaaaggcctttccgttccctcttccctaccctcccccttctcccctaccctctcctcccccctcccctccccctcctctcccctaccctctcctcccccctcccctccccctcgtctcccctaccctctcctctcccctaccctcccctccccctcctctcccctcccctctcctcccccctcccctccccctcctctcccctcccctccccctcctctcccctcccctccccctcctctccctccccctcttctccctccccctcctctccctaacccctcccaacctttcccctccttctctgtccccctccccctccctccctgtcttcctcccaccccccactccctgtcttcctccttgtcttccatcctcccttccttcctttccttcctgtctttcttttcctttctttcctttttcttctttccttcctgtcttccctcctctccgtctgtctccttctccttgtccccttctctctgtcttgcctttcctttccttctgtctttttctttctttctctttctttttcactcttcctttttttaatttcccttttacttgccttctctctttcattccttccatgctttcttttttttagtggtatgtatactttgtgagcaatcagactatagcttgcagaatagttgggagaggccaaaaatgcccctgagaatgcaagcaaggaacttcttagtgagcatatgaacatcctcactccaatcggaggataacattgttcatacttcaaggactaaaaagctgagagagggtctctgctttctgttacttttagcactcgagtcatttctgcatgtatttctactgattactttttctcctattttggttcatatgttttctgcttctttgcttgtctagtgattttggattagatgagtgacattgtgaattttactgtgcaggatggctgaattttttttctattcctgtaaatatttttttggcattgttctaggatgtagttaagttacctggaaaaagtgacatccttttgagaggcttgcttttaagttttgttaggtggaatcacagcagtctttagccagctcactaaggaccaatactcttctaaatacttaccataatgtcatatgaatttccatgtttttccacttcagctggtaggaacacctgtgtcatctctaagcattgtactgttaattcttctagtagttcttatctggctttgtacatctgctgatcaatactttcagctaaagtctcaaggggacctctgcaaatctacagtgttcactgttcagctttctcttctgtagtaaattgcacagtgaactctagtccccttagccttcctgaacccccagttctccttaactcagggagatcaccaggccccaccaggattcctgtatctgccctgtgacctggagattctctgcaggcaataggttggggcggtcgtagggtccactttgttttcctcctcttcggcttcactgtcctgtgttacctgatgtccaatgtctgaaaactactgtttcacgtatcttgtgtgcttttgtagttttaggtgaaaggtaaaactagtttcttattattccacattggccaaagcagaagttttggaagtctttttttaaggtctaaaacacttctactttgagagtcaattgaaatggtcttttccacaataattattttctgacctatggtttaaagataagtcatgaaaattttatgccactatttttttttaagtctgattatggttaaattcagggggctatttcctcctagattgacagagtttataatgtttcctactcacaataattgtacttctgcttcctctttgcatgtgttactttaatgggaatgtatatttccttttcgttaaggctgccttcaacaatttgtcataaagtcacttctgttagtgaattctattttttctgttactttactctatccttagtaccaaagagctccttatgtgacaccaatttattactaaaatgtcgctttgtttatgttcttggaattcttcatacattgactatcctcagatgtcgaatgttgtaggcctgtgtggcagggactctcttccatttattctatttttaatctaattcttgacaaaataaacccaatttttcttttcttcccctttccatctcacgtagggactggcataaagggcaatccataaaattacaaatgatgaatttttttggttttaactattattcatacatttaagatatggtcacaatttttatttcttactagtaattcattttattttttaacttttaggttctggggtacacgtgcaggtttgttatataggtacatttgtgtcatgggggtttgttgtacagattatttcatcacccaggtattaagcccagtacccattagttatttttcttgatcctctccctttgctcactttctaccctctggtaagccccagtgtctgttgttcctttctatgaaacacaatggttttaattggaaaatttatttttttttcaggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggtaagtactcctcatgggaaattttaatcagcccagtttccttgatatacatgattaatctagacatgttttgagtaaaaacaactttagtgatgttgagatagtttccttctgttcctagtttttgtcgtgagaaagtgttgaaatttgctaaatactttttctacattaattgagataatcatatttttccctacatcctgttaatgtggtatcttatattaattgattttcatatgtttaacatccttgcattccaggaataactccccaatggccatggtgtataatcttttaaagatgctattgaatttggtttgttaatattttgttgagtatgtttgcatcaatattcataaaacatattgttctgtagtttttctgtactgtttgtctgactttggcatcagggtaatactggcctcatagaatgagttaggaagtaactcttgaatgactattttcatgaagaagcttcaataatctgaaataaaatacttaaataatttagttcacctgagagttgtttttagaagcgtatttatttttctattaatgtcttttttgaactatataagaatgtattctccttccactcacacattgatggcaagtgtgtatttgtactctgtggcctgaaaataagatttttttgaataatcttaagaggccatgctttatactctggtaattgagaattacctatttcacagtagctttttctaaaggttaatttccagagaaaagagaacatgtttattaggatatatctcttaatgaattcagtgtatctgaaatttctaaatgacattttcatattttgcatactaaataaaattcataagtacaaatataatgcaattcataagtacaaatataatgcaatttggatttctagaagttatctagttaaaatatgatcttaggatttattttttttgtcttagatttatgaatcttgcttgtttttctgttaattcatttcttcttgtttgctgcatcagtcagatcagagtagaggcagcttgtatagttgatggcacagtttagggttagatggcacaggatagaaatgggtgctagacaaagagcagtcacagaggcatgttagaaatttccagttccagcatcattgatgaagaaaaccatgaggacccaagttgatcaaaggcagccagccaataaagctatgctcatgcgagatgagctgaagtgacattacattaaaattggaagaccctcttactaagtggctccatgcttccctgctagcccctttgggacttccaagaagacttggttatttcaagaagacaagaacccacagaggctgtagtttagtttatctctctggaaacatagagaatatgtataattaaataaaagcactttaatagtgaatcctttacagtgttatttgaaatttatgtcaagtgatttaaaaagtaaaaatgaaaattaataatttcagtggaagtaaattgattaacatgaccaggaatacataaaacttgcatggtcttgtctataaaataaggatatgtcatttaattaggagagtcaaagctcattcttgcgcttaaggtctgaggaactcttctcccatggggcttatgaagggctacactgaggcaacttcctcaatatatctcagccataaaaccaagagaaagtaagaagcagaggacatcacaacaaagctcaattcagtaaaagcaattttataggagtagagggacttgtcaaaaacaaaaacaacaacaaaaaacaatgtccaaatatttattcagcttaatgagtgatgtttttgtttgatctagggttaaaatctagacaaattacagagatgaataaactacatatcctttagtctaccatcctctgaaaatgttactttttgaaactttgattttgataagagctggaggcactcagggagtcattctctggcatggtctttgagtacagagtgattttgctgattaaaagcaaatagattgacttttaaaatcaactcatacaaacaaactgttaaaatcctctaatgagagtgaagaaacctaaccaagactgactgatacattactgctccatctctgcaccaaagtggactcagggaggcctgtaggagatgccaactccttatcctactccccacaaagacagttcttggctatcttcatcagacacaaatgaatggttgaggctccaaagctctctaccaattcttgtgttacactggcacttttaaaaaattttgtttattttttatttttaaatggagtctcactctgtcaccctggctggagtacagtggcgtgatcttggctcactgcaccctttgcctcccgggtttgagcaattctccctgcctcagcctcccgagtagctgggattacaggcacccgccactacgcctggctaatttttgtattacttagtagagatggggtttcgccatgttggccaggctggtcttgaactcctgagctcaggcaatctgcccaccttggcctcccaaagtgctgggattacaggtgttagccaccgcacctggctggcacttctcttaaaactaatatctcaagaagttttttctttaagaatcttctttcaattgcaggtccatgtagttctggtattcattaaagtgcctatcccaggggttttggtatgttgtgtttcaattttcatgtttcaatttttttgatttatgcattaattttgttttttcagaattcaggtgcaggttgtttagtttccatgtatttgtgtcgttttgagaattcctcttgttcttcatttctaattttatttcattgtgacctcagaagacacttgcattgattttgattttttttatcttattgagatgtgacttacgactatgtggtcaattttagagaatgttccatgtacagatgtgaaaaatgtatattttgtgttgttgggtggaatattctgcagatgtctgtcaggtccatttggtcaagagtctgatttaagtccagtgtatacctttgttagttttctgccatggtgatctgtctggtgctgtgagtggggtgttgaagtcccccactattattgtatagctttttttccccataggtctagtagtatttgttttatgaacctgggtgctccaacattgagtgcatatttatttaggatagttaaatcttctggttgaattgaaccctttatataatgccctcctttgtctctttttgatgttgttggtttaatgtctgtttcttctcatacaagtatagcaacatctgttcttttttaattttctatttgcatgctagatctttctccatcccttcactttgagcccatggttgtcattacatgtgagatgggtctcttgaattcagcagaaggttaggtcatttaaaaaatctaatttgccactttatgtcctttaagtggagcatttaggccatttatgttctaagttaatattgatatttgaggttttgttcctatacatttgatatttgtgtattgttaagtagttgctttctagtttgaattgtgtaattgctctataagatctctgagccttgtacttttgtgtgcttatatggtagcaagtattgttcttttgtttccatgtttagaactccttggagtatttcttgtatggcaggtgtggtggtaacaaattcccttagtgttttcttgcctgggaaagactttatttctccttcatttatgaagcttaatttggcagattatgaaattcttggctggcattttcttttttctttaaggaggctaaaagtaggcccctgatctcttcttgcttgtaaggtttctgctgagaagtcctctattagtctgattggatttcctttataggtaatttggcccttttctctagatgcctttcatattttttctttggtgttgaccttgcatagtctgatggactatattccttggggatggtcatcttgtatcttgcaggtgttttctgaatttcttgtatctggatgttaacctctctggcaagattagggaaattttcctgaattattgcctcaaatatgttttccaatttgcttacttcttcctcttctccatcaagaatgccagtaagtcataggtttggttgctttacataatcccatatttatcaaaggctttgttcatttttcagattctttatgtttgtctaactgggttaatttgaaaaggtggtcttcaagctctgaaatcttgtcttctgcttggtgtagtctgttgttaaaacttccaagtgttgttttgttttgttttgttttgttttgagatggagtctcactctgttgcctaggctggagtgcagtggcatgatcttgactcactgcaacctctgcctcctgggttcaagcgattctcctgcctcaccttctggagtagctgggattacgggcgagtgccaccacccccgactaatttttgtattttttagtagagacaaggttttgccatgttggctgagctggtctcgaactcctgaactcaggtgatttacccatcttggcctcccaaagtgctgtgattacaggtgtgagccaccatgcctggcctgcttccaagtgtattttgatgttccctttagtgaatttttcaattccaaaagttctatttggttttatcttaatatggctatctcatgtttcatatcctgcattgtgtttctggtttatttgaaatggattttaaatttctcttggctctcactgagtttccttgcaatacatattttgtttttttagtctgtcatttcaaagttttcaacttggttaggatccattgctatagagctagtgcaattctttggaggtatgaagacactctttttgtagtgttggagttcttgggcagattccttcttatctgagggagctgttgattcttatttttgaatttcctattggttgggcgggacttaaactttttttttttttccccttgagggtatgactatggtgtatgttgtgtgtgatcattcaactttgtttctgggtgctttcagggggccaaggctctttatggattccttgggcgtggtagctttcttaaatgctgcttattgtagcaatgtattggatttgtgagctgacactctatctcatgtggggctgagggtgcagaagtctcaggaagcttattttgtggagtagtgctaagcctttctggtagtgggctttttatttgatagtacagttcaggctgcaatccagtagatggcacttaaaaaataagaaccagcttgccctcagttaggctgatgtccagtagaagcacctgtcctgacaggggagtgacaggaagagattctgttggtgtgtgccgaggcctttggggtcgctggttggggggagatagggggaggtgcactagctcctcatgcaggaatgtgatctgcttttctatcataccccatcagagggctcatgaccttcagttcataaagattttttccttgggttcccagccatagtctgtctgtaggttatgcatatgcccctctgaaggcaaccaccaaaatggtcttggggcagagcctcttcccccagtctagggcagacaactccatgacttgtatgtcctccattgctgggacactgctgctctgtgtagggatggggagttgggccccaccctttatgtaagcctaagtggcattctcactttcagcaggggtggagccatcttgaaaaccatgaaaaactctttcttcgagtacctgtgctggcccccagtgggaagaaccactgctgcgtcttcaacagcgtgtggggtgggagggtattgccacagatgaccccctctccatatccgttccttgacatggtgttgccccctttagcgattggcactgtgcccacctttcctttgtcccaaaggggttttggcaagttgtgtccctctcccttataggtggcctacactaggggggttagatctctagaggttccatagctccctgggaacttgctggccccctgggcttttcaaagtcagaacaggttatgaggtatgtttgctggggatctggtgctacagagactcaagggtagagaatccctgggcagagcagaggcccaccactggtgcacaagcaatatggtgaccaccatctcagtttgtgtctgaggggagtatgggaacccctgcaggagctggccacccagttctctatccctgggaaattcctaaattaccaccaataacattgccctgggtcacaagggtggggccttgaattctttgggggttgatctctgccagactctagctacttttcctttctgcaccccagcttcttcccatgggcactccaaaaggtcctggctctctttccccagttttccattagaaacttgtccatttgacagtaactttgatcttctttctaagaagagctggcatccaaggtctgtggtcagctatgttggaaaaaagaaggagaaaaaaactagtttgtattaaattctgaaagactagtggcactggttaagtctttaaaggattgttaacaaaagaaaatctttttaaaccaaactcctaattttatcagaattgtaactgaaaatataaatgtatgaaaacataggtattatgtaaaatttgctcaataaaagaataggaaaaactactatttatcttggactgatagcatgttagtttgagatttgaaccctttctactctagtaagtagtggtgggaaaaattcactgtaggagtctgcagacataacaaactatcattagactgccaagacctccacataataaagcaagcagagaatgtcaaataagtatgtgaaaaatgatcaaaaaagagaaattgaaaatataaatagggtgctattaaaaaaggatagcatttatgttatgacatatgtacacatgaatatcactttttagaatttcatccttcttaggacttattcctgagtccgaggattgagaggttctgataaaataagtctcagtgggttccaggcatgggctttctttaaaagtctctccagggattctaatgtgttgccaggaccaagtaccatggacagccaagatctcatcagcacagtttgattgaatgaacttatgtagaaccctgaatgccacacttaaccaaagaaacctttccagggattaattataggtgacagaacatgctatattcttattaaatattattaaaagttaagcaatacccattcctgattcatgtaaaattctcacttattttccaagagttttactgtatgactggtttatgggatgcttggaaaaggttgacagacatggcaaaggttcctgcagtgtttctctttgtccatcaacagccctagctcataacctctaccctttcagctaaaagcaattagctcttcagaagtgattcattctatttatacttgggataagtaacatcaggcagtcttccctagggcttctcacgggccctggtggcatttttattctaagagagggttatatttttacatgtaattggtcataattatactaaaaacaagtaattggtgtcttatacaagaaaattatatttctgctttagtcattgacagagtatcctgagaataagagttaagaagtatattcattgtcatcttatttctgatatatttcaaattcttttgctaggaagaagcccttttgactgtgctttgtgtaacaaaacttcttcggagaaacaatttagataaactttgtcagatcttatgtgattatattcaaaatgctaattgaagattctctaaacattttcagtaaaatgttgaattgttttcatgctgttaaataagttaacatgtcttcctttactaaagtcattattataaaaatgtaaatcctaatgataatagctgatgtttattaagcatttagtaggttccattttttgatagcaacttttatgaattatctcattaaatcttcataataatagcatcaagaactacaaatatgttttcatgtaagaagggaaataaaattatgagttttgctgtgaggtttgaagaatgaaaacaatgcatgacttagaaaatagtataattaagtgaattttattatcattatcatctcttagtttataaatgaaaaaactaaggcttacataatgtaaaaatcagttaacaaggttaaacaaccggtagatggtagaggaggagctgggaataaatctgtacatgtctgaatctggagcaggaacccttaactgatgtgtcattctagcaggtcatcagttactctacaatacctattaagtatactttatttactgtgtttagatttatagtagatttagactctactgtaaaaacaaggacttcatacacctgctagaaagtatccatatcatcttgtttgaaagttgtcccgctctagtgttcttttctaatcatgatgattcagaactccaaactcttgaagcagggcaacccgtagggtcagcattcataatttctcaatacttaaaaaagtttcctcatgactgttgctattattgagatttctcaaatgtcttggcctgaattgggtgtgcactatgaaaaaaaaaatggcagacatttctttttgttaaaggaattttaaaaacacatataaacacactgatttgtgacagattaccaggctttatgtttagcagggtttcctaagcaaaacacaaattctgtaaatctacagaattagataaaacattgactcaatccttagatgagagtataatggattatcacttaataacttctgtcactgaaaataaatgatgtaaaaagtaataaagttctactctcacagtatgaataaataggaaatacataatactttaaattaggcaacaaatcattaagcccccagcattcattagactatcattaatgataataaaattgtgtggtatttatacagatattatatgtaactccaggaattttgttataattgtgtatgaatatatttgttgtttgaggcaggtagatggatatttgcagcagctatgtgctgaagcattctggtaatagttttcaaatcaaccatttttttctccttgtcgatcatctttaaagcaaaagcaccgttttttactatattttttgaaaaaaatacattaggtgtaaaattatatattttgaagaagttcactttctgtttttactagtttcacacctttgttattttttcagtggaaggagcagagataggcaaaggcgaagcctgtgtgtgtggtcaggttcctgggcccttcatagcatctgatgccaagctgtgttctcttttgtgtcattgccttcccacttgctaattacgtgacagagctagggacttccctctgtctagaatgccccccatctcttgtttgcctagtgaaatctggtttgaagttcaaggtctgatacaaaccaggtgatcctctgcaaaactaactgtacctgagcaaaccaggcacttactcttttatatgttcctggcactgctgatactctgatagaaaacatcatcacttaatgctaactgtgggctcacaaaggggatacttctactgtaagaagactgtaactcttcttagcacagagattagtaagtacttgaaacagagtttcacatataataagtgttcaataaattttattttttatttctaacacttggcacactgcatagctcagtaaatgttggtgaagtgaactgagtattctccttatctattatgtggtaggcattattctagttgcttctgttataaaccaactcatttaatccttatcacagcacttttattgtggtcaatattttttaatcctcacagatggctaaggaatcagcactctgagagattggttgacttgctttgggtaaggtgcttataaagtggtagaacaagattcctatccaggccttctgattcaaaaatacattctttttttttttttttttagtagtgttttctggaaaggcagggtataactgactatgctgtgtatttgggactaagtatattattgtcaagtatattaaaaatgtcgcaacactggaaaggagtccatcaatgggctatgcaggttgagggatttgtagatgagaaactgataaatttggttagcaaggaaagccatcaagctgtgaaccctttatattggcaaaagagagggtcctttgaaatctaagggaacagaactttcctgttctccaagtttggagcagaataggtaagctctaggcagtctaatgcccaacttttaccagtggtgttttagttttttttttttttccaaaaggaaatgatggaattctttatatacttctgaattgtctatcttttcaaaaataaaaattttcattttgcagtacatacagaatcaaaagactttcaagtcctaactccacaaatgtttattttgaagctctttaaactgtttaccacggatattagtaaatctgtcagaaatgaggtgacttacttatccttgtcccaccagatatgtgggaaggatgatcacgctagatagcatggatgggtcctctatttatctctttttacttgaatggaaaacacatcattcagattaatcaattagtcattgtgactgatagaatttttatatggataatctgggtttggtccctagctttaccacttacttggggtctttatgtcttctatggtctcctatctgtaaagggaagttgataatgccaatctagctaggttactgagatgcttaaatgtgtaatgtatgcaaagcagcaggtactcaataaagggtaactcttactattattgtatagctctccaggtatgtattgagcttctatagaatccatagccccaaactctttagccctttgagaccaagattaagcattgtctttccagaggagagggtgagagagattgccattatactaatagaattcatcattatcaccgtcatcatcatcatcatgatttcttggtgtgtcatggaatgtactgtgtttcacattaccaacagatgttaattttcacaacatccctgagacaagaaactatgattacattttacagataaggtcatgcagctataaagttgtgaaattgggattcaaactcaggcagtctgtccccacagtccatgttcttaacccaccatgctctcctgacacttgaaaagttaggaggcgtactccatagcctgtaatgttgctgcagagagaatctaattttaaatccagtgaagcatattagttgctgtctttgatatgccattcagattgtgctatccttatgatgcctaccttggttgtatatgtaactgggcgtcaaatatataaatactcaaaaagtgataggtgccaataaaatattttatagttaatacttatgtaatctgtgttctctgtgtttgagggctggttctaaaatactgctctatatttgacttctggttaaaacaataaactttgctcatattagttatatagttgataccattctcatgttgctaacatgtctgtaagtaacagttgaaattgatctggcaattttagagctgtcagacccaggagatgagagaaacatttaaaatgtttataacattaaatcagctgagtcaagagagagaaagagaaagatgattcagatttcttgtactggtggatgtaagtgcttggaactgaaataaaggagaaggtgtagggagggagaaagataaagaagtcttccctttatacaagttgaaattgagtttyctttgagatatagaggtgaagacattttaagaaacttcttaaaactctctaatgtggcttttcaacctgtttccatcaatttggcacatctcacttttcggcacaacagaatattctaggtttatctcacaccttccttgccccagcccaggaatcagccatttctctaagaaactcttgtttattttggtggggaacagtattgggaaaccaacatctgggagctaaatatactcctagtggttaggaggtcataccttgtagactcttgtagctgacggagttaggacatatttattagaaatcataagtttatattgatcttgctaggatctatccaatcctacaagattcttccctgtgtctctcctttgtatttgtgtatcctttcttccatattaagaactgtggctcccaacaacaaggcatgtgcccatttgcccaatcgtatgatgtataaaaactactttgagaaaagtggcagccaaaccactaagaaaaataaacttgctgaaatgagttcaagatttattggcagctctttttttggcccctagactgaaagtatatatttcaagtattgtgttcaaaaattatttgggttagctttttccacctttcataatagtaatattatttacttgaaatacagttggctttgtttctatattcagtttttttctctctatcttcattaatttcattatatatatttaatatgtaggacattaacatgtttccaaaagaagaaaacactccttcctgtatcatttccacctcatctctcttaccccttataggtaaccaattgcactggtttctagtttatcttacttatattcctatttgaaaagttacctcatatatgtatgttttttaaatttttatacttttttacacagaaagtaacgttcagtatgtactttgccactttccttttaaacttaacagcgtatactggaaatcactccatatcgtgtcacagagagcttccttatattttttaatagctgtataagacttcattgtgttgtctgtaccatattttattcacttccccatgtgtggacattttgactgtttctagtatctgcaattactaataatgctgcagtaaactttgtgcatatcgtaccttggtaaatttctagacatagatttctgggttaaaggttaagcacatgtgtagttttgttagatattgataaattcctttccatggggtttatatcatttttaaaatatttaccagcaacgtataacagcgtccattacttcaaagcctcaccaacagattgtatgttttaagtacttttatgttttagaatttttccaatgcgataggtaaacaatggtatatcaatatagttttaatacattaaagttcagcatcttttcaagttcggctagtctcagggctattcttaatatcttgtgaattatcttcatattattttcccatattccataatacttttggttttttttcctcctcaattctgacaagttctttatatttcaggaatattagccattttatttgatatgttacaaatatttttctcccaatatataacttttctcttataacgatttttttttcatgaaaagtttttaattaaaaccttttatgggcccaggtgcagtggctcacacctgtaattccagcactttggaaggctgaggtgggcagctcatttaaggccaggagttccagaccagcctgaccaacacagtgaaaccctgtctctactaaaaatagaagaacattagctgggcttggtggcacatgcttgtgatcccagctactcaggaggctgaggcatgagaatcacttgaacccagcaggtggaggttgcagtgagtcaagatcgtgccactgcactccagagtgggcaacagagtgagactctgtctcaaaattaaataaatatataaacaaaaccattatgggccaggtgcagtggctcattcctgtaatctcagcactatgggaggtcaaggtggttgaatcatttgcgccaaggaactggacagaccagcctgggcaacatgggaaaaacctctctctaccaaaaaagaaaaaaaaaaaaattagctgggtgtggtagcatgcaccagtagtcccagttactcgggctggtcacatgagcctggggaggtcaaggctgcagtgagcagtgattgtgccattgcactccagcctaggcaacagagtgagaccatttctctaaatacatacatacatacataccttttgtggagttaaatttacacactttttctttattggctctggcttttgcattgtagtaagactttctttacactcaacttatagataaattcacccatgttttcttctagtacttgcatagttgaattttagatctctagtccatttggagtttattttttgtatggtagaaggtattgatcctattttttcccaaatagttgttacccagttgtcccaaaacaagttattgaaaagtccatctttgtcccagatagactggaacaaaatgaattaaagacttaaatatgaagatttttacttgtgtatcctttcttcctagaaagaaaacataggcgtaaagcttcatgacgttgaatacttcatgccattggtctggcaataatattactattatgaaaggtggaaaaagctaacccaagtaacttttgaacacagtacttgaaatatatactttcagtctaggggccaaaaaaagagctgccaataaatcttgaactcatttcagcaagtttacttttcttagtggtttggctgccacttttctgaaagtagtttttatacatcatacaattgggcaaatgggcagatgccttgttgttgggagccacagttcttaatatggtagaaaggatacaccaatagaaatatttatatttaagtctggcaatcatttttaagatgtgaacttgaacaggcaacaaaagcaaaaataggtacgttggattacatcaaacccaaaagctcttcacagcaaagggaacagtcagttgagtgaagagacaacctatggaatgggagaaaatatttctaagccacacatctgacagagggttaatatccaaggtatataaagaactgcaacaactcaatagcaagaaaacaaataacatgaataaaaaatgagcaaaggatctgaatagacatttctcgaaagaagacataccaatggacaacatgaaaaaatactcagcatcactaacaatcagggaaatgcaaattaaaaccacagtgagatatcgcctcacacttgttagaatggctgttatcagaaagataaaagataagtattggtggggtgtggagaaaaaggaactctagcccactgttagtgacagtgtaaattagtatagctgtgatggaaaagagaatggaggttcctcaaacagtttaaagtagaactaccatatgatccagcaattccacgactgggaatatatccaaaggaaatcagtatattgaagagaactgtattttagtgattattgcagcattgttcccaatagccaagataagggatcaatctgagtatctatcaatggacaagtgataaagaaaatatggtgtgtatacacaatgggataccattcagcctttgaagagaaggaaatcctgtcatttgccacaacgtggttgaacctggaggacattagctgagtgtaataagccagccaccaaaagaaaaataccacatgatctttcctatatgtggaattttaaaagttgaactcaaggaagtagaatagaatggtagtgaccaggggtatgcgataggctgagggatcaaggagatgttggtcacgggatacaggatttcagttagataggaggaagaagttcaagaggtctattgtataccatggtgagtatagttaattataaagtatacttgaaaattgttaagagtagattttctgttcataccacaaaatgataagtatgtgagataatgcatatgtaaattggctcaatttagccatttcacaatgtatatatatttcaaaacaacatgatgtacatgataaatatacagtttatttttaattaaaaattttaaactctctaattggtcttcaacatatagtacacaagtcttttcacgactctttataatggaacatatgttcttggaatgctaaaaattattttttttggaggccctgcaaataactaaaaatttatcttaaaagccacacctaattacttacatatgatccagaaaggatactttgaaaaagctttttaattgataaaatcattaaggtaaaacatattcataaaagtgttctctaataattttataattttctagttcatgaaggattaaatatacaactatcatttgaattggattttttatgaggttaattgtatttaaatgctaattattttaactaattttgtggttgacttctatgtagagtagggaaaaagaatttcctaaagccagttacgtatatctctttttagtctggatttttaattaggaaaagtgatatagttaaataggtctactctatagcatcttctaaaatgagtaaaaattcattatatcaggataaaaaatgataaagatatatggatgacacatttggctgaatttttcttcttcgctgttctcttgctctctatttaaatagtcttagctcttttatcatttaaattctgaagtattgaggtgattattccggcagcaggtgattctgctaattactgttcagtcagttttagctattagaaacagagatatgtttacattgctgggctgcatgtaaatttagaagttacatggctttgtttttactttgacttacggcattaaaattattttcatctgtgtatgtaaagatctgcatctataagcttttgtggataataaggtgaaattgatgcattttaatataaattgccaatataaaatatctctaactcagacctctactggaaagttgtcaaatcttatgtaggaaaggcttttaccatcactgttacacattaactgggcatagtttaatattaatagctcctgagacttgtggttaactgaggtttctatttcctgtgtttgggttttatctttgcaacaacttggttgcttttctgtgtaaaatagtggtgaatatacacaagagtatgacaaggttctgggctcttaactttgatgaacaccatgccatttccatcatgctgcactcaaaacagcacagatgtgagtctgggagtggcgtccctgccgctctcatgagcctttgtttggagaacaccctgattaacccccacccttcacggttcattgactcactgatagatcaagtttaaactagtatatattagcacatttgttaccaacagaggaacagttggccattctgttttacattgctggttcattgcaaactggcgtgctaaaaaggtctgtactctagagtatgaattgggaagttaccaaaggactgagaaccaagtcagttgcatattaatgttgaattatacctatattttaatcttggattgtctacttgggggatgcttacactgttgtcaagttatgaataagtgataattaccactttgaaattcatctttttttttcaaggagtttaggggatttaggtgtctcaatatagctttcatattaaacagtttgtcataattggatgagagcagagcaaggtcatgactacctgatgccttgtgttggagcattttaaaaatgttttccagagagttatttgtacctaatgactttacataagtccttacattatactttatttctaggtcacctaaaaatgttaattgtttagtcaagagggttaggatgtgtgtctgttttctcatgaaaaaaattaagctgttccctttttatcaattttcttgcaatctaaaggcttttttttcttaccttcctaacctagtgactaaggtcatcttattgttacagttcctttcatgggagataggtttactgcatcatttggcagtttcatagggtgaattttgtcttggcttcatctttccttactggttgtcatcccctgggccacctgcttttttgcattttcctttctcttgtgagatgatgaagctctgtgccccgatggggatgagagacagcactctgagttcaagtctaggataaggcaatgggcttgcttttcaaaacaaactagtgtcatacgggctgctgctttcaggtccactgtctgattttatcactgatgacttgtttctggaaggcaaactgatttaagttctgagcaaaagggtcggtgtttattttcaatgctactattaatttagagttttaatttagaaaagattttttaccagttctcaaatatgatttttctattgactttaagtttgtagatataaggagtagacatgagatagagactgaattgcttttttgtttttaaaacttggcagtaataaggggttgcttgttttttcatgctaaatattttttctaagggatctagatacctatcagaaaacttaactttgataactctggttctttattaagtatttttgtcttattttaggaattaatagaaatagttgtaattttagacttcctttataaaataccaatttaaagagaagctttttgcttaaatgattgttttgcagtgttgtgcttttgttttctttaatgcagttgaaatcgcagctttataacttattttttaatttggggtttttaaaagaatattagttatttatttatatttattgggcacctactgtgtgccagacactattctaggaactagtaaacatagcagagagcagaatcatgaagttcttgacctcaaggagcttaaatcctagtggtagagggggaattcaaaaaaatcaaataaatgtatttctattatgtcaagtgatggtatgtactaccaggcaatcagatgaaaatatttcctcttctatacacagtgggcaaggaaggcttcattgactgtggagttttagaagaaagctgaaagtaatggggaaagagagccatatcgatatatgaaggaaaacatggtccaagcagaggaaacgaaaagtgcaaagaattgagcaagaaagtcatgttcaagtggagtcagcaggggaaagagtaggtcacaaatgcggctgagggtgggtcatgaagggccttacaagctttgtatgagtttttacttttattctgaaaaaaacaaaaacaaaaacaaaaaaaaccggggagctatttggggattttaatagaaaagtaacataatttccttttaaaatggatatgtggccactaagtggagagagtggtgtatatatgagtggatggaataattgatacaggcaagcaggagacaggttaaatgaaaaatggattaatccaggcaaaagatggtgacttaaattaagctgggagtgggagagatggtgagacatgcttagactttggattcatttttccagatagaactggctgacagagacatgtcatttaccaacatagacatggcagattttttttttcttttctgagacaaggtcttgctctgttgtccaggctggagtgcaatggtgtgaccatagctcatggaagcctcagactcttgatatcaagtgatcctcccacctcaacctccctagtagttgagattacaggcatatgccactgtatccagccaactttttttttttctgtagagacaatatctctctgtgttgcctagggtagcctttaactcctggcctcaagcattcctcctacctcagcctctcaaagtgctgggattataggagtgagccaccatgcctggccaatatggcggttattaagaggataagtcaaagattacatgaatattctgttatgaaaagtgtcaaacatatagaaaatataaacagtattccagtgggcacccatatttttatcaccttgattctacagatcttaacatttttctgtatctgcttcaaacattttattctgccaatgtgttctaaagtaaattgttgatattgtgatagttctctccaaaatgctgcagtgtgtagctctaaaaatagatatttttcagataaccaaatatcattaacctgccaaatcaatgaatgataattgcttattaacatttaatacttggtccatagtcaaattctccatattttccataatgtcttttatagttaacttttaccaactagtgtctgatcaagaatcattcatttaactaattacatttaaactgtaacattacaacatgttttttcgtatgttttattctctctgacattgacttatggaagagactagattatttgtcctgtagacattttatcatacataagagttactaggagagctctgattactagtccccactctcagaaattttgattcagttgctctttccagtgagctgctggtgatgctggactttcattctgaagaccatactttgagcactactgctgtaccactatccgatggcttctttgtgatatcgtttaacttgttgttctgttgcctgtatttcctctaaactgaattttcaatctaaaggcttactgagattcatgtttgatactttgggcaagaatacttcataagttctagtgcttaatgttaggtagcacttaattctgactatttcactattcatgaggctaagctaaggaggtgacagcctgatccttctattgtaatgtttcatgtgaaactactagataatttgttgagttggggggtgggtagggaagagatatctagttttcaataaatatttcacctaatggttttaacacacattgatcatccttgcctgaactaattatttaattagggatggcaacatggagactttctaattcaatctttttttttttttctaaatgaatggccttgtttttatttttaaatggatgttacttcgcaactggggttatttgattacccagaaatatagcgcatattaaaaaggtaggataaatgcttagttaactaattaagcaatttttaattaccagttttcacagtaaggcactaaagtttctgacttgagcaaagataaagtggaaagataaagtggtcgtttagtgagatgggcaagactgtggataggtagactaggtttggtgggaaagtcagaatatcagttttgaatatgttaagtttgagatgtctattagaaacatatgttgacgaggccaggtgcaatggctcatgcctgtaatctcagtactttaggaggctgaggtgggcggatcacctgaagtcaggagttcaagacgagcctggccaacatgtgaaaccctgtgtttactaaaaatacaaaaattagctgggcttggtggcatgcacctgtaatcccagtaatcccagctacttgggaggctgaggcgggagaatcacttgaacccagggggcggaggttggagtgagccaagatcccgccagccactgcacttcagcctgggtgacagagcgagactccatctcaaaaaaaaaaaacatatatatatatatatatatgttgacaatatttcagttgaataaaataaaatattctagctattttaggtagaaaggcattttataccgatactactactaaagggtaagaagatatgactgtagtacattaaatatgctgatggcctacaactgttgctgtgttgctttttcctcttcaccacacatatgcagcctcatgaaacattttccatgaccagcacactgaaggaaataaaaggaacctagtttagagatggttctgcatgatacaacaaaaatgagctgctaaagcattacaatcccactcaagagtattcccccatcaaatagtggggctggtattttaatcagttgatactaattgtcaaggtgtgatggccaagggattgatgtttatcagtgtatggacagtggttcagagtttggtgaattagtcgagttgaaagagaaagattggtgacaaagatgtatgaggtggaaagtatactttcacagaataagaacagaaaatgagatttatgtttttttgtaaacgttcaacaaagaaaattcattcagaggaggaaataggtaggcaagatgccctattctacagatgttagtcagcatcactgcaaagcaacctcagggcttatgcagtggacacttaaaatagcactggtgcagggatgggagaaataaatggatttaataagcactgctgcttaccaaggttgattgaattgccactattgccaagtgttctacctgcaaacagatcaaccttgagccctggatatggcaccatgtcccagagcaaccagccagccacctggtggcaggttgattgcattggatttgctccattatggaaggtcagtggtttgtcactgctgcgatgaatgcttactgtacgtttggatttgcattccctgcccaccatgtttctgtcagcaataacatggccttattaaagccttattcaataatatgacatcctatataatattgcttttgatcaggagactcattcacatcaaaataagtgaggcaattggctgtcaactacaggattcactggtcttaccatgttcctgttgtagcatattgtattctacctggaagatgaaaccttgtgacattaaagtagtttttagttccataaacataatacaggggtctatgaatcaagaagtggaggtagaagtgttgtcttttacttcacatctaatcacatgttcaaaatattttttcatcttgcctctgcaactttgaactttgctgacacactgaggttttagtgtgaggaaacaatactttcacatgggaacatgatagtcgttcaattgaactggacatttagaataacctggccacattactgaactgtataactgaaacaacaaatgaaaaaaatgaagatgctacgctggcaaagatgattaattttgattattgggagaaatagtattgctactgttaggaggaagactatatgtctagaaactaggaggaaacctgggttgcctccttgtagcagggtaaaatgagtgagtaccttgtctaagaaagggaacatgaccaaactgaacccagaagacataggaaatctaaacagatcaattaacaccaaagaaacgggcattttttggtacttctaaaaaagtaccagactgatattttcacagagatgttcgttatacccttaaggaacaggaacagaaaacttctatactatttaaactattttagaggatagaaaaggaaagaaaactccagattttatttatagaacttgcatgaaattgataccaaattctgacaatgcaagttcaaaaaggaaaactagagatcagtgttacttatgtcaaacagctcttaatagaatagatggatatggttatcaacatgataaatatgtttatcacattttaaagcctacatggagaaacatttgaggttttcttattctagaactgacaggaatgtcctttattatgagcactattagtcaaatttttctggtggaactaatgtaagtagactgctgaagaaaatgaatggtatgaacattggaaaggggaaattaaatgattattatttacagataaaataattgttaagctggaaaatccaagtgaataaagggaaggcctacaattaagcagttaaggaaagggctaggtatagaaatcaatagttttgatatatgcaggctatagccagttaggagatcagttaggggaaaaacacgttgacagcagcaacgaaaagctgataaacctagaattgttcaccacttatcttaaaatgtttaacatggtactgagggacacaggagattatttatgtggaaaaacataccatgtttctatacagaaaaattgaacatcacaaaagtattatttgatcttaagataatttatatttaatgcaatctcagtgaaataccaggagaatgtttttaagctagacaaacttatttcaaagatcatatgtaaaaataagcaaaaatagatgtgaaaaattctttaaagtaatgagagaccagtcttattgactattaagtcattataaaactataatgtttaaaagatggtactgacatatgaatagatcagtggatctcagatgggcagtgcagaaagagatccaaacacatacaaaaatttagtacctctaaaggtggcatttaaaatctgtggggaaagatggattttccaatgaataatgttgggataggtagatagccatctggaaaaaatgaaagtcaaatcccaactttttaccttttatcaaaatgaacttcagatacaattgaaaatataaaattgagaccataaaagtattagaagaaaaatgcagtttttaagtctcaaaaggggactcttaaatatcatacaaagcccagaggccataaaagagatgattgataaattcaaatataggtccgtgtaagcgaaaactttcagtatggagaaaacataagttattaaggcaaatgacacactaggaaaagcatttgtaactcataacaagcctagttttcttactgtgtaaagtactgccataattgacaaagaaaatatgaagaattggcaagtgacatacatagaaagttcatggaaaaaataactcttaaacatttacaaaattttacaacctctcatgaaaagagaaatggaaattgaaattagagtcacatacagtatttcacttttcatttgtcaaagatcaaaaagtttgaacatactgtgggtttatgtttataaggatgtaagaaaacaggcaatctaaattccttgtagagtgtaaattggtagtaataagagaaaaatttactgaatactttgtgccaggtgcttttctaagcactttacatttaattatctcaattaacttatccagaaagtaccattatttctgtattacacgtgaggaatttgaagaaaagttagacaagtaattcaaagtcacacagttaataaatgacagagtgaagatttgagaccatttcctttttctcaagtgtccacttttggtcgcaactctgctgtttctgtagtgagtgatttaacactatatgataaaaccttaagagtacgtactctttgatccagtgattctacttccagaagtttgtccattttgcatcaaatagatggagaatagcattcattgcattgttatttgcagtaaaggaagattggaaacaacctgaacatttatcctcaaggactcatccatacaaaagaattgaagtaaattcatccagatgaatatgaggcagctttagatagagtgagatggcatcctatgtagtgatatggagtcatctttaaaatacagtaaaaggaaaaagcaagatacagaatagcatgtagggaagctgctgtctatgtgaaaagctgtagaatatacgtgcatttttgtatatgcatagaatattcctagacaaggacaaacatggtggttcatacctgtaatcctagcactttgggagactgaggcaggtgattcacttgactccaagttcaggatgagcctggccaacatggcaaaaccccatctctagaaaaaatataaaaattagctgggtctggtggtgtatgcctgtggtcccagctacttgggaggctgaggcaagaggattgcttgagcctgggaggcaaaggttgtagtgagccaagatcatgccactgcactccagcttgggtgacagagcaagacaccattcatctctctatctcttttctctctctctctttctctgtctacacacatacacatacccccccacacacatatatatacacacatatatgtgtgtgtgtatatatatgtgtgtatatatatacgtgtgtgtatatatatgcgtgtatatagatacatttctagaaggattctcaaagtgatatcagtgattgttgtgcaagaaggaaactagatatcagtgaatgcgctaaataaggtgattttgaattctgtagcatgtgtatgatttacctatagagaaagcagtctagcatgagcgtgggtttctcaaatatagaatgtttgcagtgaggtcacttggtgaaaagtatagccatgtcagacagatgtaggttcagattccaggacttccaggactgctgaaagggaaaggggctttggatctccttcagctccaggcagcattgctcctttcccagctttgacattagctggagggaagacaagttcttagagctctatgtgcttgggacaagaccccttccccctactgccttactcgccaaccataactgctgcaaacaattcttacctcttccaccccatgtcactgcctaaaacccttcatcacctggcctcccatgcctctaagtctctgtacatcccctagcctgatactgtccccaaccctcctcaactccagacaccattttactctaccctctggaattgtccattattagcaaaatctcctttattttcaacctcctttctaagtatttcccccacattcttgttgtaatagagacacagctttcccaggactgtatagctttccttgcagtcctctaaagtggtaactggtttctctgccatacatttcataccactggtcctggagatattgtcaatatcttaatgtcttccttccatctcacttaaattttgagaccataattcctttttcctctcttaaaagttctcagtgttgaagctcaatccattagatacctctagctggcactactagttgcagtcctgtgcagactactgagtcattttctttactccctgaagacttaaactctatcttactctcactctctctgacattactcctattaaaatgttatgtttctttagctattctttcagtttttggtctcctctccttcaacgaggatgatttctagaatgttggttctcaaaatgtggcccctttgcagacatcgtcagcacctgggaacctgttataaatatgaatctgcagaccacaccccagactactaagcccaaaattctgggggctggagcccagaatctatgttttaagaagcacgtcaggtaattctgatgaatatgccagttccttagatcttgttattgtcattactgacaactttctctgagaccacaatttgaatctaccaatttttcactagtactcacccatcttaagtccttactttccccttaccagccagacatttgaatattccttgactcttctctttcacatactatatccaaagagtcaacaaatgctgtcagctataccttcaaaatacatgtagaatctaacttttaacctccactgcagtcacttcagtccaagcacaaccatttcccacctggagtattgcaactgttcttgtttggtggcccttggccctactttatctactttccgcaaagcagccagagtgtttctttcaacacctaaggttatatggcttcattgattgaaattcaccgtgcttcacctctttctctacaaaagccaaagtccttgtaaatgcctgtaaggctcgagggtgatctgaccttccctggcctgtcgtgtttcggtaaaagtaagctgagtctttcatagttaaaggacagcaatattgtcctgcatgatattttaaaaacccaatcaagaatcacacattgcatttaattttcatgcctttagtctccattaaaagtgtgccctttgtattaataattggagtgatgagggacagagtttaagaatatataaatattttgtccccaactgactgtcactggatggctttggcacccattggtgattcttacctgaatcagtaattattgtgatgactgaaaatagtgatttttctcactgtataattcttctatatttattaattaccttaatattatcctatagaacagaatgttcccttctcatcttttgtttgtttagtgtcagtattactcatgaagttgggtgtttagaaaattcaatgttgtataatactgttattattcaatattgtattttctcagtttgagtcttccatctgcgtcctttcatgtaaatagtataaagatcagtaatagaggaacatagagtaaagtgtgagcagagaagccttactctgagacaaacttcagagaggtgaactctgttgctgattaagaaaggcttcactgaggaagtgttgtttgaagtgagctttgaaaagtcataaaattttgacaaaagtggggatggggtggagcttaaaggaaaaactgtctgaacaaaggaaggcccggcagactaggaatttggcaataatacagtggttttggaccttgatgaggaagttgaaatggaacataaaaaccctctgcatttagctccatttatttgctcaggcagctctcactgcctaaaattttcacccctgctgttttgctcaggggtgggatgaggggtaatgagggaggaaattttagggggtgaaaacagcacaagccaaaaaccctgctcagatactcccttctcttgaagccttttccagatccctaataagaattaaccaccctctctcacacactctgttgtactttgtccttctctgttaaccagcctctgtgttttgtgctgtctgtatttgtggatacatcttcctcctttaaagcacgaatcatatcttaatcccttggcccttcttcccagtacttagcacaagtgctcaatacatgtttctttaacgcgtgtaacagaggaaggcgaggagagtgagtgggattgggagcaggaggattctgaatgtcattttaaggggtttgggctcgctcttcaggcagcaatgagccatagccgcctttgaactgtgcagcactgaccagagctgtgatgccaaaggatgcagtggaaggggaggacagccagcatgcctgggcatggtccccaagtcagaggacatcagtgggagaagggagaaggcatggaagcaagtggctaccatcttatgaatctgagcactcattcaaaggtggcaaggaaaaaggaaggcattgagcacggttttgaggtttccagcctgggtgattggaggctgatgcaggcttcttaccaaaaagggccctaggcagtttcaccaggaatgtttaaggagtttatcatgaccctatctcttcctcgtctaaaactctccctaaaatcaaaacagtatgtcctgttgaaatactttattgtatcaaatataatgagaagtaaaatattctctctacttgatgtatgaaacactgacttcttgtagtggacaattttcacttgtctttttagtaatggtttttattaaaaatagatgttaataactgcttgtttaatctttaaacgtggccctctgagagcagcttaccgtaaaagaaacggttgtcagctttctttttgctcctcagtccctcctgccccttcctaacaacagaaaatttgctttgcacctgctccaactgggttcgaagagataagcatcttgcaagcccagaaaattgtagtatcaaatctcagccccaactgtgaggcagcactatcattgaatccctgctgagaggcgttgctttcccaattcccaaaagagttctttctcccctggccccttttcaggcttgaactctgaccgaaaccctctttttaactcccagcatgcactgcacttggtactgacactgacccatccctgcttcctctgttctgcactggactcatcagtaggtcaggcgttggtagccctggggtcactggggtgcccaattccaataatgagcacatttagctaaggagaggaaatgtacccttctatttgttacagtccattgctttttttccagaaacaaatgctaaaagaacatttgatatattgtggtttggtaaatacacatagcactgcctaatattcacaaagttgcctcttttttttgcatcttccttcataaattaaatatattgttctaactcatgatttattttaagagggatatacctatttcacagctaggaaaatgttttcaaataaagttatattcagaatactcttgcaagaatttcaaataaaaatagcaaatactatttaaatgcatataacattctaacagacttgtgtgtcattttaaagggaaagaaaaaaaatgatgacaaggactttacaactttgtctttaaaatttcttcttaggctttccaaacagaccgaagtcattaaaaatactccttaacccccaaagtcacaaaaaagaagctacccaggtttattatgagaaggttgaacctctgttgaagcttgcaggaataaaaactgatgtaacaagtaagtaattttcagaatataatttcaccatctacaaaaacatacaaaagcaaaataatctgaatttgtccttaatgcaaacttgggaaactacttgtaatatctatagcatttttacgtcttcataacctactgcagccagctcgagggttataatttaattatttttgttatttttattagaatattaatattttctctttagaattttttcagatattttttcagacttaaacaattgttagatataattacaaaggaagctgtatacttgtttacatcttcatggagatgtttgctacttacacgttaattttgcagttaggcaagaaattgattttttgctcacttatatagttgatgtctttccatggaattcttccttgggttgttttcgttctgactctgacccctggtggttaggtcaaaactaagcactgaactgctggttttattaatagatgaatttagagatgctagaagcttaaatttgttgtctaaactaagaaatgtacttaggtttgtgccaaggaaaatagaaacttgttaatgctaaacttaatagatgattagtaatatcctttttgatttttttaatttggtagtcacatttctttgtttctttgagacttattttcgtatggtggggaactgagtagaagagtcgatgctatggagaatcgcaaccttcctagctttatttctatgtggcttcgctaacagtggaaatttgcaataaattttaattgatgaaaagtattataaaataagcctactcaggggacaagcccagagtgcaattggaacttcctagtcccagttatagattcctagggaagggattcacagtgatgtggctttactcagctgtaaacaaaggagataagtttcaagatgttaataatatcattgaaacctacacctagtgatctgatggattgaggtagaagaaagttcaaaaaaaaaaaaaaagcaagttttgtaggaaggtcagcccccatgaaatgtgcctataactatagaggttcgagagaaactaccatgaaaaactcaagaggaatttttgaattaaaataaagttatagtgaagaagttaacctttatgtttgtgaccttcggcttatttagaggtgatttacaagtaaaagagaaaattcagatttatgttttctttctactgaagatttccaaagattggctgaaggaaaagtttgagatttgtattagggtgagacaattaaaagttgaataaacatattggcatactcaatgactattttgttcattgcttttacatgtgaatactacaaagcagcttaacatggatattgctatatagcattcacttcaggaatctcattgtatgcttgctctgtgttcaacatagtgcaggatgcgagatgaataagctatcatacttggatgactttctacattattagagattcaaaaaaatgcttaaaaccattataactggggtatacataaaagaactttgatgtctcagaggtgatattttgatcggaagattcaagaaaagcatttgaactaggcagtttttaagaggcagacaaaaaatgagggaaggaagtcaggctaacaggcatgtactgtaaaagttgggagggggggcggagagagagagtgtgtgtatgtgagagagtccatgtgtgttacacccatacatctggagagtttgtgccataactttgctctactttcctcagtttttacattatctgaaatcttactctatcatcataaaatagctgccagtgaatttcatcctttcttattaatatccagtgggatggggagaggtgtgcatatgtgtgcaagagagacccaacatgctttaatcctgaagatgaattaaaatttccttttttaagtttgggcacagatactgtattagcgcagtcaatctggaataatcatttatttaaccatcaagactcttcccaggggctgaggacagatccccttttcctgatgactgaaatgcctcagctgaatctggattctgttagggagaagaaagggcaaaatgacttctaggaaggctctcaacaatgtatactacaggaggtataattccaggttatggatggatccttaagctgcactcagcagtttactcatcgtgtattgatccacagttggtgtaaatttttttttatcatactgttgcaatctggtttggcaaagatgactccaccagcagaattaaaattaaaaaggaagagagaaaaagagattggagacaagaaaactgatatacaaggcctgaactaaggcagaggaaatcatctaaatgtgctttccttcttaattgtattggagacaaaactattatgttctaggatttttttctctaaatttgtaaatattactaagtaccatatttaaacataaaacaatagaatattccgtaaagcaaatttagaatttacttacatttgtgcagaatggctaattattagctgcctaacactcctcctacaggcaaatttataaaattacatcatttgcttataaaaccattttagtatgcatattggctcaatatttatgaaaaatatttcttgaataaacctgtgaatatttgaaaagttttagtcttcctgcctatcttacagtgttatttttgtagttgaaataatatatttgaaactttgtatattatactacagaaaggtggtcataatactgttagtttcagtttcaaaaattatgtcatagtaagatcgaattcgtactttatttgaaagtatatggaagagtaaagcagaaagaggacatatcttctgcatgtccagtgggacattgttttaatgtatccttgtgtgaatgggtgagtccaaatggaattggaattacaaaataaaccctatatgatgagttaattaggaaatagtgctatataaatatgaagtataatatgaagaattacagctagatatatacactataaggtactgtaattttttcataaatttattttaaaaatggatcttaccacattaataaaaacacacttctttcattttgggttgtgctgaaatcctaactacttctgaatatagatcagcatcttttgaaatatttgtgctaaagttgcatccccactctgctaccaccaccaaggtagtatcttatctaatagcatcagaaaaacttccgggagaacctggaaagaattattttttcctaattacctattcgtacacaaatcaaagaagagtatgaacgataagcccatgctggcatatgatatcatttctcttgcttctgaaacaaagcaagttttagagattgtaccattaaaggtgtgacagatattttgaggatcagagatccataggataattcatagtacaatagagtgaaaaagttaaggcagcagagaaatcagactgaaaagaactttcgaggccatatggttcaatttttctccttgtgggtggagcacaggtgtgtggcactcaactttggcttggccacctacactagaggcagagtacgttgttactggacaatactgtttgacattcttatgaatgttcagagttactgtacctttgggcagattagaaaaggcacctcctctgtgctgacttacaaaaaggtgccctttcttccagactaattcatcctttgcttataaaaccatttcagtatgcatattggctcaatatttatgaaaaaaatatttcatactttcaaaatattcatatttcaaaaatattcagcccaaggtcactagattcagcctaaagtcatttgttagattgcaaatccgtcattcccgttagccaagtacctttgtgctaggcataaactgtacaaaatgagaacttgtcagctgacattcgcctctttgtaatttttatgtactagagttaatgttatctcttgtagtaatatgaaataaatgtgccccatctattgtataggagtcattgagatatttgaagagagatatcctgtctgcccctcatctcttgttcacgataggtacttccatcgccttcagttactttttgcattaacagagctgctagaccttatcatggtcattatcattatcatactcaaagacatttatctgaaggaaaccttgatctctgccagctcagggctcttgggagtgcctagtcaccagataattttacctcctgggcagagttgtcaagaaagtggtgtttgttatcattttccccttctttctcctaaaatcacgcttctaacatggctgttaacaagcctcttcatagtgtttctctggttgtttatggctctacttgaagccttccatttcttggaaatgcctcttgcctttctaaatctcacccagcagaaagctaggccatctaatgaaactgtgtcacaaaagattccagtagcctgaggcatcactccttccaattttacctgcattttaatacaaaatctgaaaagtaaatgttcatgcatcatatctagctagagagaaagataattctgtgtaaaagattctttttgttacctcttaaataattgtgggtgtatatggccagtcctgttcccagcattcagatgtgagttaggaagttggaactttatacctggggacgatgaagactcactaatggggtatatacaaaaaagtgatatgattaaatatgtatctgaaaatggttattctggctagagtgggggagaggtttgagggagacaagataaaaggctattgtagtacaggtggagtatcccttatctgaaaggcttgggaccagaactgttacagatttaggatgtttttagcttttggaatatttgcattatacttaaccacttcagcatctctctaatttgaaaatcatggacacaggaaggggaatatcacactctggggacagttgtggggtggtgggaggggggagggatagcatcgggagatatacctaatgctagatgacgagttagtgggtgcagcgcaccagcatggcacatgtatacatatgtaactaacctgcacaatgtgcacatgtaccctaaaacttaaaagtataataaaaaaaaattaaaaaaaaaaaaaaagaaaatactccaatgagcatttactttgaacgccatgtcattgctccaaaatttttagatgttgaagcgttttggattttagatattctggttacagatacttaacttgtctacacatgaaagatatttagtgatcagatcaatcagctaatttagggaattagctgggagaaatggaggaatgctatggcataatttaaagacagaaacaactggccttggccatggagtggttctggagagtggaggaaagggacactctagaaagaagtcattttcctgtcttggggtagatgatggaacacaaaaagaacaatatatttgagagagaatatatttgaaggtatacataatggattctgttttgagcttactaactttaaagtacctacaggacaggaaagaaaatgacatttcagtatcatatcccacactagaattttatcaccaaaccaagaaatgtttccttatgtccaaatcaaatctcacctgattttatttcaggtgattttctcatcaacattgaatatcaaccttaagactttcttgtcttcctgaggaagttgcatttgcaccaaagaggggagggggaaattcccagcagtgagaattgtgttcaaagacctgtaaactgtgaaggcttcacatctcctatttagaaagagcacaggttggcaatctcataggaaaaggcaaatagatgaaagaagaggctgggttacattttttgaaattacatttatctagcaatcctttctttgtttgtttgtagggggatgatttgaatctggctgtcactgattccagggcccacaatagcctgtctaaatacatatttggtcctttctactatatttaaatagtaatccagatcactctttatccttttgcctaacattgttttgtataaccacctattacttcatattataattcattatttcattagcatatattgtctatctccagaatgcaaattcctgaggccaaagactaattcattttgttcattttgctaatatattttatagatgtagatagtcaggttcttttcattttgtttctttgttctagatctttgattttattggacttttgcaatgttacttaaaaaattgctattttcaggcaggttgcattagtgtataatcaaattccacccacaatatcaaaaaaagactattacaaattaaaaaaataaaaatagcattcaataataacacagttctaaagctcattattggatctgaaaaactttaccaatgtaagctttggtataaaagtaaggcttggtgaactgattcttagcataaatattttttcatgatattcttatttttaatgtgtatatgtaagatgttttattttgcattttaaggttgtaagtacttgctgtagttataaatgaatgatcagcacacatcttctttgataacctttcaactttattaatattaatgtttcatatgtagttttattatggctttcttctgattggaatttaatatagagaggttttattcatgtgagtgttaatggcattttgaataagctatgggagaattacaatgtaacactgctggatacagaatgattcttttagacaccaagactaataatttttaacaatatcgaaaaacattgtaggaaaagcttgaaccatgctggcaccagggacagacaagcatgaaagattaatgtaatcttgcatataatgacacacattcttacacaaaaaatccatctgcaatgtcatgtcagtcagcagaaatctttgatgggtggatacagctgggctgtctcttctggcagagctgccctggaaaatgctaaatgtggttgtgatgcttggtgccatctgcagtgtgcccgtttatcctgtcttcactggcatttacgatactgcatagggcatcagtgactgtggagacagcgatacagagtgacagattcatttcctcggagggtctgagctctggtgggcctgtgtgccaccctccttcttgggtctgggtctcttataattggtgttggctttactttgtattttcacatccaactcttcctctttttagtctaacagttccagtacacattcttctggtttgtaaatcttacactaaccttttgactaatttattcatgtaaggttgccaaaccgatttaagattgactgttcaatgccagctaatatgccttatttccaaaatactgctcctcctaagcctctgatttaaaggacatgtgtcttatttagggaatactaaacaggcaccaggacaaattgggtaaccactatgcgtgggatattcccaaatgactttatgtagttgaaacaaatatatgaccttctcttacataaagctataaaacatcaggccagtaacacttagtcctcttgcccatgattaaaatataaatattcaagaataaatgctgttttatgacttgaccatatgtttatcatattattttgccagaacaagttaaaaagtgtgatcattgtttaaaactgtcactttgtgtatgtgtgtgtgtttttttaatagtaatggaatatgaagggcacgctctgtcactgcttaaggaatgtgaactccagggatttgatgggtaggttatattattaatcaatatatgttatatcatttatgtattaaatgccttcactagttttagctacatatttggaacctaacatttaaaaatatttgtagtgtatgtactttggctctatcttgttcatatctatgtaataataattaatgataatatgacatggtcatctatctctcaggatctggcataggaaagcaaaaagaggaatctaattattaaaatactgggaaatgacagtgtactactctatacttactaatgtgcatacatttgcatctataattatttgcttttaccatatatctagagaagcactaatggaagatgttatactggtcacatggcataactatatgatgatcttcttttgcaaattaattgataggtttaatagctacccattggttaacttgtctgtgatagattgagggaagatattttataaatacaagtaaataaatacattatttccagaaacaataagaaataattttaattatctcataatgtagtgactacaatttaggtatgttattcacagtgggcatcggaaaccattgttcgcaatacattggagtgtacagagattgttcactggcatgcaaacgttagaaccaaggcaagtgatataaatttcattgccattttttaaaattaggtgaaccaatttgctaaagtgttggactgatgtgtaagactaaaacatattatattcctttagggaagttctttttacgtgagtagatatttgagaatttaaaaagttgacaagtgtgtgaattatttgtgttacatggtgatgggcagggggcaaagacccataaggtcaggaaagggagttaggtctgtactttcaccaaagtgaaaggcattaaccttcccaaagactgatttgaatgtgctggggagggaagtgatgcaatcaaaatggagtattggcagggctgtttttcagaaatgcttatttatttatttattttttggatgaggagaaaacaatagctgttgagaaagaaaatgtggtaagtaaaacatgatttttccaaaaggaatctaattgagggaagtaaatctagatagcaatattatataaacattgggaatcaaaaatatggggtaggagattacttcagaactttatacttagaggtagacaaaaacattaataggcttcatttagaaaattgtcttacaagtatacaatttaagaaaagtccttgtgggaatcatgcataccaactacctatttgaatatgctgcatagtccctcactagacctcatgagtacatgaaggtagctgcattgcaaatgagtacctgcttcaaaacttgattaaagaatgagaataaagatatcacagatattaaacttgttcttacacagcagcattacagaatgttctgctgaatgcagtatctatcaatatgttttactggtatttgtactgggtaaagggatgaaaagaactttgcagaatgaagaaagacgattgctgaagtgtagtacaataatatttttctctttacctgaacatatttaatccttatttatttttcatggcaggtgttgttatttttcagtgtagagctaaaagatgtatagatttttcagttattatattttataaaccaaatagtttggcctaaccattatatgaattgagttatgtaagtgtttctaaactctatggcatgctgatttatttcagacttacaataatttcaaatttctactgaaagtcatcttccgtgttctaagactctttaaatcaggggtccccaactccgagactgcagatgaatatcagtcagtggccttttaggaactgggaggcacagtaggaggtgagtggcaggagagggatcatttccgcctgagctccacctcctgtcaggtcagcagcagcattagattctcacaggagtgcgaaccctattgtgaactgggcacgcgagggatataactggtcatgcgagggatctaggttgcgtgctcttgatgagaatctaatgcttgatgatctgaggtggaacagtttcatcctgaaaccatccgtctcccaccccaccctgcagtccatggaaaaattatcttcccacaaaaaagtccttggtaccaaaaaggttggggaccactttaaatagcttatttatttttgtggggtcagttttcccagtagaagctgatatggtagttggagtaattatcttaataaactggcaattttaagtcactgtacttagaattacatagagagatatatgaggagaataatagaaacatagtttcttcaggtacttcaaaggaacaattctcttgcaagtaaaattgtttgaaaatggaatattctacattggtgagttttctattcctgaacctgttctaaagagtggctaaaggaaaattttgggggaaatttatagaaaaggtgcagagatgagagaaggttaaccccaaaatgctatggcattttgatgagagacagactcaaatttctttaagaactttggcctgaagcacctccgtctgacactagtggaactattaatagggagtgattaggaaatcacctaacagtttggtttctagatacaggctgaagaagttaagagccaagaaagattctatgtatagtatttagtaaagcaaaacaatttggtaagtaatgtttaagaaatgctatttcctaagattttggagttgtatttattttttttaatgaattacatatgtttctatgagacatcttgtgacatttctaaacccaacagaaacagtgtatcagcacttatgacagctagttctccactgcagtgtgtcctaggaaacactctaagatccactgttaaaccttatgagagcttcagattctatattgctccctattttactgggcatgagtaggaagttttaggaaggaaaataaaagaatatcagctgcatagacttgaagcagtaacacttgcatttataagtgtgagtatagttttaaaaatctatagattttatgcaattgtaaatatatgaattcctcgctattaatatttgtttcagaatttttaaaaaaattgttgagttacttttcttttgttcatttcaccattaattagacccataatgttgtagacattatttggattatattgacattttatcagattgaacatatctgtattacttagtaaggtaaaaagcaaaaacaaaaacaaacttttccagaaagaaaaaaaactgtgaatcaaaactacaacaatatattgaacatttcatagatgatgggttcatagataagtataaaaacattcattaaaaaaatctttatcactctttgaaaaaggatatattatcacccagtgtttcttttctagacagaataattctgtttggagccatggcaaggagtttacttattttaaaaacaagatttgtcacatgcaaaggattagttactctaaggtttatgttttagagtgacacaagtgtgattaactcactataaatgattgaatactttgctttttgcctttcttgtatatttagactcttgtgatatttttgtaagaagctgttgatgaaaaaaaccaaactgtaaaatatttaaagaggtttattttgagccaaatatgagtgctcatggcctatgataaccccaggggggtcctgagaacatgtgcccacagtagttgggttacaacttggttttatacattttggggatacagaagttatagccaaagacataaatcgataaatgtagggtattcattggtttggcccagagaggcgggatatcatggagctggtgggaaggggagctcacagatgaattcaatgattttctgattgtcagttggttgataagctttgctgaaagattagaagtcagcagaaagaaatgcttgagttaagataaatggggtggtgtaggctgggtgcagtggcttagcagtggctcacacctgtaatcccagctctttagaaggctgaagaggggagatcacctgaggtcaggagtttgagatcagcctggccaacatggcaaaaccccatctctagtaaaaatgcaaaaattagccgggtgtgatggtgtgtgcctgtagtctcagctacttgggaggctgaagcaggagaatcacttgaacccaggagggagaggttgcagtgagctgagatcacaccattgttctccagcctgggcaacagagcgagactctgtctcaaaaataaaataaaataaaataaaaaattataaaaataaagataaatgaagttgtggaagcacaggttcttgttatgtagatgaagcctccagatatcaggcttcagagagaatagatggtcaatatctcttatcagaccttaaaaggtatcaaactcttagttaaatctctcctggatcaggaaaagacctggaaagggaaggagattctctatagaatgcaaatttctcctgcaaatgatagctttgcagggccatttcaaaatatgtcaacaaaatacattttgggataaaatactttgatttcctctagggcctgctatttgttatttaatgctataccagagtcaggttggagttggggatcttattgctaccaagtctgttttgtcagtcttatgatctattttttttttttttttgagataaattctcaccctgtcacccaggctggagtgcagtggtgcaatctcagctcagtgcaacctctgtctcccaggttcaagcaattctcctgccccagcctcctgagtagctgggattacaggcatgcaccaccatgctcagctaattttttgtttctttaatagagatggggtttcaccatgttggccaggatgatcttgaactcctgacctcgtgatccacccttggcctcccaaagtgctggaattgcatgcatgagcctggccaatgatttacatcttaatgccagtgctggccatttgcgcctaaactccaaaagacaagagggtataaggaggcatatccaacctcccttcctgttatgacctgaatagtttttcagattttctttgtgaccttcatggccaaaaggggaggatccattcagttagttggcgacttagaattttatttttgttttacaaaacttatttcctaggttgagtcactttacctgaacatgatcttaatgattgaatagttgttaacataaataaatacatattttttctaactcacttaatttcacactggttctactggtaaactgtttttcaaaataataagattctcataaggctatttttattaggtttcatatatagaaaaggtatctaatatattgaataatattgtagcttctaagaccaaaatgtcttatttcaaatccctgttctattacttactagtggtacaatcttgaaaaagttactttatctttctatgttttagtttcctaatctgcaaattgaaggtaatattacctattgcatacagttatttctccacttaaatgagttaatacatggagagtgcttaggaaaatgtctgatatatatatatagtaattattcactaaatatttctttattgttataattgtcatttgtattagtttcaaaagatttaacacagaatgtattatgacaaaatttcagatgtttcagaacatgctcatagggaggccacctctaataactctagcaatatgttaacatatgcatgacgctataattgtatgcaacattctaggagttaagtgttcgcatcctatgtatgtaagggtcaagttatttggtgctaaattagatttttttgggtatgactccacatagtctttttggtcacacccatatgtcagcatttagacagccatggattgagggttacgtttaagttcacagattagaaatctcatagagatttttgaaatcaggtaagtttcaagtcaaaccttggtttttttcattcataaagatgggactgtggcctattttgcagacttctgaggatttaatagaaattagtaaacacattacctgatatatagtttgtccttagtaaacatcattccttttctctgaataggtggtcatattgcgaacctctggaatcagtttagacataagaataaaacacacctaatcaaacatgacctgggtcatatcttgagtcttctaaccagagtagccttggattgcccaggctatgtggagctagtgggatgaggaagatggggactagagggaatagatggccgagagaaagatggtgggaactgactggaaagacactttcagcctttggtcaccaccctccagagcttcctaaacttagagaaccagtaactactgctgactgtggcccatagacagttttgtttgaaatagtgtttttaaatatattgaatgctagttgcttagtatttacaaattaggagactcagccttaaatcagaatctctggcttctgtagaaaaaccagatctgggtccattaggcctcacacgtgatgtgagtgggccacagcaaagaagtggctgcgcctttagattgagcctactcttccattcctgctgggcccttgtagcccttgagttgtgacacctgctttcactgaggcaaaatccactttccattgggttaactggtgacattttgatacgtaagaatattttgcttcttttgaacataaatgattatgaaatgaatttctggtacttctgtgttattttaatggattctgcccccatagtctacttgatataaagtcttaaaaaatatactagtagtactatctaggatcaaaggctaatagtattacatctagaagcaccgtatagcaataatgtcaaggagatgaaattcaggtcaggtttgtaattactacattcatatagtaatgataattagcagtttcttaaagcttcatattttatatgatttttattgctatctgtcttttcagagctttattgagaattagcaggattttatgactttggttggtgttagttaaatgaattgcagatgacagtattattaacaagaaatgagaatgatatgcttttggatgttaacagagcaaaacgctggtcagatgtgaattaacatgttcaaaagttttcatatctcttaacacacttaaagctattttgtctatggggaattatctagttattatatttgtgaagtaaacttacctgtgttgtgtttgtgttgtcttacccattgacacatattaacatgtttaaaggtacatgtgagcagttatgcacatagactacaaattagtaaactattttgaagtctagatttcatgacttattaccaatcattctgaagttttgccttctttgcttgatttgtatttttctagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggcaagggagtggctacagattcattaaactgacccttctccctcttttcctttcttacttgctaatctagacagcacaacacagaattaatgaacagactttgaaagatccagacttctggcatccccactagcaaatgtgagacttttgacaagtcatttaatctctttgagccttatttttctaatctatagaatagggatcacagatatattattcactttattacaaggttattgtagtactaacgtttggtttagtaaagggtttaatatatagttaaaccatcagtatatggaatggttattattctcccttcgcataaaaaatctgttgattacacagtaccaggtaagaagtttcaaaacagggccactccagtctagctgcttacaattccatatgaggtgaatatggtaacttgcataattgatgtataaccagataaccttgagaatgccaaaattacttgtgactggaagggaggataaggtttggaagggtgagattcttaagggcaaggctttttaatctttctactcactgccatttttcagcatctagaatagactatgccacagtgatgctcagtgaagcctattaagtgaatgcatgtaaagaagactttatatagtaaatgacacttggattaggtcttaaaatgggttggagctggcctgaaaaggtgagaatgagttattttcttggctgcaaaagtaataaagcaaaggcaaaacccaggagtgtttgaggaatagtgaaaaggccattcagtggaagataatggtatcaaaataggcccaaccatggaggctcctacatgccacagtaaggtctctgaattgtatttgataagcagtagggaataatgggatgtttcagagcaagggggcaacctgattggagcttgttccaggaggattcattttgcctcaccgtgtggaatgattagaggttgggagcaggagaaagtagaggtcagagacacggagaaccgttagagcaacactgtgatccagaaaagagggaaacatcattcaaaagctgattgtattacacaatcactcatccctatttaacgaacggtgctgggaaaactggctagccatatgcagaaagctgaaacaggatcccttccttacaccttacacaaaaattaattcaagatggattaaagacttaaacattagacttaaaaccataaaaaccctagaagaaaacctaggcaataccattcaggacataggcatgggcaaggacttcgtgtctaaaacaccaaaagcaatggcaacaaaagccaaaattgacaaatgggatctaattaaactcaagagcttctgcacagcaaaagaaactaccatcagagtgaacaggcaacctacagaaagggagaaaatttttgcaatctactcatctaacaaagggctaatatcctgaatctacaaagaactcaaaagaatttacaagaaaaaaacaaccccatcaacaagtgggcgaaggatatgaacagacacttctcaaaagaagacatttatgcagccaaaagacacatgaaaaaatgctcatcatcactggccatcagagaaatgcaaatcaaaaccacaatgagatatcatctcaccccaggtagaatggtgatcattaaaaagtcaggaaacaacaggtgctggagaggatgtggagaaataggaacacttttacactattggtgggactgtaaactagttcaaccattgtggaagacagtgtggcaattcctcagggatctagaactagaaataccatttgatccagccatcccattactgggtatatacccaaaggaatataaatcatactgctataaaggcacatacacacatatgtttattgtggcactactcacaatagcaaagacttggaaccaacctaaatgtccaacaatgatagactggattaagaaaatgtggcatatatacaccatggaatactatgcagccataaaaaatgatgagttcatatcctttgtagggacatggatgaagctggaaaccatcattctcagcaaaccatcacaaggacaaaaaacgaaacaccgcatgttctcactcataggtgggaaatgaacaatgagaacacttggacacaggaaggggaacatcacacactggggcctgttgtggggtgggggaaggtggggagggataacattaggagaaatacctaatgtaaatgacgagttaatgggtgcagcacaccaacatggcacatgtatacatatgtaacaaacctgcacattgtgcacatgtaccctagaatttaaagtattatatatatatataatatacagccttatgaacatatatatatataaaggaaaattaggcaaaatagcattacttgaggtactcaatagcctggcagagcagacattaagggtaagagagactggacttgaatttcagtttggtacttgactttgggtgggtaattagcctttattagtcttgattacacatttaaaaggtttaataaggccgggtgcagtggcttatacctgtaatcccagcactttgggaggccgaggtagtggatcacctgaggtcaggagttgaagaccagcctggccaacatggtgaaaccctatctctactaaaaatacaaaaatgagctgggcatggtggtgtgcgcctgtgatcccagctactggggaagctggggcagaagaataacttgaacctgggaggcagaggttgcagtgagctgagattgtgccactgtactccagcctgggcgacagagcgaggctgtctcaaaaaaaaaaaaaaaaaaaagtttaataatgtccatccccatagggccattacaagaatcaacttttaaaaagtcacacattatcactaaaaaagcaaaatatttttccctatgattatagaaaataatgcacattgttgaaaaaaattcatattttgataaccctattcatttagtatggattttagaatacttagtattgttgataagttgacagagcataagatattcaaatgcccttttagagtgtaaagtctttcagaaagtcagaatttaaaaggagagagatattcagatataatctgataattctagagtatataggaaaacctaaaatggtttctaagtagaagacaccaagatgattttgactcaaagagaaaaatgatgcattttgggccatcttttcatggcattttatttcttgacctttttgctttactttagtagttctgactataatggtggaaactttccaacatttccttccatgcaaagtggatgtgcttaggacacttcattagtacttaaattcctgaggtcattcattgactgccatacatcagaaatagaaagatgggtgtccctacaggtatgcctttgacataaatttggtggttggctataaaaactggtggttattcttatgttttagtatgtaattcagattttataaagaaatagcatttagttttatcactattataattttgaagagtatttctgatttggggagcattttatgtattctttggatatttgtagtaatgccattttaacctgtcttgtttagaagacacagtatgctgccaaaattctggtcattgcataggagttctagcattctaattccatctaataggaggggaaagtcatgtgtggggtatatttaatatgatgactgtatgcctagtcagggcttttgatagagaatgggaactagaactaggcaggaagttttcaagctgaacatgaggagacagtgtgcctttgaagccatttgcctcctggagagagacacccagagggagagtgtttagtaaattaatccactgagccaacagactaagctgctgaattatggtcagactcaaatggatcagatgtggagaagcctgtatttgaactgctggccattaggaatggtgtttgttgctatgggaactggtgctaaggaactatactgagagactctgattaaaagggggagggggaatggagaaaaaagcctgagaggacataaaaataaaaaagcaatccagttgttgtaaaacaaggctcaagccacatactgatggctgtgaaccatatattcctatagagtttgcataaataaattcatgctttccaattaatttgaggagaataaaatattgccgagggactgttaatttctatgatatttcaggcaaagaaccaaagtgtaggtgccgttttcatgagaattttagatatgcttgactaggaagtcattacatcacatttatctgtttggatgtgggagacattaacagccttatgaatattcatggtatctggttaattaagttaattgttctgcagaagtgcttgcacttccaaggacattttttttttttttttttttttgcctccatagtttctccctggtatttcatcagtaattctttacatgaactgctacttctgtccttacttttttgtatttggaacattttagcagctctcaggaggaagtggtaggcaaagtttctggtagtgttaagaaaaataactttcaggctaattaaaatgtttaccttgaggtagaacatttatagcttttgtgagaacattaaaattacgccattgttatttatgtgagcagcatgttcttttggcatgtagacatcttttcaaatagagtacagtttcctgaaacaaaatgtaatccatctttcagattatcccaacaaaatatagaacaagctatcgttttgcaattttacatatactttctcataaactttccttttttcttcagagtgtcaaaaaccacatttaaagactaagatacagattaatgagtagtcaatgactaaaataattttctgacttctagtcatgtctgttatcactgccaacttctacagaattagagaaaagttgcaaagcctgagaagacataaacaatttttaaagccatctctagcattctaaaaaaattttgtacttgggcatacccaccgtacttcaaactcacagggaataaatggtctttattttcttaagtcatgatatgtgtcattctctattgcacatgacattacattatgttttttaatagcctttctagaggaatgcttttacggtctactcataattaaccatggtaatggaggaaatgtgtttcatggagtactgtaatccatcgataatcctaaatatctgactctaattatgtggcctcctccaaaatctttaccacaaatctgattgggaagcacaatggattgacttgtttcttccttttctcctgatccattccagatttattagcaattagatggtcaaagggcaggctgtagagggccacaagatcattggaaagaccttgataaagatccactgagtaacaggtttctacactacttgttctcaaaacttagggtccatagactcaccttgtgaacttgctaaaacagagatacctgggtcctccctcctccaaacacattctgagtccatgagttggaggtagaacccaggaatgtacgtttttaacaagctcccaggtaatgatgctgcttggaccatgcattccagaggagtttctcaccaagtcactgtgcatacaaaccacctggggatctaataaattgcagactctgaatcagtgtgtctggaatggggcctgagaggcaacattttaaaaataatatattttttacttccattaatactgctattactgttttaatacctattatccttatttttaaatggacaaaaattgtatgtatttattgtgtacaatgtgatgttttgaaacatgtatacattgtgaaatggctaaataaagataaacatgcataaaattgacataatgatcacatactgattttacattgagaacacttaaaatctcccttagaaatttccaagtatataatgcattgttactaactattgttttagcctgttctcatgctgcaataaggaaatacccaagactgggtaatttataaaggaaagaggtttaattgacttgcagttcagcatggctggggaggcctcaggaaacttacaaccatggtggaaggcaaaggagaagcaaggcacattcttcacaaggtggcaggaaggagaaatgctgagtgaagtggggaagagtcccttataaaaccatcagatctcatgagaactcactcactatcacaagaacagcatgggggaaaccacccccgtgattcaattactcctacctggtctctcccttgacatgtggggattatggggattaaaattcaagatgagatttcggtagggacacaaagcctaaccgtatcaactgtagtcactaggttgtataacagatctcttgaatttattccttttacctgaaattttatatcctggaccagtatctccccagtccttcccacccattagccccagtaaccactattttactcttcgcttttatgagtttaagtttttcagattctacataaaagtaagtatttgcctttctgtgcctgtcttatttcacctagcataatgtcctccaggtttatccacgtgttgtaaatgacaggacctctttaatgccaaatagtattccattgtgtatataaacaggctgattgtccctaatctgaagacttaaaatccaaaatgctacaaaattagaaatgtttgagtgccagcatgatgccacaactggaaaattccacacctcatgtgacaggtagcagtcaaagtgcagtcaaacctttgtttcatatagaaaaatattttaaatattatataaaattatcttcaggctatgtgtataagatgtataaaacttttatgtttagacttgggtcccaccccccagatatctcattacaccaacagtgtaaaagtattcccatttctccacagccttaccagcatctattgtttattgactttttaataatcgccattctgactggtgtgagtgtggttttgatttgcatttctctgatgatcagtgatatttagctttttttttatatgtttgttggccacataaatgtcttcttttgagaagtgtctgttcgtatcctttgcccactttttgatggaatttttttttcttataaatatgtttaagttccttgtagattctggatgttagacctttgtcagatgggtacattgcaaaaattttctcccattctgtaggttgcctgttcactctgatgatggtttattttgctgtgcagggattgttttcttgatttctttttcagatagttgtaagtgtacagaaatgctactgatttttgtgtgttgattttgtgtcctgcaacttaactgagtttgtttattagctctgacaattcattcatggagcctttagggtttcctaaataaataagatcatgcctacaaacaaaggcaatttagcttccgtatttatgatttgcaagccttttatttctttctcttgcctaattgctctggctagaacttccagtactattttaatgacagtggtgagaatgggtattattgtcttcttgaggaacaagacattgtttctcaactcatgagagtaattttaataagcactcaagtattgtcattcctgtttgacagtaggccgtattttgagtaacaagggtcacagcataacttgccttttggtgaatcagttggaaccagtttgccatttagttaaaataaacttttctttgcactggtattactagaagtaattgtgcttatttataattaataataattaaatatgcttattcttagttacctaaaaaattatgatattaatgacctcttggttgataatggctaagctgcctcagcttctccaatttagcaacccaagtacatatcagttcaaagtaacacaaattgaagcaattatgtatgatcacataggaatgcttctgattaacaaaatccagaggactggtctttgccttcataaccggaacacaccacatgcatggtttcacagctcttggctattattggacttacttattatattctttaattcaagaaaaattgtagcttcattcattctgttcttaataattttaaattctctttagcctcctgggaatgggaagggctagctggtatagtcccctgtatctcagatttcagttacacataaacattaaaggggcctgacttagggcgctctttgcctctgtggactggtggggaaaatccaggtgtgtcttaaattctaataatcatgaaaatcagaaatcataatgtttcaaatacaaatcttcatacatgggaaatacaattgaattaaacattttcttcaatgtaggagacatttgtcagataacagaggggattctcatttggctaagagcttacctctaagattcattaaatgtgtttagagcatattttttgtagtttgtagttattttatttttctgagttattatttggattattttctcttttatttatgtatgcatttgtcactgctccccagaggcacctcattttggcattgaagctaaaaacccattcattaaggttgggatggagtgggctttgatatagctagcatttgggaggtagaaaatagacattcgtgatcaaaaaagctgtaagcggttactataaactatttttaaatttctaagtattttaaatattgaacaaatgtgtagacatttgatgtgcatctatactgtgaataagaacttaaacttctaatattcacattaactttcctgattttataaattctcgtttatttttcatctgaacattgaagaatgacatctacataaagtaaaagcaaatgttagtttgaacacattctaccctaatagtgcatgttttaaaattgctttggcaggatctaccaatgtattggcacattctcttcatggagttcctcatgtgataactgcaacattgcacattataatgggtaagaattcttccaaagcagttcatattttataaggaaatgttgatttatataaggaaggccatcttatttccatcagactttaagaaaaggcaggttctttgtctcttagagtagagaaatgtttgactaaaaaaccaaaaggcaatgctttactatgtggattgcctgtcttttcaaaatacttgctttgtaaagagcagtaaatgaagttttattgtaatctgtacagaaaaaaaatattgtagtgtgctcaaaattataattttataaccagatgaagaacattaatgaatactccttaagtatatccaacactgatgtaggactgtaccaagactctaggactaggattatgttattaatgaaaaaacataaccagaaaaaaatttcagccagtagatgtctatagatattttattatccctattggtaaaaagcatataagctcaggtatatgtaacactaaactactgttaaatctgtgtttaccttgcctatctactttaacttcgtttctttgaccatgttttataggaaatagcaataagctgaaaaatttagtactctgtgtttcttcactagtacctgaacaagttaaaaatggtaattattgtagttataggtaaagggaactgaagagaaagtgaggatgttcatggtctacagtacctttagatattctcctataagccaataaatatgctctcttatgtttgctgttttgatacaagtcctactgtactcactgattaatatttaatgtaatattcaagggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaagtaagtctttttcttaaaccaaaaattgtatcccaggttcaatgactgttaataacaaatttcattacattttagggcagaagactgtgaaatatcatttttaccatttaacagctctgatgatgtgcaagaaaggtaggtaaaaactcaatgtaatacagataacctgtatctttaaagcataaaacattctgacaaacaattgatcagacttaggatctttggttatttttctaacatagtagtaaagaatatagaatcacagactcttacaggtcctagtaagcaaacaactactcactcagcctttttctctttttccttccttctttcctcccttccttccccctgtctctccctccctccttccgttctctttttcccttcccttcccctttctttcctttcctttgtttttttccctttctttccttttccctttcccttttcttttgagtgcctactatatgccaggcactttgaatacaacaatgcaccaaaaaatgaacaaaacacacagttttgtccctcgtgataattttggtctagtgtgtaatacaaatattaaagccatattaaagaagggttatagtctttaaagaaatagtacattattattccttataatactagtttacctttaaatgaatcaacacattatgttggcagcaacaaaattgtacgtttttacttactatctaattgaagaaagtatttaacatatataatgatgagttctctaattttctcatatttaatagatttgtgtgtgtctgtgtgtctgtgcgcgcgttatctgttttatgtctttgttttgttttctttcttttaggagggcacagggatctcccaaatctggtgagtcgaaaagtatctccttgagaactgtgccaggttctgttgacattttgttctggtgagggaaaataaccaatcactttcattacctttagactgtaatgatcaatggcaaatgatccagggtcagttcttgaatgtcagcattatggcaattccttgcctgtgttcagtggcacctagaggcttggcacctaataccaggttagtaagcatttttattgaattgttgatacatttcttatagaccattttttttccagggtatccaattaactgttggttagctagaaacttaacaggtagtttatctttgtatattagagattctaagggatttgtcatcacagtaggttgagaacaactgttgaactggaataattatcagataatcattgactatttaacgtcactgaggctaaaataatatttcctaagttttattgatagaattttatgcctactttacttgatttattcatttagttgtggagaacattatattaaatactgatatttcttgtgaatgtctttgctttccaactttaatgcaaacataaatatccttagcatgaaaatcacacatatgtatatttgatactgtattagtctgttttcatgctgctgataaagacatacccgagactgggtaatttacaaaagaaagaggtttaatggacttacagttccacgttgctggggaggctccacaatcatggtggaagatgaaagtcacatctcacatggcggcagacaagagagcttgtgcagggaaactcctatttttaaaaccattagatctcatgagacttattcattaccatgagagcagcacaggaaagacccacccccatgattcagttatctcccaccaggtctctcccacaacacatgggaattatgagagctacaagatgagatttgagtgggaacacaaagccaaaccatatcagatacttttagtcaaaagaaacatttcagttctatttaatgtgaatagtagtgcatatcaatctcctgcccacattttcaattgaataaaatatgagacatcttatatatatctttttatccatgggatatagacattccttctcttgcacattcttcttaatcagctgtccattatggggctgaaaatatttctttcctgaatccaatcctgtagagtgtaggagaaaggatcgtgagtgttgtgaaatataggcaataaacggggaaatattcaaagttagagaagaaaaaagagaaactgcaaacttcgatattgaaaacccagatggcaaggtcctcattaattacatctagtgctaaaacttcaaaggagtattttgaaccttgtgtgatttagaaattgagcctggtggttttccccgacaccttcagaaatcctagatagctgtgtgctttcataatgtagtttccctgactaaacttgaagacgtggctagctgaccaaggagctatgtttggcaggacttgagacaatgtttatctaaccctgtttgtttaaggaccttcttgggagggtagacctgctcttctgggaacaatcgattcatagctccttcaaagccactccataaatgttctgcttgactagaattccactgttgactctgcaggcttaatcagtattaatgaatttttcagagaaggatgactaattagagatttcttctgtggtttataatcacaacatgccatctttgcaaagaccttttgatcaagactcatttgaccggagatttttcagagatgtagcttctgatgattcaggatgattgaacaggagatttcactttcttctttttcccccaccatgataaataataatttatgttagaatatctcagtgcaaattgccagtaggaactaatattcttatattctaagtattctaagattaaatgtgttcatatatgtgagacatttaaagcagtgccagccatgtaagttgtgtttctatttcaagtaaatattgcaaagcaggcataggatagtgcttttaatgtttataaattatgcaattaaagatgcacagtaacactaccatgaacgttttggtgctgtttatttttaattgggaagaagaagcatgatggaaagcatactgagcacctggagtattggtgctgatgaccattttttctctgtgtgcctttgaacaaatcacttaaacttggagttgtcttttccctctacatgaaatgagcgaatgatgagataatctctaaggtcccttacagctctgacttgagctttcataagatactaagagctctttttttattttgttgttattcttaaattaacttcatgtttgcactgaaatcaagctagaagtcatttgtatgtatttctgcaaactgcattctatagcttgatgcatttgtgagtggctgttttggcactaaatcacacctctgaattttcactctcttatattggatggaacagttatgcaagattaaaatgttcagtcatttaactgaacatgtgtggcagcatttgttcactccatttcatccatccaaaggccactttgatttatttcatttcctatgtcacttagaccttctgtctataaataaatatttaaatcacactttagattttagaaaatgttgagctatttgttacacaacttgtgcatattaactcttctataatacatcttttaacaacatagtttcacatttagaatttctaattacattgtattttaaattatgtcttgatatgtgagtaggacgcttgatggtttgctttgtaaaatgctctaatgtaagagcttattgagaaggaagccagtgatttaataaaactcatttgaaagcctgcatcatttaaaaaatagcaagatacggtttatgaattttaggtaaacgtaacatggtgatttatctatcttgtccaatactttcagtaaacagtatacttgttataaggaacagtatgtcataatttttggtataatctcttagtaaatttcttgatgtctaatagaaatatttaatttcagattaaataatggaagtatggctcttataattgcccgaaacacttctcggccagaatttataaaacacctgaaaagatatgccagtgtaaaaaatcaggtatagtaaattctttttgttacttatttgcaaagctattaatcatgtagaaaaagatgctgcaagaattgacatcgaatcctgcctcataagaaggttttattttcttctgaatatattaatcttctttttcccaatctatttcatccaaattttgaaaagcatccgccaggattaatatagattggccttttttgaatgatgaattagtggttatgtatctgtaaccacaaagataaaataggaaatgtagtgttatattgcaatgtgaaataaattaaggataaaattccatactcaggctgttcttcagaatgaaaagaagtgaaatttgagagtttagccttcttgatattatggcagcagactttctaaagttatgatctttagatcttcctgacatttgtttgcatatctgcattgattgaaatagatctgtagatatgtatttaaaaatatgacagttttatacaaatattcattcaaaatgagaatatgtgaagatatacatttccacttaagtgatttgctttaaagagaaacagtaactattacaagccatattattttggcagctgttttgacctgattattaggaaaatgatccttgaactatgtgaatttctgaaattgtgagtctttgaagtacataggtatggttgtaaaaccctatagtttcacactttttctttttctttctttttttttttttttttgagttagagccttgctgtgtcacccaggctggagtgcagtggcgtgatgtctgctcactgcaacctccacctcccacgttcaagcgattctcctgcctcagcctcccgagtaggtgggattacaggctcacacctccatgcccagctaatttttatatttttggtagagacagggtttcaccatgttggtcaggctggtctcgaaactcctgacctcgtgatgtgtccacctcggcctcccaaagtgctgggattacaggcgtgagccaccacgtccggcccacacattcttaaaggtataaaatggtgcttggatagagttgggagataacagacgggaggaggaggagagtaaacccagccaatgactggcagctgaaccttgcttatgtaccttagccatagcaagtctctccatttttgcctcattatattttaaaactttcttaggccatcttcatgaagtttgatctgtcagtaacattatttgatcctcatgtattgaacaactaactgggctgcttaggaacttaaatcataaaaaattacagtcccactttctttatatgtcaaagtagatcagcaggtataatgtaggttgtgagcctacataacagttttatgtatgtgtttgggtggaatatggagatttattgattttcaaaggaatatatgccctttcacattttaataaatttctaaacattaaaaccaatttttaaaaaacccaaagcactatatattcattgctgtttttaagtcagaaaatagaaacaagaaaatgattttaaagcactcaaaattccatgttcctcaagattagtgtcattaccttggtagaattttttccgaatccttttttattaaataaatgagaagtaaagtaagtattaacctcattcatgtacctctatttgagaacttaaatagtattaacctattaatgtacccctgagaagttctgtatttattttggggaggtgtatgttgcacaaattgtttatggaaggtctcttttgaaattgcctatggggcaagtctctcaggcaatttttgtaaacattcttcttcttcatttttttaaatcaatatacctttcttctgattttaaaagcaatggttaccttacacataaagacagacatacagaaaataataaaaatctgtatcgataggaagacgttttctaagagataatattatgcaggatttatcatattttctcatgtactctacgaggcatatcttgcttttgacacaagaaacagttgcctgtgtgtgattcactggccttaactctgatttatttatcaactttcaaaaattaaaatccatgctattttttttttttttgcaaagaattctaaaatattttgcatagtgtatatagtaagaaagattgattcccagggtgactgctttcaagcaatgttaatttgatttgttaattatccacacaggtgtgtttatttaggctctttccttcatggtgacattaaaaatgtgaatttatataaattttgtaagattatgaaaatcagatctatgtaaaaatcatgtctactgcataattcatagcagtgctggtattcaggaaggaaaatgtggcaattcagtttaaggagagtaacatctgcttctctgaaccatttttaccaggttgaataagcgaatgttactgtataacactgtaaaatagattgaaaccaccatgtgcggagtggctcctgttccttccccatctctgtgtaaaattagatagaggctgaacactacccttcaaagtccttgcagctccatcctattgctttgccccccttctcactgtccacacttttctctttcattgtgaccatttttggtagggagtttaaaaccttaaatgtgagtgcttcccccaggatttctttgcagccctctcatcttctcaggatgccgtctcctggatggcctcattgcccctcacttttgaactgtctgaacatcatgcactcccaagggttctgtcatctcgtcttatctgcaggacctctgtcttcttgtatgctgaagaggttctgaaattcaccggcatctggaggccaacatgtctacagccgaccttatcttttcccctaaagttgttccttctgcgttgctctgtgcgggtcaatggcaccactttctacccatccaggttaccctgaactgttccttcttcctcattcctcactaccagtcccctaacttgttctgttggtctcctcttaaatgtttctaaaatttctccctcaccttaattcaaactttaatcctttcttgcttacagtagcctccttttggccttcaggttctctggtcttgtcttccatacctctttttagagaaacttttttctaagacacacattggatttctctcctgcttaattcttcagtgcctttctcttgttgtcagaataatatggaatatcctcagtctggaacacgtggcctttgtatccaggtccctgcctgtgttgcaaccccacctcttattaccaccctccaccacattcccagtgttttggcattttattcgttggctaaggttgccataacaaataccacagaaaagatggcttaaacaaacagaaatgtatttctttcatggttctggaggctagagctgcaagacaatgtcagcaggtttggtttgtcctgagtcttctctctctggctggcacatggctgctttctcacagcacccacaagtgagtggtctttcctctgttcatccccgatgccttttcctatgtccaaatttcctcttcttataaggacaccagtcgtattggatgagggcctaaagacatcattttagcttaatcgtctctttaaagatcttatctccaaatatagttatgttctgaggtatacagagcgaggatttcaatacaggaatttgagggccaaggggcatgatgttgagcacctaggagtcacactgaattctgtgtagttgcttgaccatggtttgcctctagttttgtaaatgcttcctctctccagactttcttctccaggctaaatcttatatgttctttaaggctcaattcaaatgggaagctttcccaacatccatagcctgtttgcctcctcttgtttcctctgttgaactccacacttgcaccatcatggcactcccctgtatcaaaattgtaactgtttacttctcctccccgtgccccaaacataccctcacacaggatactaagctcttggctcccgaaagtcccacttaacagcgtctgtggcttcacagttaaagcatttgaaggatggctagatcttcattttgtgaggagtgcacatgacaactgctgatttaagataatagacttactggtggtggctgtcaattcttgacattccttggcttacagctgcatccctccagtctctgactctgccatccttggcattcttctctcataaggacatcagtcatattggattaggtcccgccctaatgacttcatcttaagttgattctacctgcaaagaccctatttctaaacaggggacattcacaggtaccaggggttaggacttgaacatagttggggtggtggagggaaatataatttagatcataacaggcagttgtgtgttttaaatgaattatcaactaacatgaatgattatgtagataattctacaaggatgaggcatgtagccaaggctttatacccgaggtaggaggtctaacgcagttactgtcaaacagttttgcttggggccctctaattctgtacctcagtcacaacagctgatgccatcatatcatctactgtttaactgtgtttacagtataaactggaaagttggctggaccttggtatctacatatgtaaaatatgggtgttggggaaaatattagttttctgtcaacttttaaaactgtttcattgaggtttacatgtggaaaaggggaaaaactatgtagatgatgtttaattaggaatgtatctcatgtcatttttctgaaaactgaaatgagtagttatacatttctgctcaagttatttggctatattttcttaattatgtcagaaaatacatagtgctttttcagtatagtttccttaggcaaacaagaaaaaacgcaagttgaagtttaccttgcaccattctatagtggtaagtaaacagtgatcttgcagcttgtgtccattgttaaagtgggaatggggcaggcaaacaccttttaaaatccatatttgattggctttctcttttaaaagaagacatacatcccattttatcttcagaagtttagacttgcgttcttccaaattaaattccaagtgtgaaacttgtactagtttgctttatgtcagctaaactaattgacaagttgataatggattatatgtcttctgtatctacaggccagtattaaagattatctttaattgaaaaatctacagtatcactattttatgtaacttctcacagatatgtactatttgtcataaaacaagatttctaggtgctagatctaaaagaacccaaaaggctttggataagagattccttcttccaaaaaaacttggagatccctgttcatagtctcaaagctattaaaatgtcagcatacatgctgatatttacttgtgagagagggctcagtgaactttgattcgcgttagtagctagagataaaccaagtataatgattatttgtatttatttttagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattaggtaagtctatttatttcaccgcttattgtcaaccagtaaacataaatctaatattacaacgaaagctctcttctctgaactatcaaagcaggcagttggttagtttttaaaaaatcagtaaatcagggaagcataaagagacatgcacaaatttcaataaataaaaagcaactttacatttattcaactgttatgtagacccaaggcattttctttggttatgcgtgtctacattggctttctaatttattgttgtgcataaactacagataatgtctacaacttccattttggatttttaaaaatggatcaagatcttaaatcttttagtggagccatctgaatagtaaagtgttagatttttatccttccatcttagtttcctctcactcataattactgtaacatgttttgttcagtaatttgcttttattaggcctttacagagcattcaacttcccttgggaacaattttacatagcaactggtataaacaggtttaggaacctgcaaacgcattcttggtaggcattgtgacactcagtggttagaagaagcatgcaggggtgcccactagacatgggtgttctagaggcataactgactgttttacagaggtaatggagagcattggacaatcaaggaagtcagttaaggaggttttagagcaattattgttgttgatgatttatcaatcagaccttctcagttttctagattacagctctgttgggaatgctgtgtttgttatcaatttgtatttggcattggcattgtgtaccatacttattaggtgtatgtgaaaaacaacaaaataagttgatgaaataatgtattttctttacagattgcatccaagacttatcagtctttatggaggaagcatggaagaaatgattccaaagtaacatgtaattgtttctaaaagaaatgtacaaactagaattttaatataaagaaatgtggccatgctttaaacctgtggtccccaccctttttgggaccagtttcatggaagacaatttttccgtggatgggggaatggtttcaggatgaactgttccacctcagatcatcaggcattagattctcttgaggaacatggcactctagatccctcacataccagttcaccatatggttcgcacttctatgagaatctaatgctgctgctgatctgacagggggaggaactcagtaatgctccattgctctaacctcctgctgtgtggccaaacggatatcctaatagaaattgatgttactaacaattagcctctagggctttaaaagtcaagatgaaatatcaattcaaattctgtttttagatatcaattcaaattcttttttttacaatgtgtttattggacacacaaaaaaactttgcaaccatcataatacatcaatatttaacctagataattctgaaataatttggattctttcatttttcaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttcttaaagtggtagggttttaaaattcatgatacaagtaacaaagtaagttgataacaaatactattttgaactgggcaaaatctagcccaatatgtaattgtgttccccttgtatctgagaggcctgtgttggacaaccatagtactctgctttcactgtgctcagataacctgaaatatatagttgtttctgagtagttctgagtaggaaagaaccaaatgtaaatttccttagagaccatcctggagaagacagttctaaatcggggcttgatttttcatctatgatcctagatgttctcctgaaagaatgactagcctttttataacgatacaaagttttttaaaaatacataaatgtcataaagtttattcctgtgtatacacactctgggttcaggaggttttgtgcttacatttcactactcaaatgccttcgcaaatctcagaacattcctcaccatcactgcaggcctgtgaacagataactttcatcaattaggatggctggctagtggcagggacttcatataaagaaatctttcccagaattgtttttccacattgccttctaatttgatcactccctataacagatgttcaaaattcggccacagctctcttatgaaggcagagtcagataaaatgatattctgcaattatctagatcataagcataaaataaatattacaaaaatgattgtatttaaagaaattttttaaaatccagaaagtcatttaaaatagaacctcatatagtatgaacaaactataaaaatattttacatttca

SEQ ID NO: 14 - DNA, 145347 bp, Homo sapiens
  mutation 86371: c/t SNP in reverse strand
attgctatttgggcaacaatatggctccttcagaactggtcgagaatttctgtggtctttgcttgaccttcaagttgggagtttcaaatcagaggctttgaagtctggaggagttcgcagccattaatccttccggggttgtgctaaaggcgtttctagaaagagatcggaaagacccgttcagcacaggcccattgcatcttctctttgaaaacgcttgtctgaatcaagtatcttatacagacccgagactgaggggagcaagagcgcaggtccggctgtggcgaggtgtccaccaccgtacttgtggtcaatgcctggactagagagccgaggccgtccagggcgggctggccagggaaccagaagcgtccctggactggctgagtgagggtgccctttccagcaacccagtggccatggttaaaaggcagaatacaaccgtcaaagaagtccccagctcccacataagagagcgcaaaggccaatggaaccaaggcctcctcgcgagaactagctcgctttgaggacaagatcctggggatggaggtggggactgacgtagtgagagggtctggaggaacagtcgtagctgaaggtcaggacatgaagaattgcacgtatggtagggatagaatggcaggtacaacttttctgtactgaaggaactgggagaggacgatccggttagggaggttggggaactaatctcaacgctgcgtttacagatgaagccgcttttatatggcgtatatgtttgcttagaggggccgacggagattaggagaagccatcctttggcgccaatgatcaaagcgtctgccaaggagaagaagccaagggatgggcctttcagagagggcaaggagtcatgctgctctggatgccagtgtcaggacaagaaatcgaaaggagcgaggactcttcactgcgtgcctcagtctccccgcttctgcctctttcacctctgtcctacttccggcgcgaaagcaggccactcgctctgatctagacctagttaacattagcttttcccttccttccctcaaatcccctcccccctctatccccgtcccttctgccgcctgaaagggttaatctctcctgcgggtaaaaacaggtccgcggagtctctaactggcgacagatgggccactttcttctggccacaaaggggccggaatggagcgctccgcggcatacaaatgggcaggtcacgtggttccaggctcttggctggaccgggaagaccatatggcgcatgccggggaggaaggaggaggggcgggggtaggggtggagggtgaggggagcggttgtcggaggagggcgggagacgagcaaggcgtggggagaagtggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaaggtaattacagttctttcatttttttgccccagaatagaagcaataactgaagactgatgaacctacatattctgtatgtgtgcgtttgcgagagtgtgtatgtgtattgagaccagcatccccctccataattgcccataagtactcacacataatgagtcgtgtcactcaagtaccccctgcaggctttctaatttaaattttaaaaatttgggtttcttttgtggatagcataggagcttcttggattttttaaaagaatgcacggtaactatgattatctgctagtgctgattttaaagtcccaaaagcaataatgacttcactttctcacttcttacagtaagaaaaaaaaatctatgttatcaatatatattttgtgtgcatgtattttacgcacattgggagtgtcaagctgtgttttcagtgaatgaaagggacatggataccttgagtattcacaccatggaaaataaatcaggttcagagatagtttagttgagaggggggaaagtggagaaagggagagggactcactcctgctacctgttaccgctccagaggcggccaagtccccagcagccactactggagccagaaattcagttgttttactaaaggctttttattttccttactagaagcggcaacttcgcggttgccaatcgctgaccattataattactcaatcttttaaagggaggtttgaggcgaactttgaaaagccccaataaagagcgggcggccctttcaatgggctgtttattagagaggagccttccgcacctgatccccggcgcgtgggagagcgctctgcgccgcgcccccagccctcgccctgcagctagcgcttttgtacaaggtggaaatttagcggtgggccagagatggaaggcaagaaaagaaaggcgagggaggggtggaagaccctgtccacttttgttgccaaatgttacattgatggtgaaacaatttggtggaaactatttttcctcctttctgcatttgcttttcagtatcccgtcgatgtaatcttcttaaaaatcgctgccagtattagtaaattacgcaatggctgttcaacttaaatcgctaagtatctggaagccaggacagaaatggaagtagaatgtgtgattttacagcttttttttttttttatggagttgtgagtaactttgaacacatttggataaacatgaagtcgctgaaatgtacagtcatttccacacacattatcctgtcgggcaaccaccataaacacatttaagttaatcactaggatacaaacacatatgcgtgagtggtgtacacatatacatattcactaccctcccccagtcctgtcctcactcctacgtactagcggggcacacgcacgcgccattataaaacactgcatttaactttttctcagaggcattcattttgtaatgggcaggtacttttcgcaagcatttgtacaggtttagggagtggaagctgaaggcgtatctggcttttgaatatagcgtttttctgcttttctttctgtttgcctctcccttgttgaatgtaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaaaccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtgagagcaattgttgcatttcttcttaaagggattctgtttttatttttggggaaagtagttgcttttttgctgagttaaaaaatactaaacactatatgtagaataaaagaaaagaaaaaagtttaccttggcatatgctcttgtctgtttatcttgcacagggagtcaccagttctatgtagataatgaaaagacctaactgatatttcattatttggaatatgggactggacggcagtacaaacagtgtgtttttttctttgttttaagtggcttagcctttaggttttttatttccatttttaaaaatgattgttacatgttttcttctatttctttttttaaaaggtggattttaataattattaacaagcaagacataaacaagtatcctagcttagtttgtctatacatttaagatgtataaaacattactattttcttggtcttctgttatctgtacatttttctgaactaaacagttttatcttgcaaactagtactgtcccagaaaaatttatacacctttaggaagtaccaaagggaaatgagttaattaatttaaagaatccaagagaagtaacattttataattgttctattaacatcttgtgatgatttccatcatttttccaagaaaaagcataatggattatttgtactgaagaacacactatttgtactgtatttaggaaggtgtaattatttcctccccccaccctttggggcactattctgttgtttcatgaacacaactcactggaaaaacttatggatgattctgtctattgttaagtccacttcaaaaaaaaaaaaacagtttggcatttcttttcctctggatgtattgactgacagtcatgattcctagggaatatcattttggcacttgtgccctggctctactgtggtgctctgattactgtcattagtaactccattgtttctactctgattcgggtgccacattggatgactaccccccttcccaagcttgttcctttaatctccttctcattggtgatttaggggttccagaaagctgacctcatttagcaagctgctccagaaaaatgtgagtaatgtaatggacaggaacaattagccatactaataacattgccaatgaggctgcgtcaagctgtgacagaagcagtaaggaatacttcgacgttaaaaaaatgtttgagagcaatttaaaatatattattttaacatgttttctatcagccttcatcacatgacagaaatacttttaagttagtcccaactttatctaaaatgcagcaatctcattccaagtgaatcagagttgttattttggaatcaagctgttgctttctatatcctggattgttctcactgttcttactttaagagacataatactgatatgatacttgaatactaccagccttccagtgtaggaggtaatgaagtgagcattcagatctgatctaacctattaagtagctcaatttcacctgcaattaaaattagacatcttcatgcaaactaaaatctgttgctgtagtgaagagaagaaataaaagaatgccattttgagaattccagcttccaaaatagcaaacagggaaatctagactgtgttcttttgtaaggtagaaatgaagactaaaagttaggttttttttttttttcttcccattttgccaatacaacttcattctaaaacatagggattctttcagtcagtcaaggagtaactcacatgccaccatcttttattcaaaggcaggcacagatgttccttctgcaggggaggatttaatttatgaaaatgatattgtttatgcatgaatgaactgcatgcactctgcataacacatagcacttccatctgatcagagaaataccacagaaccagtgccaatgtcagaaacatattctacaaatttactcacttaaatgtttaatgaatatttggaaggcattttcaaaccataagaaacattttaaattatcttcttttatgaattcctacccatatttaaaagagactcttacagtttttgtaattggctaatgcttatacccagtttgtaagaaaagaacatattttactaaatgaaaaccaaccaaaaaaaaatgctggcaagtttggcttcactggaaaaaatatttcgtttagttttgctgtttaatgcttgtcatgaataatatttgggattctatctgtttcttcatcttgagccacgactattcctatcaaataagatgcttaggtatacttgtttaatgtgaaaatcctatgaatagttatttctagaaaaagctggtatgtaaaatcagggggaaatttcataaagatgaaattgggctaaatattgtaacatgcataattactattgaataggaacacttcacataacatattttactttatataaccaattgcagctatatagtatgatctatctacttttaatcattaaaacaattatatataaattaaaatgaaagattataatatcaagagtgttctactaattttaggtttataatatgttacagtaaaataccatttgaaataaattttgtgttctaatttatcttaaaatctctctgtttttacatttgaaagtccttacattcttacaaaattaatgcattttctgaaagaagctagcaattactaaaatgatatatggatcattagctaacagtttgaatcaagctgttttagttctataattatacaagaaatttaaagtgaaaatacctattaagcaattaataaaactaggtttcaaaatattggctaattttctcctaatgggaaatgtaaaatagcaaaactgcttcttaaactacacaaaaacctcctcacttctccttttctctctctctaacaccacttatttcctgaaaatcatctaaataaaatatttaattccagggtctgatgaagaataaaagagccaatgcaacatcttgtggaacaccaggactgagaactcttgttgttaccattgcaaagaggcgttctggcgtcagatgcacagtgatttgtatggtggcataatcattggctcctggccaggcattatgtttcagaggacactattgtcaagaaccattcaactagaaatctgcactgtatgcactcaaaagttgagatcatctgccttcctatgacaggaagaattctgtgctggcaattgactcatggactctcttcacatacactaaggcttggtccagtggctctgatggaattaactgtgcagccaaactagtggcattgacaagacagggccacagtctctggggacttcaggagaaattgctaattttaaaatgcagagtattatgttaatgctggattaaatcttcagatacattaaatgtggatttggccatctaagcattattatgttatttgcccagttaatttagaggtagatggatggtgacaataaccatctctacagatccacaattctaagagatggatccaattgtgaaatgatatggagagatagagtaagttcaatctagcatatatgaagtaatttggtaactgacttttcttttaacaagatcaaaagctaacctgctttacactttcatgtctaaggacagccaaccagagagatggcttcacacactagcccactgctaagtgcttttcattcactttcatatttcatcatcaaagcaccctcctgccttatttatagatggggaaacttcaggaagttgagatacctagatatttgcattcctgtcttcctttcttcattcaggtttttctttcattgccacttcctcaaagaagcttttactgattcccatttaaaatagcaactgacttcaactccaccaaaatcactgtattgcccctccctctttccagagcatttgcctatcaaatgttatcttatgtatttacttgtatagcttaattttaaactatctatctctaggtcttctgagcacctgagaaacagagacaaagttgtctcttctgtgtgttgctgttcctctggtgcttagaagacctagaggatcctcaataaatattaactttccaagggaactgaagagcactaatgtgatgctaaagcctgttgccttaaccactatgctataagtcaaatcagttgagaatggagaggaccacaaattattttcagtccagcaagtgttataaacattaattctataaaaagaaaacaattgaaactaatttcttattatattgcatggcaccaaactccccccacttcctttttgaggatcatgagttgtctgtcattgtttctttttattgatatcaattggttaaatataatctggaattggaataaaagaaaaactattataggctttttccagaccatgtatttcaatgcatattattttttcctttctgttcattattctttcagtaattgcacttgttctatttttagtgttatgtaaaattactgtagctcataatttctattttgaagggttcagtgtataaacttagcacatcaatactatctttttagtgttcgcgctcaatggtgtcagttaagagatcaccatcacttttggtgacgtcaatgaaggggtattgcaatgcttaagagaactgttaatccctttccactggtgtcactaacaattgtagtgcttgtttattcatagcaggtacgtgactaagtaatgttaacatcaaagcagaaagaggataatagagtgttctaaaaagaaaattcggtggttgggtgcagtggctcacacctgtaatcccagcacttttgagaggccaatgggggtggatagtttgagcctaggagttcaagaccagtctgggcaatatggtgaaacctcgtgtctacaaaaaatacaaaaactagtggtgcatgatggcatgcatctatagtcccagctactcgggaggctcaggtgggaggatcacctgagcctggggaggtcaaggctgcagtgagacgtgattgtaccactgtactccagcctgggtgacaaagtgagaccctgtctcaaaaaaaaaatgatttgagataacatcacttgtcattgtttgttaactgaataatctttattctagccagtgcctaaatacataataaatgatagtacaaatggatataaattataactaaacctaagtagtgatatttatcacaatatttctttactagaagaatttctttgttaatagaggcaaggctacttgtttagataccttaaaataacataagatttttggataaataaattaatgattctttgattctgactggcatattaaaaatattaagcgaagagatctttgcttcccaggttttattttttgtctaattaactactggtgcatttatattaaaacatattgtcaagggaaaacgtatatatatatatgtgtatatatggtgtgtgtgtgtgtgtgtgtgtgtgtgtgtgcacacatatgctatacttggttgagtagtatccccttcccttgcccacctctctcccaaatttatgtccatccagaacctcaaaatgtggcctcatttgaaatattgtctttccagatttaattaagatataagatgtaaattgatacaagttcatgctggattacggtgggccctaaatccaatcactgatgtcctgataagaagcagacagaacacacagacacacagcatacaggaagaatggcatgtgaaggcaaagacagagactggagtgatgtgtctacaaatcaaggggccccaaggatttggggcccacatcagaagctgggaaagagacaggaattctcagcttctccttctgaatccctaagaaggaatcaaccctgctgacaccttgattttaaacttcttgtctccagaactgtaatataatacatttctgttgtcttaagctacccagttgctggtgatttgttatggcagccctaggaaactgataggtatactaaaatctctaatgaattgatgttaaatatatataagtataggagagttcatttaaattcttctgaaaatgtcttcttaaacttttaatgatacagtatataacaaccagtatacgtagttggtatcgggtttgacatttaaacaagctgacaaaaaacagctgtttaataaacatctgaattatataaaagttttattgtttattattcatgtgaatgacttaaactgacatctacatttagtgaagtgtgaatgggcctagccaataaactatgggtaatttttttaaagtctcatctttgaactcacaaaaaattatcaaatatcagctattatgtattcttcatgtgaagaaaatgtcatatttatttgatttgtggattagcatatatattaatagagcttttgaaagaacaaatgtagcactttcccgatttcatagacactcatttaacacacaagttcatattttaaagtacataattttaaaaaaattctagtccaaatgaatttaagtgccatgacttctaaaaattctgtctctatttttgggttttataggaccttgagccagtactcttctggtgagcttaagaggctaagacttcacctttagttatatggggctttcatctgattatttgtctattttgattgctctaaatacaagttagtgtgtatttcatctgaatgtatttcattataagttttggttttatgtagatctggggatctgtcttgtttttaatcttgattggtctgtttgttttgggatagttggtactttcatttcttatgcttgctttctttttcattttgtgcccacctttagtcaggtgaacatcagtaaggaataaaattttatttttttaagccactgaaaaaatttaaaaaccacatcataactctgcctctgctgactgataaaaatgctaacttattaagacaaaatgttatgcaagaagactttattggaatagagaaacatcctttttatgtaagaaatatcaacagagacatgtgcctttcttgtgacaaatgtggtatgtgtgtggattagaggtctggaatgtggcagcatttcagtacttggaggggagaattagagtagggtagaaagatagacggggagcagaggatgattctcacccagtagaaagcagagtgaagaaagaaaggggaattgttttttgcattatattatttgaactgtggattaagtctttccataagccatccctacgcctctaagtaggttttattaacttaagctggtttgagatgggtttttggtcacacacaagaattgcctgatacaagagaggctttgattttgttgttgcttgctcatttttatacactaagatggagaaaaccctggacatagtgaagacgaaattgaggaaggtgttgggtagagtggagggtagaagacctgtaacataggtacagaattacattaaactggaaggacttatatccagatataggagtcagggtagaaagagagaatgttagcagtaagggtaacagagtagcagaagtttattcttaccaggtcctgttatgtgacagtggaggcatgttgaccttctgactaggggagttaaaggagaacactgaaggtttagaataatgtctctaaggatagaaagagaaagtttcatcaagactcatcaataatagggcagcagggcttagggccaagcaaattcagagaccatgatattatagtagtttgtagtggtcttaatccatctaatttttcagcattttctcaatggccaatacttagcagtggtagtgttttatggcatttggacaacagaagtgaaagcactggtaagagagacgttgaagtgaaacaccatggggctcagaaaagcagagttgatccatctggtacatgggcaaggatggtcctgaacaattctgcagtaagttggaagatagaaaaaatacctaacgaacttgtagatctgggtaaggagatttttggcagaatattgtaaggctaattggcttctcttaactatatgagatagggttttacaagggagagataagcgagcataatttagaagaactatagggggtcccaggcagactctctggctggaaaattattctgatagcaagaaattagccccaaagcaaagatgaaaagtagggtacttccaattaaacatgtcataagggcaagcctcaatcaagagtgtggctagaaggcacagctcacctggacaaaagtgcttctaagcatattaggagcatataccacaataacctgacttggacccaaagttgagagaggccagtctcaaaaaaatttgagggaattgcttttgcataatatgatactttatatacatatctgttacatatcatatatatcatattaaaaagaaaaaaaaccctgtttttccttccgttctttcatataacccttctgacaacaaatgtggagtttttcacacactaagcaattctttagttcttgctggacacttcctggatgtcctacaattcaactcgattctcacacaactgcccagagtcagtgcagacccgcagattaaaggcttagccccaaaagactaccccccactttagatgtcaatcacaagtctcaacttcatttacttctgaaggacgagctatacattggaggaaacccctctttctttcaataatttgctagaatggctcacaaaactctgggaaacatttacttatggttaccaatttattataaaggatataactcagaaacagccaaatggaatagattcatagggtgaaaaatgggggagaggcatggagcacaactctctcagcacctccatgtgttcaccaacccagaagctctcagaactccttcatttagggcttttatggagctttatcaagtaggaatgattcatgaaatactggcattggtgattaacttaacctccagcccctttcccctccctcaacattgggggtgaagctaaaagttccaactctgtaatcacagggtgagcttccctggcaactagtcccctgatccttagggggcttctgaaagtcacctcattatcataaactcaggtgtggttgaaagggatgttttgaataacaaaagatgcgcctttttcctttatctttctgagttgtttcaggagctagggacaaaagactaatactataacaacaacaacaaaaaattcaatttttgcttttatctcttgggaattacaaggattttaggagctctgtccagaagccagtgatgaagatcaaaatacatatttcttattatatcacaattcacacatgtacatgatatccgtaagataagtgaactacataaagtaagctcacaaagtttctgtaggagttttgtccatttacaaacagtttgtaagctaaaagtatctgtgacaagcctcagtcaatttagaagttcatttttccaatgttaaggacatgcctgtgacacagcctcagaaggtcctgatgacatgtgcccaaggtgatcaggctacagcttggctttatacatttagggagacataagacatcaatcgatacatgtaagatgaatattagctcagtccagagaagcaggactactgaaagtggaggcttgcaggtcacaggcagattcaaaggttttctgattgggaattggttgagttattatcttaagacctggaattaataaaagggaatttatcatgcagatgaagctttaggtagcaggcttcagagacattagattgtaaaggtttcttatcagacttaaaagagtctgttctaacagtctttaggtctcagtgttgatgttaatgctggtcagctgtgcctgaattccaaaagggaggagagtataatgaggcatgtctgagtcccttttcccatcatggcatgaactagtttttcaggttaactttggaatgtccttggctgagaggaggggtccattgagatggttgggtggcttggaattttatgtttggtttacaagtttaacattaaaagcctctgtacctccaatgttttatggacaaaaagaaggctgaaaaagctacttggctgtaatcatgggccatttcttgctgaaaagaagaataaaatggaggcagaaccaaaagcccagaggctagagccaagagctgctgagaatgatgaattagggaaccactctcagagagcagatctggatgtgagataggaacattttctttctcagggtctatgaaactggcaacatatgctctcctgaatttcagaattgctatggaccagtgactgtgatatgctttctatatttttcccttttgaatgggtgcatctatcttgattatcctctgtctcattattgtatgttggatttgtgtgggacgataacatgtgtttttagttcctaggttcccagaataagaggagcacactcaaagagcgacatttatgagatactggatttttcacttgatatcataattgggtgagacttgaaagaaagtgaacatattttgcaaatgggagggatgttaaccactgacaaccacacccacagggtccactgtattagcctatctgcaaagacggctgccaaaaattccttctgtccatatatacattcccttttttaatgtgactgtttcacctgccagcaactgaagggctttatttccatttccccttgtgacttgtttgactaacagcaagaagcaaaagtaatgctattccaattctagacctgggccttaagaggcatgacagcttctgcttttactctcttgaaactcaatgtcattttttaaaagctcaggctagactactcatcatgagggaccacatgaaaagagataggcccagctagtttccacccattccagccgctccagatgagatgccagacatgcaaatgaagccatcttggatatttcagccccagctgagcttccagctaaatgtaagtacattcagttgatacctcatagagcggaactactgagctgacttcatccaactcacagaatcataatgaataacaaatcattgttgctttaagtcaatacatttaaagtttttttgttatccagttgtagatgaattatacagcctggggggaaaaaggagatagcacactgttagttgcctcatcaatattcatccccaaattctttttcctttttagtaggtctcacctcccacctggaagctgaaaacacctttcccagtctctctggaagctacagcacaggcatgttgcccaattctaaacaataggacatgataggaggtctgctgggtgggatttttgaaaatatttttttttctggttaagaaaaaagaaatgcccaaggaaaacctacaaatgccccttccattcttgcttttggacattttttgggagagggtatgatgcttagcactcctgcagccatctcggggccaacaatagaatccttgttgctacctggtgatagtgaagtagaaagctacaaagctcttgatttcttttcttttttttttttttttaaattttattattatactttaagttttagggtacatgtgcacattgtgcaggttagttacatatgtatacatgtgctatgctggtgcgctgcacccactaactcgtcgtctagcattaggtatatctcctaatgctatccctcccccctccccccaccccacaacagtccccagagtgtgatgttccccttcctgtgtccatgtgatctcattgttcaattcccacctatgagtgagaatatgcagtgtttggttttttgttcttgtgatagtttactgagaatgatgatttccaatttcatccatgtccctacaagggacatgaactcatcattttttatggctgcatagtattccatgctgtatatgtgccacattttcttaatccagtctatcattgttggacatttgggttggttccaagtctttgctattgtgaatagtgccgcaataaacatacgtgtgcatgcgtctttatagcagcatgatttatagtcctttgggtatatacccagtgatgggatggctgggtcaaatggtatttctacttctagatccctgaggaatcgccacactgacttccacaatggttgaactagttcacagtccaacagtgtaaaagtgttcctatttctccacatcctctccagcacctgttgtttcctcactttttaatgattgccattctaactggtgtgagatggtatctcattgtggttttgatttgcatttctctgatggtcagtggtgatgagcattttttcatgtgttttttgactgcataaatgtcttcttttgagaagtgtctgttcatgtcctttgcccactttttgatggggttgttttttttttcttgtaaatttgtttgagttcattgtagattctggatattagccctttgtcagatgagtaggttgcaaaaattttctcccatgctcgtgggtaggaagaatcaatatcgtgaaaatggccatactgcccaaggtaatttacagattcaatgccatccccatcaagctaccaatgactttcttcacagaattggaaaaaactactttaaaattcatatggaaccaaaaaagagcccgcatcgccaagtcaatcctaagccaaaagaacaaagcttggaggcatcacactacctgacttcaaactatactacaaggcttcagtaaccaaaacagcatggtactggtaccaaaacagagatatagatcaatggaacacagcagagccctcagaaataacgccgcatatctacaactatctgatctttgacaaacctgagaaaaacaagcaatggggaaaggattccctatttaataaatggtgctgggaaaactggttagccatatgtagaaagctgaaactggatcccttccttacaccttatacaaaaatcaattcaagatggattaaagacttaaacgttagacctaaaaccataaaaaccctagaagaaaacctaggcaataccattcaggacataggcatgggcaaggacttcatgtctaaaacacgaaaagcaatggcaacaaaagacaaaattgacaaatgggatctaattaaactaaagagcttctgtacggcaaaagaaactaccatcagagtgaacaggcaacctacaaaagctcttgatttctaatgacatcatatgggatgaaccaacccaggaacagcctgactctggacctcttttaatgtcagaaataaaatcttatttgtaaaccactcttagttgttcaggttgttgacacaggcactgaagtgcctccaaatggtgatgaataatgaggcaaaagtcaaagacagcaagtctagtgtcaaattttttgatgcctatgggtaagaagttcaagaaagtgagctattttctttctttttaaaatttatttttatttttgtgggtatatagatgtatacattagtcagctattttcaatagtgagaagggatgttgccacttagtataatgcctttttcatagctatcatagaaaccatatatacatatagtatagaaaatgaggatagatttctgacttaaactgcctatttcatttgtgtgcctggttacacctaattcaagactctacaatacagcattgctagcaattactgtgagaatatttcaagctccctatttgctggaaatacatttcatttttttgttccaagtttatgaatattagaacctatctaaaaaggagcttttaaaaacttgaggaaaggaaaagggagggcctacttttcttgcctgtgttatttcttgttactgctgattgagatgctagagatcatattgggtgagatgtgtcttagaatacagctgagcaattcacttttaacagtttccatctgagtacaaaaaactggtatgtgcagaaaacttgatattctgacttggcgggattctaggatttgttctatttttttctgtaattgttgtagggacatatggccctgtaccttttgggcagcaggagccagaatagcaggaacattctgacaaaattcccactcagcatgagagggaagcagtccccttgatacactgatgatgtgcccacttagcattacaagtgtttgagaggtggacacaactaaaactcacctcactcaaaatatatattgacacggagaaagtaaatacaatttgctgttattaacctttcttctcaccattgagacatgttaaatatctgaaattaataaaggaattaaatttaaaaagtttacttatcatgcatttaacacatttattgagcatctgttatataaatgcactgtttcaggcacaagagatagagccataaataagcagattaaatcactattctcaactgaggtactaatctgatataagagaggagacagaaataagtaaacattataaatcaactacatacttttacatggtgtaaagtgcaattaagaaaatattattgaatagaggtcaattttggaatggttgggcagggaagaccttctgaggtgacaagaagttggcctgggcaccatggggagctctaccatggtgaaaagtgttccagacagagtagacagcaacagcagaggccctaaatgagaatgcacttggcttatctggagagtagaatgaaggccagtgtggtaggacacatactaataataggagaaaactgatagaaaagagggtttgagcaggtgggcaggaattggacaacatggtgtctcatatgtcataatagaagtttggattttattctacctgcagtgagaagttcttaataaaaaaaaaattctataaactggagtttgagaaagaactatgttgatgatagcataagccctcaatcacttgtcacataaactccaaacttcagcagagactcagggagatcaaagggactaccacaggattacccactggctaaaattcagatccatggcagttggtcctgactggaattagacttccttgtctgttgccctcattgcagtgggtctgaatgtctctgtcggctgtgaatttttctccctctatctgtggcactgagaaggtggcccagacttccagagtctgtctcattggcctattacttggggatttgctgcccttcttctggaagtttgggtatttgttttcagagcatacttaaaggcctcctgaaagcaatgttaacaatagcaggatatattttacagtcttctactcagacttggatttttaagaaccagggatggagactgtgtttccagatctagtcaaatcccttccaaacataaagcaacaaagtgccttttaaactaggacctgtactgtttaatgctctggaaacaaatacccaagcttcagccaaaggagggaaagctatgttcaggaagcttcctgaaagttttttgaaagcaattttcatgcattagtattttacatatatatatatatatatatacacacacacacacacacacatatatataaacatatatatatatacacatgaatcactaatgagacaattgatcttcaggaactaacgtgaaataattggggtatcttggtattattgttatagataaatgttgaagaagttcattctttcagatattaattgagcacttactgtgtactaagaactgtgatagatactggggatttaatggtgaacaagataaattctctgccatcagggggcttatattctaacaaacttaaaatttactgagtgttctctgtatttcagtattgttactaagtacactaacttagtggggaagctagacaataaacaaagaagtatgtaataagaattaatagtaagtgctgtaaagaatactaaagcaggttatggtagagagattaatggcagcgtgaagatgtccatgtttcaatccccagaacctgtgaatatgttaccttacatagcaaaagaggctttgaaaacataattaagggttatctgggcaggcccaatgtaatcataagagtccttatctaagacgggggacaaaggtcaaagacagaggaaaagagacgatttaaggatagaagcaaagaggagagatgttagactgctggctttgaagttggaaaaagtgaacatgagccaaaacaaacaaaacagaacaaaacaaaatccacaggtgacctttagaaaaggggtccccagtctctgggccatggaccagtacctgtctgtggcctgtttggaaccaggctgcccagcaggcggtgagtggtgactggtggacaagcaagttttaccacctgagccctgtctcctgtcaggtcagtggcagcatcagattctcatagcagcctgaatcctactgtgaactgcacatgcaagggatctagtttgtgctccttatgagaatctaatgcctccaaaatgctcaccccttcaaactgcccccatccgtggaaaaactgtcttccacaaaaccagtccctggtgccaaaaaggttggggactgctgctctagaagccagaaaagaggagatatattttcctctagagcctacagaaggaatatataggcctgctggcaccttgattttagtcctgtgaaactgattttggatttctgacctccagaaatgtaaaacaatgcattggttttgtttcaagtcactaaatttgtggtaattagatacagcagcagtaagaaatgaatacacaggtttacaggatggtgaattatggagggtgctcaggaatggcctctttgaggtggtggcctttaaacagaaaaatgagcaaagtgaaagaatgaaccatctggtggggagaaaagcattccagtcagagggaacagcaaaagcgaatgctctgagaagggattattcttctcaatgtgtttgaggactggcaagaaggctttgtgtgaatgagcaaggggaaaaagttagtaggtgatctcggagacatagccagggtccagattataaaggacctctcgccttgctaagcattttgactttattccaagaataatgggaagtcaatggaaggctgtgagcagggttatatgctctcgttattttttaaaggcacaatgtaactccaaaatggaaaattggctctgggctggaggtgccagcacaggggaaaccgaaagcagagagctgggttgggagagcggagactgaagttgtccagctgaggggtgcagaagtgcagactgcaatgacagcaggcagaaaggactatatgttctagacagaatggacaggatttgctggtagattggattgaaggcatgagacaaaggagacatggatgatatcaaggattttgatactacagatttgaaacattctgagagggacaggtttgtgatggaaaatcatgagtctggttttagatatgttttagaagcttattggacagccaagtagagatgtcaggtagggagctggacataatacctaaagttcaggagagtggttggagctggtgacatcatttgcagaaccctggatggtacataaagcacgggacagtgtgtggatagatcctaaagagagccctagggcactccagccctggaagaaggcagcttatcaaaggaaaaagaaagaaagaaggaaacacaatccttattacttccatcttcaggacaattcaaagccagtgtttttgacttcctggcttgagtgaagcttgaaaaatggcaacttgcccctttgcaaagctcctaaggagtagccattggcttggcctgtttgcactggctctgggtgagcttttaaaatgccagtgagctctaattgtgttgattgcctaacagctgtgaatacaagatgctgactccagaactgcaactcattctgcgaagggcaccgtccttttccctctaatgactgctgaacagagccacctgaagcctgcatggggtttagcagcagctgcacttctgctctaagaaatagctcactgcagtcagatcaaactgaagctcttccttgcttttcctcgaagcttgggtacttattgtcggagcattaaacagtaagagtcctagcttaactggtgcacagtgctttatgtttggtagggatttggttaggcctacaaaccgtctgagctaagaaccttgagaaactcctgctatagttagctctttctgtgactctgcagtgtgaccaggaatgaggacagaattaagaatttgctgcctctatgatagaactgtttaggcactagaacactggaactagatctacaaccctatgaatttaatttccttttcaactcccctactccttcttttcaatatgatgataatgatcttgtttaaaaaaaaaaaaagccttctgctttacttcccactctgctcctcttcccagggactcactttcttcttgactgcttccccattacaagtactcagctccctgttttatcaccctgcttagagcagccattatcagccttggctgaacattggaattacctgggaacttttaaaaatccggaagtctgggtctcgcctccagagattccagcttagttgtcttgagcgtggcctggacatttgggttttcaaaagttccctatgtaactttaatgtgcaaccacaattgagaatcactagcctccagactctctgtgttatcaaaattaatgagcagctgattttagaaatctcagttatcaggagaaaagggtgaacccccccagggctcttctccttttccaggtgacacttctttatggcagtgcgtgaaagtgaagccctgctgcttgtaatctccctcaagggagtgcaagatccaggcaaagacaagactgcagaggcgctaccttgggggaaagtaggaccctaaatacttacacctggaggcacttacctttaatactgaatttgtcagatgcaaatttgtctatgcaaaccagggccttatctctagcttcccctcaggggttttgggaagtgcgctactactctgaaacagggttgtaaagcgtcacctgtgctctccagggaaccctctggaaaggaggtggaaaaacagaggcttccacccttgcaactctaagtgtgttccttggccagtgggatccatcacctagtattttcttagatatgtggtatctgggggccagtcccacacctatgcaataagaatctccatttgaacaagatgcccaagcgattatatgcaagtttaagattgaggagggctggtttaactcgagggtaacgaaaagtacgaaatcgtactttacaggagaagctaggcggagggagccacttattcttcctcttgcagctgggtctttttgtggtgagtggcgaagcggcgaggctggcaggccagggtgctggactgggtcaggcgcggccccgcctccctcctgggtccctgccctgcgcgccgttgctgtggcagcgctggacgcggctagagctggggctgccgcgccctccacctccttctccaaaggcctccccggacccctggctcgggcccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgagtgcccggccccaagcgtcttcgcctccctccgcgcttcctccctctccccggcccaaggcctacacccacgagcttttgctccaccctccccttttctcgcctcccctccccgtgctcgcctcactgcccggacaggttaccgagtccccaagtcgccgcctcctccttcccaactgggaactcacgcctctcgccccatcccagaacccccagggattctttcgctacctagccttttcccgcctccgagaccttccccgggcaaacgtcacaagcagcttttgctcagagtctcagcagaaaatcttgagccccaaaggggaggtaatttacaaatgtgagaaggtcaactactcctcccctccaagttgaaaaagttttaatccattaactttgatggtacattgaaactataaacatctcacagattatgcctacacaagagttctgaatccaactctcattttgctgacttgaaaatgtaactccagagctttgggagtgtttctgggtttttttctgcccctcaccttccttgccattgtctagaattaagacttcttcaggctcggtctagaaacttttgatttttaatattgaccctagattattggatcacagttttgcgatgcttagttacgtcaagcggtttgcttaacgtttgccttttattgacttaaaattttagttacctaaaaaagttataatgctgtagtttacaacaaatacttcgagtctattttcacgtcttagtcaaatagccttatagacttaacagatattttataaagaccattttgcaagtcttataagtagactttcatatagtcttatttctaagtccaaactcgagaaatactccccattgttgaattagcttagatgtgagcggtgaaagacagatgaaatgggggaggaactacatcaaggttactctacttgcgaggagatgacttgggggagatggaatttggtattcaacctcttttagctaaatacaaatttatgaaattaaaaaaattgccttcccctgttggaaaacaagacacagtgtggtatttatgttacagaatagactcactgtcttaaagtcttgctcaaaagtctaacaaaatgaaaccaactagccagggattcagcactggttgcgattgtgaattctgcctgtgctgcatgtgccatgctcgctcgcttcacgaaaacagtctttgaccttaaagtgttttcaggtgttttaaaaaccaaggtgtagtattttcttgaaccttttaagttaaaagctagggatatagctatggaattatttgtaagtctttcaggcaattcgagttatgcaatatagaagtttataattacagtttggattagcccaaagagccagtttaacctacagtgcagctgaaatgctatagaattaaaatgagacattgtgcaatgagaggtcatacaaaccaatgttgcagtatttgtgtacaaaaaaagcaaacaatgacatgagaaaagaaatgctgttttatattgagtggtgattaaggtaaaataggtttaattagtgcacccctggcagtagagtttaaaatacatcttgacagatttgtaactttaaaggttgcaagtactgattctttgtttaattatgccctaaaaccatttggtggtcttttccttcatacaggtgtaccctttttctttgtaattaatacctggtattcaaaccactttgggcctctaaaattgggggcacagaagcctagagccttagtaagtacttctgtttatggaagaaaccaagagatgttttatttaggtaaaatatagccaggcgtggtgtgtccctgtaatcccagctacttgggaggctgaggcaggtgaattgcttgaacctgggagttggaggttgctgtgagcggagatcacaccactgcactccagcctgggcaacaagagtgaatctccatctcaaaaagcacaacaaacaaacaaaaacaaacactgggaaataagaaggagatattaagagatgatatatttaaatgttagaaatgctctgttgttgaataagcttagatgtgagtggtaaaagattaaatggaagagggagctacatcaaagttactgtacttgggaggacatgatatggtaggatgtggtggggggagagcatgtccattgctggttggcaagtgactggctgcctcagaaaaggatgagggtgggtaggggagatcactggagattattagaacatacgtatgttttcaagattgcttagtttttaaacctcatagtactttgttttcactgatgaaataaaatactatgtgatctttttctaattttccatcttgagtaataagcaaagacattaatgtattttatgaaggctctgactgccaaaattgggacaaattgatggtcttgttggcagggtaaatgagcataaccgtagtaattgtagttctttttattgggttcagggatgacctggaataatggatgtgttattacccttccctgtagaagtgaggctttcgaaaagaggctataagtcaatttgggaggcacaaagtatcagcgctttttggggattttttttttttttaagtagagaaatattttaaatgtgtgatataaagttatgcatgtgcttcttaagcacattaactcaaccagatccaacagctggtctaataactttttaattgtttaaaaaaatttaattgacacattgtaattgtatatatttatgagatactatttgatgttttgatatttacgttgtacaattatccaatcaaagtagttagttatccttcacctcacactttcattatttccttgtgggttagaacattcaaaagactctcttctagttattttgtaatatatagtattttactgttaaccatagtcaccatactatgcaacaaaacaccagaatttattcttcctacctagttgtaactttgtgtcttttgactaacctctctccatccttccttctcccctccccttcccagtctctggtaactattctaatctctgccttatctatatcaaccttttataatagaaaaagattctacatgtgagtgacatgtggtatttgtctttctgtgtctgggttacttctcttaacacgatgtcctccaggcttagcattcacaattgacaggactttattttttaatggctgactagtattccattatgtttctgtatcacattttctttattcatccattgttgtacgcttaggttgattccatatcttggccattgtgaatagtgctgcagtaaatatgggattgcagatctcttcaacatactcattttatttcctttggatgcatacctggtagtgggattgctggatcatatgatacttctatttttaattgttttaggaacttccatgctgttttccatattgactgtactagtttacaatcataccaccggtgtgtaagtgttcccttttctccatatctgtgtcagtacttattttcttttgtctttttggcaatagccattctaactggagtgaggtgtatctaattgtggttttgatttgcatttccctgatgattagtgatgtcaagtatcttttaaatgcacctgttgatcatttatatgtcttcttttgagacctatcaattaaagtcgtttgcccatttaaaaaatcaagttggccaggcacagtggctcacgcctgtaatcccagcactttgggaggccgaggcgggcagatcacgaggtcagaagatcgagaccatcctagccaacatgatgaaaccccgtctgtactaaaaatacaaaaattagccgggtgtggtggcacatgcctgtagtcacagctacttgggaggctgaggcaggagaattgcttgaacccaggaggtggagattgcagtgagccgagatagtgccactgcactccagcctggtaacagagtgagacttcatctcaaaaaaaaaaaaaagtcattattattttatctgttgaattaattttcttatatattttggattttatccctttgtcgcatgtatagattgcaaatatttttctcccattctgcagctgttttcactttgttaatagttttcttcaaggtgcaaagttttttagtttgatgtaatcttattttgtctatgcttttgaggtcttattttaaaaatccttgctcaggtcagtgtcgagaataatttcccttttttcttgtaatttcatagttttcaagttttacattttaaatctttaatctatttttatttttgtatatggtgagagggaggggtttaatctcattcttctgcatgtgaatatctgattttcctagtaccatttgttgaagagactgtctttttcccagtgcatgttcttgacatcttaaaaattcagttggctgttgtaggtgcaaaaatttatttctgggctttccattttatttcatgggtctgtctggttttatgctagtaccatgctgtgttgatatagttttatcgtatatttcgaagtcaggtagtatgatacttccagttttgttctttttgctcagggttgctttggctatttggggttttttttgtggttctgcatgaattttcagattgtaacatttctgtaaagaatggtgttggtattctgatagcaattgcattaaatccatagatcactttgggtagtatggccattttaacaatataattatttcaatccatgaacatgtactatcttcccatttattgatgtgggaagataatttctttcatcaaagttttatacttttcagtgtagagattctttcacttccttggttgtttatttctaggtatctttttttttaaaaaagtactataaatggaattgttttcttgatttttcacatagtacaatattagtgtatagaaatgctactgatttttatatgttgattttgtgtcttgcaactttactgaattctaacagttcttttgtggagcattttgggttttctatctataagatcatatcttctgcaaacagggacagtttgacatgcttctttctaatttggatgctcgttacttctttctcttgcccagtttatctggctagaactttcagtagtatgttgaatagaaattgtgtaagtggccatcctttccttgttattgatcttagaattgatctcgttattggtcttttcccattcagtatgatgttagctgtggatttgtcatatgtggcctttgtgttgaagtacaaactttccatacctaatttgttgggtttttaatcatgaaattatgccacattttgtcaaaggcttttaatgcatctattaaaatgatcatacagtttttgtctttgttaatgtgtatcacatttactgctttgtgtatgttaaaccattcttgcatgcctctgatcccagtgatgaatcgcacttgaatgtagcaagttatctttctaatgtgctgttggatttggtttgctaatatcttgagaatttttgcacctatgttcatcagggatattgtactatagtttcctgtgttgtattgttatctgattttggaattagggtgatgcttgactcatgaaatgagtttggaagtattccctttgcttcagttttctgaaatattttgagaggaattgatattggtttgttaaatgtttggttgagttcagcagtgaagccattcgtttctgggcctttctttgatgaaagactttattactgattcaatttcctcacttattattggtctggtcagattttatgtcttcctaacttaatcttgataggttgtatgtgtcggggacttcgttttttctatgttatcaaatttgatgaaacttgttgaaaaccaactctaaattttgttcatcttttgaaattatttttagtctctatttcatttatttctcctctgagttgaattacttccttacttctaccaactttgggattagtttgttctgttcttttttttctttctttctttttttttgagatggagtttcgctcttgttgcccaggctggagtgcaatggtgtgatctcggctcaccgcaacctctgcctcctgggttcaagcaattctactgcctcagccttcctgagtagctgggattataggcatgtgccaccacacctagctaattttgtatttttagtagagacggggtttctccatgttggtcaggctggtctcgaactcccgacctcaggtgttctgcctgccgtggcctcccaaagtgctgggattacaggcatgagccacaatgcctggccgattagtttgttcttaattttgtagtgccttgaggttcatcattaggctgtttgtcagaaatctgttgtcttttttgatatgggcatttaatactataaacttacctcttaaaactgcttgtgctatgtttcgtaggttttgttatggtatattttcattctcacttgtctcaagaaaaattttaatttcctttttaatttcttcactgacccattggttgtttaggagcattttgtctccatgatttgtgaagttgtcagtttttctcattgttgatttctagtttatttcttttctttctccttccttctttccttccttccttccttccttccttccttccttccttccttccttccttcctccctccctccctccctccctccctccctcccttctgtattgctttgtctcccaggcccaagtgcagaggcacgatcttggcttactgcaatctctgcctcctgggctcaagcaatcctctcacctcagcctcccaagtagctgggactacaggtgtgtgtcactgtgcctacaggtgtgtgtcactgtgcctggttaaatttgttttttgtttttgtttgttttgttttgtatgtttagtagagatggctttcgccgttttgccatgttgcccaggctgttctcaaattgctgggctcaagcaacctgcccaccttggcttcccaaagtgctgggattacagccatgagccactgcacctggcctgatttctagtattataacgctgtggtcagtaaagatacttgatattatcttaatcttttaaaatttgttaagacttgttttgtggcctaacatgtgatctctcctcaagaatgttccatgtgcatttgagaagaatgtgtatctgcagctgttggacggaatgttctgtaagtgtctgctaggtgcatttggtctatggttcagcttaagtccaatatttcttgatctctctgtgtgtgtttgtgtatgtatgtctagataatttattcattattgaaagtgggctgttaaagtctcttactattattgtattggagtttatctctttaggttgaatatttgctgtatgtatctgggtacttaggtattaggtacatgtatgtttataattgttatatcctgttgttgaattgatccctttatcatattatgaccttctttgtctctttttacagtttttgacttaaagtctattttgtctgatatgagtattgctactcctgctcacttttggattctgattgcatggaatatctttttccatttcttcactttcagtctgtctttaacggtgaggtaagcctcttttaggcagcatgtagctgagttttttttccagtcctgcagctactttatatcttttcattagataatttatttacattcaaggtttttattgataagaacttatttctcccattttgttacttgttttctggttgtcttgtagattctcagttcttctttctctcttgtttacctctgtggtttggtcattttctgtggtcctaagctttgttttccttctatctcttgtttatgtatctgttgtaattgctttctttgtgggtaccatggggctaacataaaaagtcttgtagttataataaactattttaagctgatagcaagttaactttggtcacataaaaatactctagacttttttcctccgccatccctaatttatatttttgttgcctttatttctttagtatgtgttccctagccattgtagctgttgttgtttttgaccagttgtactttaaaccttcatctagaggatcgacaggtttacatagtaacatgatatcactggggaattctgagttggatttatacatttacctctattggtgaggtttatattctcacatgtgttcatgatagttatcattttttcatttacagctgtagcactcctgtaaacattgcttgtaaggctggtgtaggagtgaattccctcagcttttgtttgtctgggaaggcctttattctcctccaggatagttttgctggatatagtatcttttgtccttggccgagactcgtttttttttgttcttttagcatcttgaataaattatccctttctctcctggcatacatcagtaatttaatgttactgatgagaaatctactgatagtctaattaggattcccttacatgtaacttgatgcttttctcttgcagattttagaattctctgtcttcaacttttgacagtttgactataatgtgccacagagagaatctttttgggtttaatctaattgggaatctttgtggttccttcatctggatgtctatatctcccccaatatttgggaagtttttagctattatttcattaaataggttttctgtgcctttcttcaacttttctccatctgccagttctataatgcaaaaatttctttgcttagttttttttaaactttgggttatttcacaaaacctattttcagattttgaaattctttcttctgcttgatctggtctattcttgaagctctcgattgtgtcttttattcactgcattcttcagatttctgtgttttaaatgatagatcttgttttaatttctcattttataactttcctgatttcattgggttgtttgtattctcttgtagcctgctgaatttttttaagatcattatttttaattttgtttcaggcattttataaacacccttttctttggggtctgttactagagactcactgtgttcctttggcagtgtcgtgtgtccttgctttttcatgtttcttgtgacatctgcacatctagtggaatagtcacattttccagttgtatgcagtagctttcacagggagagacttttcctgtagatgggtcctagagtgttggttgggtatggtacattggctttggtttggggtggattcagtaccatggtctctgtgtagtttcgtcagctgtaatcttcacagcaatgtctgatttcctcagtggcctaggctgcaggagtttttgatggtggtatagttttgctagggacaggcatgtcatgctagttgtcaggctggacacttgcaggctcggagggctgacaagctgtcttttgggctccccagggaagagaaagtatgattttccagcttttcttctatgtttatttaaaactttgttgtctggctcacagtgttctttatctaaagtctagccagtggtggtggtcatattgcaatcattattacagcttcagactttctagaccttttccattttagtgaccttcagccttcattcgcttccattcatgaccacagaatagatgtagtcatctctattgaaggcaaacccatcccatctcttcagcttcatctagaaatttgtttcatctgttacactttctttctttggtttttagccttcattctctaccagctctttcacttaagcagagatatgttcaagactctcccattctaacagttccctgccttgatcctacaagcttttctctttagctgctaccttgctttttatttttatttttttctcacttgctctgataatctcctagaaaaattggcttactctgaccatctccattagttcacctcttaattattcttcaaccatctgagacctggctttgttctttctctactgaaactcttcaggcagagattagcagaagtcttctaattgctcaatgaagtggaaattttcagtccttattttctgtatttctccttcatttgactttgacttaactctcttggtttttgtaataccaccagcacctagtttatcagtctctcatgggaacttcattctatctgcctgccaaatggtggagtcccaaggactgtggtctgatctgctgttcctcattacatgctttctggtcagtattgcacactgtggttctcatctaccatcatctacctccagaagtgccatatatttagtaagtttacaagaaaagcaactttccttgctccgtagactaactctgatcttttgttccctatcatggttatggaactcactaattattcagcatcagctgtcagaatgtttaactttgctatttaggtttgtgtaagttatgggacaataactaggataactagaattagcttgtagcttatgtgggttagataatacaattgcatatgtaagtagtgaatattttggcttaataagtgaaggagtatttaggaagctatctggaatgttatctaagtcaggattctgaaggtaactctagcctcactgtcccttactcactatttctaaacacccaccaatcctgcctactttatttacttggtatttctccaatctgccatccttctctgtccgaccaatcactaccctagctcaggccttcaaagtctctcacttgacctactccttcacctcctttgaacctgtgcacaaatgttagcttcttagtaaggctttctctggtcacctgtataaaattcccatctgctacatacttcctggttccctgtattgccttatattcctcagtggcatttatctccttgtatactatataatttctgatctctgtcctttctattaccaccccacttcaagatggcaaggatttgtctgttatattagtgactgtcctaataggaaaaaaaatggcacatttatattagagtaacttgagaagaatttttaaaagtcagtatttataaagctgtagatatagagatagtgaagtactcttgggactagtaatcattgggcaggtgataccatttttaagcccaaaagggcatagtgaaagagcaggtgcctgaacctggattcagagagactatgtagaggaggccactaggcaggagctgtggcctttgcctcagcttggctgattacctcactaatcctcactaatcctaaattacccaagttccttcttttctggcccatttcacagtccaaagccaactttaagccagagggcaaggggagcacttgatgcagtccatgcagtatggcctcccagtgaacagggcaggtggaggatagaaactaaatctagatggaggagagggaagatattcagaatatgttttttctttactgtcagcaccttgaagagtgcctggcatatagataatatttattgaatgaatgaatttgttactggtttactggcctcatgaactttagttttgcctattctattataacttggtgactacattcctatatacttgataccaactcctcattaactacaaaggcagtattcccctctccccctttttaaacatcaaaactcttttttaaaaaaaattcttaaatgaatcgccagtatataacacataaaagtatgggtgccttgattggagtggtgggtaaatgatcctgagtctgtctgtttgggttccctctttgcctagcaggaatgtgactgtcttgtttaaagcccactgaagtagaaaacaggatgagagacacactcttcaacatggcataagatttccatgcttggctcctgcctatctctgcatcctcatttctcagtagtttcctcatattttaccatcctgtaattgaaagaattacaaaactagttctctacacaagctttcttgctgttccagctgctgggaattagcttcctttgtgcttttttttatttgaatgattcatgtttacattcattaaaattaatgaagattcattacagttgttttctctttaggcataattggatctcctatactgagacattgaatgcaactttgattgtttttttcccccattatatgttaagctccttgaggttcttttcaactttgcgttattccaggatttctatcgtaagagttaaggttcatccacttctctgatgtgaggttcatggcaggaaggttccatgttgctcagctgcagagtagaaaatactgagcagggcttaaatagattaggatgctgccattataatataaactgtgtttacgaaagagcatcatcaattcagaaaatatctttttcattgactacagtggtgcctgatgatctttctattacaatcttaaattatggtcattttaattatagaatcatacatgggtttatttatgttaaaataaggtaattatcaagctagctgtgacctatgagaaaaatcctgaagaaatgatgaagggatcaggtgactgtttttgaagtcaagtgtgaaaggtcagaccactctgggtcatgggaccctgccaaggcagagcaggtcaagtgctgtgcccagtggggccaacccccagtatggtgccagggactgggtgtgagaagtcaaaaattaagaatacacctcagaaaggggacatggacagatgccacagacttatttgcgtatttcatgatttagcccttagcttgtgctgatactggatcagatattttcagagttcagtattttcaaaagcatcgctgatcacctgttggcattgttttacatctcaaccaaggaaaaacttttgggacatctgtttaacaaggggtaagcttttatttgaaatgttcgattaaagcagaagagtcaggcatttttttgtgcctccccaaagaaagatttgtttactgtcctgtgtgaataaatataatgtcattatttcccgtaaaggaaaagctgatggggagagtaagtaatgggtaagattaggcaatgttaagctcatatattagtatgtttaagagtgatcaatttagggatctctgtgacagagatgccaaatgctcacagtgctatctcatgttggaaacatgtgtctcctccacttttcctcagtcctctgaaatgacggccctttagggattgacagatactatacagatttctgtgctgatatgtgatttgtctaaaacaaaagtttcacaaaacaattcttaccattgccatttaagagtcactctgatatgctctgtttccattgcaaacaaatgctcattatgatttgtgaaattaacttcacaatttcctaatggataacaccttgaagtatgaaaagcactacaggatcttttatagcttccctcctccagctctctataatctgctcccatctgtggtgtaggaaagatttcagcagtggccgctgaaggccctaagatcttgtctcaacagatagcaaggtgcataacagactttggacaggttgtttaacatgtctgagttactgtttattcactggcaaaatgaagggcttatattatattgtctctaagtactatcagttctgaccacctatgaactttcattttaaagaaaatacctatttctatggcctttaggcattagggaattttgtcaaattaaataaatctcagtaaggtttgatggtcaatggggcccactgtctggtgtgtgtggaggggtgttgtattttacatcaggaacttcagagccctcatgaatttctaattagaggaaccacctgggaaatataagtcaaagccctttgctcgccttactcagctttagggcacagtgactagaggtgggcaatcgctttggtgtaggtattgtcattggaaaggaagaaaccattttctggaggaaaagaattggttgaggctagctttaagcagctatttcatgatggacaaaaggactagctcatccattcttcattcgtttctctgtatcctctatcaaatttctgagtaaagattttatacaatgcttgattagcattcaaatagtatgtttcaaagattttaaaaaaaataaaactaggcctttgaatcataattatggcttataactctatttttcatatacttactatctcaagttacaaatttcatgttatgtttttttcaaaagagtattcctgccacaactcagagctcagctgaattagagcagtgactagaaaatctgagaaggctgagcttcaaaataaggtctggaaagtgtttcttattgttacaagagagtcaaaatgattttcttgagctttaagtttatgtaagtatttacttgacacttagcagtttaaaagataatgtgcaaaaatatgaaaatgagaaaaaacaatttcaaaacaagagttggtgattacgtgagacttagtagagcaaagtatattctaagtattaatctgtctaagctgtttgggaacagatgtacgtgaaatggataccgggtgttctgttgtgtacaccccaagtgagacatctgttggtagactgtgtggtcagaaataatggaagcaggggttaaaccccaatatgacctattactcatgtgaattattgaaggactaattactcagtaaaacatgatgctttgattcatcagtctacacgttaagaaaaaagcctctttagaaaaaaatttagttctgtttctaagctgtcaaatttgaggaaatttttaagatgtatgcaaagactcaaatttccatagtaactgcaaatactatctgcttataaagttttaaaatgttttgacaggtctactaatttatcataaaaatagcctcaaaagttttagctttttgttagggtaggttgggtctcacagaaaacaaatgtagagtgaattttctaaagcagggctgtccagttagacttcctgaaatgatgggagtgcactatatctgaagtgttcaatacagttaccaccagctacatgtggctattgaacagaaacatggctagtgtgactgagaaactgaatttttaattatatttaatttttattaatttgaattcaataactgcatgtagcaagtggcaactgcattgtacaacacagctctgacacatggagagttgaaaatgtttgtttactttcttcccaagttttcattttagtctttgtttctacatagaaaggaagatatagcttttgaaaaatgaacctgaatgtagaactgatatggttatgcaatttgagctgcctatttaaagataaagcaactgagtttagagatttcaaagtggcagagtcctttaacatatttcgtgggctggccacggtagctcatacctgtaatcctagtactttgggaggctgagatgggaggattgcttgagcccaggagttcgaggccagcctgggcaacatagcaagaccccatctcagggaaaaaaatatgtgtatatatatgtatatatatatatatatatatatatatatatatatatatatatgcatacacatatatacatatatacacacatatattaacatattttgtgtgtacaaaaaatatttttattatgtgtagattagttggttactagtaaagttgaagtcttgtctatagaaatcattgtatttttcatggtcattgtgatacattgtttgaactgaaatttggcaaattcaatctgtttcttactacaagaatagtacatagatttgaaatggtaactctcttagtctgtgtactctgaccctgtgaacgtctggagactaatgttattcctaaatatgctatgtccacatggcagcatctgaaggcaaacactttttaaaactgatctacttttgtggacccttcctctctctctttcctgcatcccggatggggccctctggggctggaactggcacagaactattcccctaggagtgggttcattgaagccaagggacacacaaattgagaatcagatagactggaccaaggtcattaaaccagagagggcaatccagatggggttgtccaaagtaggaagttctgaagtgaattgcagaaatccaaacatggcaaagctaaaggaatagagaaccagggcaatggatatagagaacagagcaattgggtatgcaggaagatgctattgcctagactggatgtttttgtaccctctgtaatttgagaaaatggaccgtccttgttgaaatggtcagggatgtagtagataaattcattgcagttgtgtaatctcagcactagaatactgatcataaccatatcacttgttatcccacctagcctgccacttgattgggttattagattacatttcagacattgacaagtctacaagcatcattaaaatcctaaacacagacttctgaccgtattcctacccaagttttagaagcactatgccaatgacgggggtagtatatgctgagcaggtgagttttgattgtgtgtgtctacatgtgtacgtgggtgtggtgagcaacaggaaggaactctcagccatgactctaaatgctcttgtgttggccaaaattggtataagctaggaggagaaacacaaaggagagagaggcatgaagttgaaggacattaaaccatttgcaaacttttggcatgcaaaccagaatatgaggaaacttagtgtaatgggtgactgaattcagaggtagacaggcaatcaggaaggtataggcaccaaaaatagttaccattggtgagcgtttttgtttttgtcattggcatggtgttatgaacttatgttaagcctaagggtaagtctaaaataatgtaccagctggcatcagggaattcccatgtacattcctagattttcattagaaacagtgttctggaaactaccactgctgctacacagcagtgcccagtgcttgactgaaaatagtgaacacttagatttgtttactctgccaggttctgtgctaagtatcttatcttgtttaaccttagcaaagaaactatgtagtctagatagaatttttatccctagggcccagaggtgttaaataacttgcccaaggtcataccagtaatttcagttgctggggttcaaagctaggcagtctgactccagagcctgcactgtccccatttggttatgttgcttccccagttaagcaagcaagagtctatctgacatctgagttggtggtagtaaagcatcatggtctgaaccaaaataataaaaacctttgaaacaacattatctgacttctttcaggcttttaagacagttccatcatcaacagcttattccatttctctggccacttccagtttctgaacaaatgaagaaaatgggagtgataaattggagtttttaacaagtttttttaaatctaattttttttatggaaaccaccaaacatacccaaatgtaggaataattatgtaataagtcctcatgttcaaccctaagaggggtgaagctctatgtgacccattactgagtttaaacagttttcaatttatggccagtcttatttcatctatactctacccacatcccttcttcccctggaatgattgaagtaattcctaggcatcatataatttcatctgtaagcatctcagcatgtatctctaggagataaagattttctaaaaaatcatattactactcttcaaatttaaaataatctttatagttttacatatccagttagtgtccagattttcctgatattttctctattttttaaatatgtcaaccttgaaatgaggtccatattatagctgatggctatgccttttaaattttctcatccacagattcttcttccttttttttcctttcaatttatgttttgaacaaactagtttggcctatagtttctcatgggcaagaataaccttcagactgggatggccatcactctgatacccgtaaaggggatgaggcaggttggggaagggagagcctcagaccatgatcagatgtcacaagatttttgcttacctagggtgaggacttgggaaaaagattgcccattaggagtcctgccttgggcaaaagtggccaaacttcagctgtgctgtcacaggctgtgggctgccttggaaatgtaggacctcaactcctctgaagttgaggtggagcttgagggtacgaatccctggtggccattataatgactacactcattgggatggcatggcaagttcatcctcaaagatggatcctagcatccaccatgaccaatgaggtttttttattgttatgatcactataaactcaaggatttaaacctattaaatgtttttcaattcacagcaatgattatttttactgatcttcaaattgtcacattttggatttttagaccaatgggagccccttcatcttgacttctgagttcttttgacattcactcagctgtctgatagcttccctgctttctggaatggcaagatattccaggttcatcttgaacatttcatgcttgagatatggaatcaagctcatcatcagagggtcctggttccttttactggatagtggtattagagacctcaatttgagaactaagcaacatcattgctaaaacttcccctatgtgtaccttgttacttaggtttttcaaagaacagagctagaaaatatgttgggtttttttgttttgtttttaaagaaaaaatgtatcataggattatgctgatacttccaattcaagtgcaggcctaagcttttcacattgtctcttttctcctacccttaaagtcctgattcctaactataacaacatcattactcatttgctttatcctgcattatgtagacacaatagagtaacaacaccaatgctgccaatcaaaagtataattactgaaacccacttaagatagtcctgcaatttttttttttgttcatagagtgtacactactagggaggtgtagtcaaattactatgttttaaagacacttggaataattcatatctgtgaagttatacccccaacttatttgttttttgtattattgtttcattttgcttttgatgtttaggcatttcttttttaaaaatcaattttataattacgtgaaatacttatatggttccaaaatcaaatctactaaacaaactatattctaggaagtatagcttttatgtttcccttctatgcttttccttccttcctgtaggtaggaaagcttatttgttcctcaaagctctgggttgttcttttattttatataaataaacatgtgcatatattcttttcattacccccacagtacccaccgtcttaaacacatgtacaatatatgtgtttttctaccttgatttctttcttacttagcaatatgcccagaagttcactctgtagcgctttacatcagcatcaaaatccattatgtactatcgtttattgacctctctgttggagaaatttggattgtttctagtcatttttgttatcgcaaatagtggtttaataaaaaactttactttccgttttttgtttttcaatgtgcttttaggatagatgcctagaagtgagattgttgagtcaaagaataaatgtgttaataattttgctcaatattaccaaattctttcaaaagggttgtgcaattttgctttttaaaatcattattgtataagggcatgtatttcctgaaaatttctccagaagagtttattgccaaactttaaaaaaacagcctgatacataataaatgatatctcagcatagtttaaatttgcatttttcttgttaaatcattcatgtttttactgtagtcctcctaacatttagggagcaccaattatggggtctctagaaggttccaggattctgtaatcaatttgacatgatttctgtcttcagatattcacaatcttcaggaagatatattgacaaaagaataactacatgatctattttgtgtgcaacttagtacttacagagcattataaatgcacatggaaaaataggtaaaggagaaaatcattctctgttgggcgggctgagggggaagtcaggaaaagctacagagaggttcgagggtaaactttaatgtgggccttgaagtatgatttggagttagcaagacagacaaaggagcaaggaaaccattctagaaaaagaaaattttgaaaaatctccagaaaaggatgctttggcctatttggaaaataacattgtcttatttatgggggagatgacagtgctttgtttttagtcagtagtttatacaggactttgaatagcatgcaaggaagttggcgtctcaacctgaaaattgaggaaggtgtgacaaaggctgggcattaggtgagatcaagtatttctgtttttttttttggtaaattaggtagcaggatagattataaatgggctccacactgaggagcccagtgtgatggctgatccagcagatcagggggcagtggctgcaaagctgggagaatggcaaggtaagcctggatgcaagggatattgtcaaagacaaaatttgggggatgtgaggcttaaaagggaaataaataatggtgatggtgagatttctagcttgggcagtgggatagatagtagacgctgcgcaaattcgtttttaaatcagcagaatgagaagcatcttatttgaaatatattctaccaaatcttagcatcaaatgtgctagtgactagcaaaatatgtaaacagaagggaagtagcttgaaaagtacacaaactggagaaattgctcctgaaggactgtaagttgaacccttttaagcctaagatctgtatttcctatgagccctaggctctttccttgtgtatcctgtttcttattagagtagaggctacttaaaaataatcatagtttaaagcgctctattttcagaaaacattattcattagatgttagtaaataatgtaatctttatacattcataatatttctgcattattggagtgtaaaaagtcagtgaaatagtcatttgtaaagatgtcagtttttatctgtggaaaatagctgttcataccattttaagcttaaaagttcttcatttacttcttaaaatatccatgttggtattattttgtctaatacaagtaattaatatttaccccaaattaagcttttaagtttactaaatgttacaaacataattcaaagcactgtttagtgtccatctgtgcaggaaaaataagatcaatacaattgagcagctgttagcatgtattggtttccttatattttaagtatgttttcatgttttgaaggtgtaaagggatgacagtatgttttgttgtggttttcatcatacagataaaaacttattacagttgaaatcttggtgaacataatacattttaaaatttccattcctcacccatttatctagatatttagacacagtaaaataaataacatggatacatttttgtcatgtgatttatgttttttaaaaagtagaaataaatttctctaaaagttatttttattttttaaatttagcatttttcatatttgaggaaaaaacaatatgtcttggtaccctagcttctgaactaataacacacctgtcattttacaggttattttaatgtttttcattgggatcaaacctactctggaaatatctcatgggtgagctttatttttatgaaatgttcttggcacttgaagacctttgtaggtacatgccagactcatcttacatccagttcttctgcatggaaaatatgtgcattgaaattctaagtgccttttcaaatttgaccttcttagagaataatatgagtcccaacaattaggaaaactatggaatgccttttggcctttacttttcaaagattttcagtcagtaatgtttaattagcattcattgtgtacattgtccttttttgtgtgatatggctagttccaaaggaatattctagaagatctcagccttctgctattgaaggtgataatacactactaagttatgtgttgctttacattaaaataatgttgcagcagttacttattgcttaactagcgggtataggacatcaggttgaaataactgattttgaagtgaagagttcttgtttatatcttaaactaaccaagtatgttcattaactttgagaataacaatgatctttttcattattcttgagtagactggataaatcagaaaacccatgttagaggtccctgtaaaaacttcagtcttatttggtaagtccctttataagagtttcaataaaatcaggtaaatttaaactctgaaaattctacgtactgtctatcatgttcaatttactgttaaccagtactatgcactggaaaaaatttttttcaccttaatgagaccactggtcattactgctgctactgatgctcttttgtctgcacatactgttgcaacataatgtgttgtgcatttgatacggatattatcatattgccataaggagctgctattattttagacaccaactgattccatgatagtgtcagatttctttaacatatgcttatgtttttgtacaaatgaccccaagaaacatctgctagttttgtggtggtatctactgtttcttttttagaatttgacctgtcagtcactttttaacgtgaatctacaatatttgagttgtattcctttctcgtttttatgctattgatattaacaaaattgagtcagttttatggcataattcagagagaaaccgaagctgtctatggatgttattttaaaaatacctttttcatgatgattgtgcctttaaatttttgtcattgattgacactttaaaattgaaaagtgcccttttaatggatcctttaggttccaaaatcttaagttgaaaatttctgtctattggtcctgaaagtactctctgaatttgataagtatgtagtagttgtggtgtatccttggtcagtttatatcctgtgctaattgctaatcttacttagtttctttgatgcgtgtgtgaagacaggcaaagaaaaaggaagtggaatttctacaaaactgtgaaatctttactttatggagactagagaaatttctaagtaaaagaagacactcattctattgtagttaggatcccttcttttacttgcttttcatgatcttgactgaaaagcaacaattgagatttccattgcccgacgctttctcttctgcttttctttttgtttctcttgcatttttaaagacagctatttattcaaaaacaatatgaacttttatttattggacttaaacctggaacatcaacaaaacaaagaacaaacaaaactacctttccaaatttattttattagaggatgctatcaatacaattttgtattatgttcacacttgataccaaacctaaacccaagaaagtgtgtcctgtgttacagcctatccctctgtttaagataataactagaacaatttacttttattttctactcatctgctttctgtgtatcagctgttgtcctccctcagcctcgaagcatgtcatcatttccatctccgtgctcattcagtcatccttgctgctcttagtcccctttttgtcccttgggtgacttatgtcattaggacaaccttctgtccccacttggctgaaactgagctgaggcccttgccagttgcattaggtgtggcacctttcatggctcagtttgggcctctgtgatatctgtgtgccttctactccaaactccattctgccagaggtggcagggtgactggaagctttagtttcagtgacaaaacccaagcgtggctatgctgagtgtctaagtagctttcatttaggcctgaaataggagagtcaggcgcctctgtgtcccctgagaaagagagatttccctcagctctctgggcccagcactcaaccatttaagtcagctggttagtataatttccctaaattgtggtttagtttccctatgagtaggactggagtaggaccaagtaaggaaagtccctagtgacctttctgcctcctgaggagcaggccatttactttgagttgtagcttcccatctgtctgtccccactaccctatccaaggccctggaggagccacaggatgagggaggagattcatggaaaagcgccttcaggtactgggtatgtctggagtaacatttaaagtttaaaagactctttaacaattttcctctgatacttactactgcctatacttgtttggttttagtacagtaagttttgcctatcgtgggggtgaagaaaatagaaatattcccattaactttgtatggtgcttggtatgacaccctgaacaggtgcacccgtaattgtttacttgatgttctttttaataagtcaattatatcatcggaaattgaagaatagcaaagttaatttgtttaatcattctatgggaactcttgcatgctcgttcactagaggaacattgcgtttctcccttaaaggacaaggctttgttttgtttttaataagacacactctttataattaaaacaaaatcccagtgttaagggatttctgttttaaataattggatttctttcctttgttcctctaatccctctatatgagaaaaaaatctaatggtgtcttaggataaatatttttagattaaaaagttctcttaaccactgaaatttaataatacttctcaaagtttatggatgatatagaatgtaatgtaaggttgagaattttagatttggcaaaggcaaagatacaaaaactagtgaaaaacaacaaactggaaacacttttaaaatactgatgtatttatctttgcaataaattattcagaaatataaataaactcactatttacatagttttatttaaatttgtcctcaaaatactaaatttagtactatatattttcttctttcagataaatgctttcctgaaaatggtattttaatatctacagatggtttagtttaacaatggttggggtaaaaatgacatagggaaaagcaaaatgtgacagcccagcttggttacctttagagaaactcagaataaactctattcccatttccttctctttcccctttccatactcgagagcccttttctgagactcttaagtcatgtttgggccttggagaggataaatagcagggtgggtggtaaaaggggagagtgctttgcttgaggcaaagttttcctccatatgggaccttcctcaagccctcccttcaaaccctttaaatgagagcatgagctcctaggacagaggtcatgtggaaagcagcattagcatgaaggggggtgctgtggaggggtgtaaggtgcaaaaagcagcattagcatgggggaaggtggggtggaggggtgtaaagggaatgagatgtgaagtggttaaagggccatttttctagttggcctctgggctttgatgaaccttttccagtgtgcctgtttctccacttagccctgggctaatcttgactcttaactttccaggtgtgtatctatgctgatttctcctgggtttggaagctctgagaagctctggttctagttcaatcacaagacttttaaagaaccagaaaaataaaacaattttttaaaaagtaatgaagaaaagacttttaaagaaccagtgaaaacctgggagtaaaaatatagaagacttgagaaatttcatctttacctttcaagtgggcagcatgagaaattcttgtaaatggtgctttcaaatcttacacaaggttctcagttacctttatttgtactccctagactgtattgcatcccttgctatgttgactaattcccacctaaaataattcaatggcctcccaatataatctggcattctaattaataagctaagaaattatttggtttttcactcattggcgttaaatattcttcagtgcccacatttggaaatattggaacacagaaatgaaaaaagatacaatcagtttctctgcttgccatgttttccttgatatggcaatacgacaacaggtcaccctttgaagaaaattcagagatgctaaagtagaaattaaaactgaagataagtcaaggcaggatagtataggagtctgctacagctgccatagcaaaatactacagcctgggaggcttgaacagaaatttatcttctcacagttcttgaggctagaagtccaaaatcaaggtgccattggggttggtttctgaagagggttctcttcctggctttcaggtggccaccttcatacagcatcctcacgtggccttttctttttgcctgcatggatagagatctctggtgtcttccttgtaagaacaccagtcctattggattaggaccctatgctatgacctcatttaacctaattaccctatttaaggccctgtctctaaatacagtcacactgggggttagggcttaaacatattttaggggaacacaagtcagtccataacacgtgatttgctatagttttcctttacctaaatcttttccaaccttgagagtggattttggccaggtgtggtggctcacacctgtaatcccagcactttgggaggccagggaaggtagattgcttaagcccagaagttcaagatcagcctgggaaacatggcaaaaccccgactctgggggggcagggggagtgggggaattagctgggcttggtggcgttcacctctagtcccacctactcaagagggtgaggctgaggctggaggattgctacagcccaggaggcagaggtcacagtgagcagagatcacaccacttcacttcagccctgggttacagagtgagaacttgtctcaaagaaaaaaaaaagtgggttttattcttccccttaaattcctattaatagtgaggtgaggcttcttgtgttttttttttttttttccaagacaatggttaatgtgtgattacttaaaaatgatatataacactaagaaataaagaattgttaagtgagaaggaacatattaaaatggcttggaaagatgggtaattttttacattttaagtaggttttctcaactctaactctgtggaacttggtcaatctaatcagtctaaatatagcacaaataataatagttatatggacaggagaaatagtagccctcaaagatagtgaaatacatctgaatatcactaacaatgtcatgaatttgcttgttctaaagttttctgaaagtatgaattcataactgagtttttttttttttgcctatgactactaatgtttgaggagagagtagtgtcagaaccacccccccatttattacatgtttatttcatattttggtactgaaatcagtgtttattttgtgtcttcctgataaatcttgccaataagtaattaccttccatactgaaaagttcttaggattaccaggttgctgggggcaaccttaaaaggccatgcagaacattgacttaggtggctattaccctgctttattcaggtctgagcatttactttcctactacaatcagaatactgacctacatttaaaagtgcaacactgccctgttatctaaatccactgtgttcctgagaggaaataccagaaaagagggcaccaatattatttttctgctgttcttgatcataagtgattacctttttttttggttaggcattctgcttctgaaagataactgaggttgaagttaatagaactaagattcttatataaaatcataggaaagataattttcaggattattgaatcatattgaaaaatgatataattgtgttaaaagataaggactaaaatgagttaattcaatttggaaatagttaaattagaatttgcttctgtttttgatgaatactgctttttgaaaaatcttctgagtatttaagcttttactactctagtcattctctctaaagtagacatagaagcgtgttcttatcttgatttggtaaggctctgaaaatgcaaagcaacagatgttgtacccagcataattatatgtatcctggaaacacatctttattgagtgggatttgttcttggggaaacaaaaatttggcaaacaaaggacattaacttgctgatctcagcagtaattacttgggttagattataataatcttgtgtaggtggtaactgcatgcatatattacaaaatctaattctaaaatacgtacattaaaaggaaaatgaacttgcgcaaactttagatcatgtatccccttgaagagcagaaaagatctcaatttcattatttgaaagttgtttgaacagctttttggaagaggtttccaggattccaaatcctaatatgtgtattgatactgaggctttggactaatctttgggggttactgccttttttatgcccactgaaaatagagcatttcaaacaaatgaactgatctctgatctttaagcatgccagtaactctttggaacaaatccatagttatttttaccaatgactgtattaaaacagtactttctgtattatctcttccattccaaggccattttaaaacaccctctttctcttctcccaataggtaaagtacgacagagctccttaggactgggttatggagaattatctggaggtcaatttgagaaccactgtgcaaaccatttcttaaataagtagctacaaggttgtccttacaaaaatttctgaagttgatggtgttgcgttttggagtctgaagcttaaataagagtttgtcagtggtcatggtctaaatagctgattactaccaaggtcatctaatttttttttaacacaaaaaaatgttctgagcacaaatgaaaccttcaggacaagacatttatgttttgagaatgttcttaaatgattcctgtcgtgtatcttattttacatatcttaatgatcagcatgtattttttgttgttgatgatgattttataaatgtgctatcacctagtttctaattcctaacagctccttcatcagtagaatattgctgtagcacagttttgccatctgttaagaaaagatggtgactaataagagtggcacatttcagggctggtgtgctatcgcaacatctagtgttttagtactgaggacagtgatgtatgcagtgttccttacagccatggggtgtgggaatgttttcctcttcggcaaagtctgtgtatttctatagctgaactctcaggatccagaggaaaaccacaagatgatgaaaccagatgattgtcatcaaatttctattccccactacatgattattagttttcgtcaaaagaaatactcatcctatcctgggttggaattggtaaagaattttgcattgtgactaggacacctaaaagtttttaggatgagtacaaatggaatttgatagatttccccaaaatgtttgggaaaagatttattcctccctaggaacagcaagagtagcagcatcacatgaggcaactcctggtaattttttcttcttgctcttatttcaatgatatcttttcattcttttctgtatctctcaatttctatgtttctcctcttaatgtatcctgtaaatttcttagtagaacctttttactaatgagggtttcctagtttgctttaggaggcactcaggatgcccccttttgtaaggcagtaaattgaaaataagaacttggtgaaggtccacgtgacggttagtttccattctccattgtaccaaactgctacagggaaagaaccatatttaatcaacctcaaatcctcaatatttaggtcagaaaacacttggcatagaagagacactcaaattttgcagctaaatagattattgatagaaaatatgtttcttgcctctacaagcaatatgaaaccaatacaatctctaaatatcttcagactactaggggcaaatactgtattataagaataattcttcagaaaggaaaatccagctactctcatatcacctctctatgttgaaagctagggaagataaactggcttccagccagtgagagtccatgtggacctagtgctggctggagatccctaatccaaaggcaagagccagatactggttgtctgctgaaaatcagaagatgacctctctggtagtaaggccagtgactcatccctgcatcttttatcctcttctgatttgtataaggatctctcctttttccccagtacccactctcaagaattgctttcctttttaacatgatcataccaaaatgtatctaacagtaccttgatttcctttctgaggaatttagggagcatatttactttgtcagactcattagaggtttggcttcttggtcgggttcttaaatggacaacttgtttgggtgatttggcagagaataggagaagccagtcccctctgatagagcaaacctggggagctgtggttgacccacctgctaactgtcctgtacaattaggcatgtggcatcagtgggtgactgaccagagccaccatctcaatggcggctgttctttccttcctgtgccttctcagatctcttttttgttcttgttactccactatattggtttttcttgagtttttttcaagcaaatatcattattcacttctactgcagttcctctgttgttcgctttttctcttagtcttcattgttttccattttgaacattcagagatccatcaaaaaaagtaaaataacaggaagggagaggtaaacaccagtcaaatgaagtattataatagtgtattactatactctttaaagtaattgaagggtggttttttggggtcagaatatctgttagaatttggaatttgccactcttgagactggggcaagctatttaaactctaagcttatctgtccttcctcacaatctgtaaaatgggatcataataatggcacccagtttatggtgtagtgagcattcactgacacaattaatctaaacttatttgcactacatagaacagaatttttgtctattaaacaatatagcgttttaggcatgaaagaaactttagattaaattaaatatcatttttcttaccacagggtaagtttctgttttgtttgcccctgtttctctaactcctagaatagtttccagcacatagagattaaacaaatattcgttgaatgaatgaatgcatctattctaatcctcttgttttaggaatgacccgtcaggctcaaaagtgaaagcatttccctcaagattggtgacagagttggggactaaatctaaggctttctcttcctacaccagtgtcctttctgagaacacgatgccattttctcaatatttgtttatttatatggtaaattggtaggaagctgtgtggtactataagaggataaactttgataatgaggtatacttgctatcaaattctaacattctcatttaaaacatggcataccatttgtcttctacattttcatatgtaaagtgaggtgatttctaccttatagaactattgtgaggattaactgaactaatctttgtagagcacctggtcccatttattttttttttttgctcaccccaccccccaactttctagctagataacttatacattcactctgtttttcattccttcttgaatctcctgtggccagacttgacccctgtcactctacagcttactcgtcaaggtcagtcctcatctgacttgacctactaagagtctgacaagtagtcacactatgctccttgatacagctttcttcacctaccttcttggatgtcattcttttggttctcctcctaccccattgggctgctttttcccagtctccattcttgggtattctcattttcccatgtctgtcctctgacttcttattgtctctgtttctgttttctctggttggaccttctctagtttctggcttcaaatactatctaaatgctcatgtctttcaaatttgtaactctagtctagacctctcctctgaattccagttttataaatcttctacttaaatattagaggtctaataaacttctcaaacttatgttctacaacaaactccacattttctcctgcagcctctaaatatgtacctcctatagattttcccatttcagtaagtgggaacttcattattctgattgtccaaaccaaaaacacttggagacttgctacattccaccctttgtctttcattctacatccaacctatcaacaaatcctgttgcctcttccttggaaatatatccacgcttgagcagcatcattgtcaccacttggtgttatacactctcatttctcacctggagtattgtatttctcatctggagtagtgtctgtccaacgatgtcccccatcagtctgttctccatgtagcaatttcgtttttgtttgttttaagattgggtcttactttcgccttggctggaatgcactggtgatcatagctcgctgtagcctttaattcctgggctcaagtgatcctcctgccttagcttctccagtagctaggactacaggcacacaaccacacttgactaatttttttttttttttaacttttactagagatggggtctccctttgctgcccagtctagtcttgaactcctggcctgaagtaatccttctgtgccagcctcccaaagtgttgggattataggcatgagccaccatgtctggcccagatgttaattttaaagtgtacattagagcacatcgttcttctgcatgttcagcataaaatccaatgtccttaatgtagtctatattaccctacatgggctacttgtgcctgatccctctactcttatgtcttatccctctcctgctttctcactagcaccagccacatcttaccgttccttgaacacaccaagtatgcatttgccacaggaccttgatgcttactgttccctttgcccagaaacccttggaaccagctatgtgttaaaattcagatatttactgattttagagagctaaaatggggtatatataatatattacataacactcacagctggtttgtggtagcatttcataattaaataatatttctgaatgaaacattaagaatgcccatgctaagagggatgagtaaagactcaactctcattgtcagttcagctgcagaatgaggtcagctcaagatttgctgccaaatgacttaagaaaaaaatgtttttggagctttggggatttcagaattgcagatgagagattctagacccgtacctacacagcatgctcccttattttgttccaatctttgttcaacgattatttattgggtagtcaaggaagatctctgtctaaaaggcttctctgtgtggaacaagactggcatgtggaaggtttccaattaacgatattgaaagagtgaagctcaaatcatttttcactcaaatacatactatttagaagacagtggccagtttaagaataatcattattggaaacaaagtactatttgattagggatagttaacacaaacacttattagtattagggatatgtgaaatacttaatggatgagtcatgtgctgacataaaacccattatccattttagttcctggtagcctaactggttgaactctgttttattgatctattattgatttggcctgtaacttcaagttacattttaatgtaatttcatccttttctgatcaccttgtgtcttcaagcatttttaagcagttgatagatagttgaaagatattatcactatttcaatctaaaagatattatcactattttaatctacttaaaatttttactacattcattttaagtatgacttatggaacgaatcgaaaatacaagatagtgaaaaacttgtgaggatcacctgaaattttagcattcactttccttacatagaggaacttagtctctctaaagaattatgagtaataaagtatcataatgatatttgtcttagttttggttaagtgtactccacaggagaaagttaggcatgagcaggaattattgtagtcccacattctcaaacagttctccagtaagaaagattttatgtgtttccagaaatcattttcctcctcttcagagctttgggaccataattgtatttaaattgctaatctgttttaaggaatcataataaattgtttaacatttatattcaatcaactttgtaatttgtataaatttttcagggtgacatttgaacaatttttaagaaaatgggaaatacagaagtattcttagttttaatatattttaaaaagatgacatgtgatctactgactgaaatccttcaatcatttttgtttttctccccaagattagatagaatggatgtgattttatttttaatttgcattatggagagtacttttggggggttttatgaaaaagacttcatttattttgttagtggtacttcagttgcataagaaaatgttcttttaaatatagtggtcatttgtgtgcagccttcaagttagcaaacatgcctttgagtagtcactatttttgaaggtctttatatctgattgcaatggcttatattcaatagtcctcctactaaatgaaataaaaatggatgcctcttctgccacagaggcacaggtggacatgttggtagcaagccccatgcggtgtgacacatggcacagcccaacatgggggcaaagagcatgcggcttgagctaggagtcactttatggctactttagtgtagatttgtgtttttctgtggaacagccattattgaagacatttatatagtatgatgtttgtttttcattaaatgctgattgtgatttcttaaaaatagttaagacttgattagcagaacctatttagaagccagagttcccctgcttcacctcttgctatctatataaatgatatttttgactctgtcctttataatgttggcaccctgtgcatattagatgtaatcagggctgaaaggaaacttgaatccatctggaagcaataaacttttctaaaagactgcacagtgttatttaatcctgtgacttcttactgtgagtgaaattaaggtttgatgcagttgtgtcacatcgtattgatatcaaatttatctttctaaaaaaaaactgacagtattacagcacagaggagaagatggcttgctgtaatcctgtaagctattttacattgattacatgctacataatgtacctaagtatataaaatacttgatctagaatgtttatgttttctccaaaattttctcatcaggtaatactttctcaacttcacctttagttttggcttcttatcatagtactaactatgcggtagtaattgtgttatgatgaaaggcatggagaagaaattataattttaaaactattataaagtggagacacacttgtataattaccatctatgtagactgccaaggtataaacatttagcttattttagtatcagactctttgaatcaatttaaggctttttcaataaaattggcttcctctaatttctactccaaaatggttaaaattttgttttacttcaaatacgttgtagggtatcatatttcatgtgactaggagcctaaactatatcagctgactggcataatttgtgaattatatgtgtgtttattaaaatttaaagtttttattaagacttacaattttattaagacttaatttttttccttacattttgagtaagtccaactgaaaataacttagagacttaggaaatttgactacattttataagtaatttccttgtaatttttctttcttgtggaaacaattcttactgatttacttaactcttttttcaatggcaaaaatgaaaaccaaatatatttgtcaactatattcttttaattgtggaaatgaaaggttcatatcccccatttgcctagcatattaaaaataaacatgacctttgtcttgaatgttgttaacttggattttaaaaatcaaaccaattataagctatattaaaattgcttatcaccttccctttgtcttcagtaagtctgggcctaaaaatactcatcatatgaataaataaagttttacaaatactttttagaacatcttgaattatatgtgtgtttgaagcttacttttggatgttcggtcaacaaggcttctgacagtttctttttatcttccctctattccctgccactgtgcaccccaaagtgatccctgaccacagtggtcccattgctggcatcaggaaggtagactgaggagttcaggtatcctagaggctgttaggtgaatctcttctacctctttcctggtcctaggaccactggacacttcaagtaaaaataacaattactttaatctctcaggtaaagtttcttctcccttccagcaacacagatctgcctgtgccgagttcaaatactctgaactttcaacagttgttctgaatacttttttgtcatcttatgatcaaatattgagagcattgaggggataactgaatgggcatggtataaaagtcagacttttagtgtttctaagtagcagaaccctttggacaatttagagggctgtgcgatatcctcaccgtgactgctgggaagtaatgggatctgacctgcagaggtactaccttggctgacaataatgacaaaagtgagagcaaagtacatatgactatccttgaggtcctcaggaaaaaaagagtattagtgagttgaactgtatgtaagggtctttaccaataaggaagcccatgcccagacataatccttacaccctggcaatagaaaccatcattgtggtttacatctcatcctgttcctacagtccagcaagttcaggccacaaaaggtttaagcactttttcctttgttctcatagcaacagttgcccatggaggttcagttacactaatattaacattttaatatacacaaagaagtgcctcgaatgtagtaggtattcaaacttgttaaatgaaagaagtaaactttcagacttaccttgaactactacagttttattctttctctaacctctcccactactaccatcttaaaaccaccatttaattagtattttataacaagttattaaaggctttcaaagacctttgaaccttcaccctctggtaagttaataacttctgatatgcgattaaatgtcaactgagtagtagtgggccctaagagctcagagggactgagaaatgaaggttattgtttagaagagtggctcaatgtgcttcgacagttggttaatatttgaaaagactagagtcaagaaagccttccatgtgctaggaaatgaaggagcaaaggtccagaggtggaaatgtatacagtgtgattaagggattttctgattgatagtaaatacagtcaataaaaaacttttattggaagcctagcctgtgtttgaagcattaagctaggtgctgggatacagagattagagatgaagataatgatgaagatattgttgaagtgaattgctgagaagctggagaaagggccaattaccataatctgaggctcaggaggaattggtgcaaagatcatctggtatgatatatatgaactgtatatacaaactgatctgtgtagctgaactgataatgccaaaaaaaaaaagactaggtttttgattaagatgaatccattaaggtcatgttttctgttggtgccattcttggagacctcccccaaccctatacatttataaatgtttttcctgagggactgagatggaagtggacatataaaaggaaaggtctgggcaaatacataagtaggtagtaaaatcaaggaacaaatgatctcaacaaaattgcccttcttgaaatgaatgaaaatgatgaaagccaatcacattgcatgatgaacttggggtatagaatatgaaatatttaaaattgctttatttcatgatgtttcagatgtagtaggaacttgttgcatagatggtgtaaaaacaatctagtaataaaatcttaggtatttaatacaaggtgaagaaagatgcaatgcataaatcatgccattttaggcttaattttcataaggctatgcctgtctttataagactatataccaggagttctcaagctttttggtcttggaacccttttatactcttaaatcgttgaaaaccacaaagaccatttatttaagttataaccattgatatttgttgtattagaaattaaatagacattaaaaatatttactatttaaaaataaccaaaaagatgggcatggtggcccacacctgtaatctcaacactatgcgaggccgaggcgggtggatcacttgaggtcaggagttcgagaccagccaacatggtgaaaccctgtctctactaaaatacaaaaattagccaggtgtggtggtgggcgcctgtaatcccagctactcaggaggctgaggcacgagaatcacttgaacccagggagatggaggttgccgtgagccgagattgcgccactggactctagcctgggcaacagagtgagactctgtctcaaaaaaataaaaaaaataaaaataaaaataacagtaagttcattgcatattaacataaataacatatttgtattaaaaataactattttccaaaacaatcaaaaaagcagtaccactcttctattttaaattttttcaaatctcccttttctaaaaaaaaaaaaaaaatattgtgtaagtttaaggggtacaagtgcaattttgttgcacggatatattgcttagtggtgaagtctgagaatttagtgtatcttcacccaaataacatacgttgcacccattaaataatttttcaacacccacccccttctcactctcttgagtctcctttgtctatcattccacactctgttcctatgtacacattatttagtacccacttaaagtgagaacatgtggtatttgactttctgagttttttcaactctggcttaatagaagacagctgaaatctcagaatgcttcttcatccagtctgttgtgaatatgttgctttgattcaagtatctaaggaaaatacagttttacacagatgtgcagctgaaaaggaaacatcttttaatatgttcagataattgtggatattgtcctttgatactatagcaaaacttatcaagtgctaatttcttaaaggctggttataatttgaaatctgaaaacatatctatttaattgtagtttgctatttgaaaatttattggtctgtcttgtactttgaatggatattttgcccacgtatgattttataacatcctgtattggccttttggaaaatttggtttactattatacagtttctaaatgttgataatttttattataatatattttaaaaagtctaatgtcactgccagtctcatcagaaaattctttgagattagaaagctgttaagatcatcatcacacttacaagttttacaaaattttaattttactcaaaactttatattttatcattgacaaagctctcagttgctttgcttagtgactgactcactttgttcattttccagaaagtgtttaccaaatgctgctgcctcaataccagagtctgtattgtcagttgatctttcaagtaaaaagtggtgttctatgaaaaacagctagttcagctgcgactgaaatgatataagtgtttctcctggagcaaaccaccacttcgatttgtagcagaaatgctgtatgtatactttccattgttattactcataacatttttaaaaatatactcaagggtggagatttttttaaaaataagtgttattgcttcatcaagaacagttaaatgaaactggattttttaaactgagtttgagttaatgaagaatgcagcaattattagtaaaatttggtgctccaccttgattcatactgacactccaggagttttacccactatttcttttgtacctttagtgcaaatgttaatatggtaggaatggtaaatgacatctttagtattattataaaaatcgtttttaccctgtatactctttgagactacacattgagaattgctgatgaaggtgttttaatttatcataagcactgaaaagatttacttaattcaccaatttctcctgaatatttgtttatataaaacaagactatgtgtatacacctacctttttattaatggtagagatctaggaaaattaatttctaagaactagccaggatatttggaatgtgaataaatcatatatccagaaaaaagctttagaagattgtctatgattgaaagtcaaacagctctcatttctattatactgttctttttcaaagaatttaccaattttatgtggtatttatgattaaacatacaccatgtaatttaacatttttaatgtcacttttacatcataggtattaaagattagcatttttattgtctgtattttaaagctcaaagaataacatttaggctgggtgcggtggctcacacctgtaatcccaacactttgggaggccgaggcaggcggatcacgaggtcaggagattgagaccgtcctggctaacacagtgaaacaccgtctctactaaaaatacaaaaattagccgggcatggtggcgagcgcctgtggtcctagctacttgggaggctgaagcaagagaatggtgtgaacctgggaggcggagcttgcagtgagccaagatcgcaccactgcacttcagcctgggtgacagagtgagactctgtcttaaaaaaaaaaaaaaaaaaaaaaaaatttagatttttgactgtttcattgattcatcttagacttcacatgaaaatatctgtatatcctcaaatgcttacattcttaagaagtatctcagccatttacacatgatagaaacaactaaatggaaaaaaattgcagttggaaattcactattttttatttgatccgataacaatgtgacatttgcgattggactgtaattttctgtctttctctctgaaaataagttcaaaaatttccctctaattcttttactagataagaagcctacttcgttgtaactcttgatatatgtatgtatttaggaacttaagcttttctgctaataaatgttatgtcataattcttgaggatagtattatattgtgatgggttttcagtaaactacaggagcagccctatttgtttaaaccctagtttaacctgattattaacaattaaattgtgttttcttctaacaattaaagtgtgtttaaatttattggtcccttgcttcacagatttatctcagtatgtggtgtattcaaacagaattttgtatttttaattaggggattagataaccaattctgaagagccaaaaaaattgttagacatcacattgcttaaccatctaatataccataagtgtgtgtatacactatgttgtgggagccatctatcaggcaggcctgtttttcaggcagtattttaaaaagtggacatgtgcagaaactgtgagcacaattagcgccaagcagataaatccagctctaatcctgtttacggtctacatcagacagatgtgccaagattgatttagacaagcccgaggcttacagtaatatttttaaaagtgccattcgctgttctatttttgttaaacctttgctaaatattcttaagtcttgttggttttgctcttcttattaaccaccgtaagtaacctactttaagcaggtcccgctttgctctcatggtgacaaggtaacctgccaggagaggttatctttattccctgtaattaagttgacttttccccccaaaaaaatacaacaataggaagtgggtgctgaattaaataaatagcatgatacccagtagatgtatacttaagttccttgcaagaacagatggtccccagtatctctgtaagtaatgtgagaggacagttaatgttctgaaacaactagctataaccagtatgatactaatgaaccagtagatttcaaataataaaccacatgccgccaagcaaaattatatgtcattcataaggatttaattatcataacttgcaaaaaagtgtcaatagatgatttctatatttttatctactgatatcaaatatcaatttatgaatagagtttcacttcatattttttaccaataaaggtatgttttaacattaaggtagaattaaagttatatttaaaatacatgccccaaagtatgtggtgatttttttttaactcctcttttactatactgtctgtatgtattgggctgtatatggaaatgtagcttttacatacaattaggaaaacaattgcttttatttctagcagaaacttgtactataacagaagtggctagcatgggaatcagagtagttatcttgtagatgacaactgaagcagacataaaagatgtaatattttttcagcactcaaaaatttataagtaaaattttataaacaaaaagcagtatttttgtgattcatatggaaaataaaatgagtctgagtcattcttaaggtgataccgtaaaggtgtatagataagaagtccatttttaaatatacccaagacaacagttttttctctcagtatggtttgttttcccttttttctctttaattatgtttcccataagtatttgtatattctaagaatgtccaaaaaataaatgttttgcagtgggggttgaaaagaaagaaagacctttttagatttcagctgatcttatcagatgatctctagaaccttgaaccttcaaccttcactgaagttagctggagggcttttcacctggaaacctgagaaacctcagaagccttctgctttagctctctctcaagtctaggaagccagtggcctgcgaccccacagagccagctggtccactcctcatataagaacttcggtaacaatacaaagacatagcaaagcaccatctaatctgataactcattaaacaatatttagatggctcaagactttaaataaaaacattttaagcttgtttatagaatactaacaagttttattcccaaagactatattcagagtgagaaaacaattttccttaaaactaatattatatacatgttcatatatgttaggaactagttatatgcaaaatcaagtgactcttgtgattagaactggtcacatttattcatgtagcataaatggttaatattgccaaaatgagtaatagatcagattttctatgtgagatattgacacctgagagatttacagtgtttcactgttgtgaaaaatggagtgctgaagaacatttgtctattgttatacatttgtaaaagaattcacaaattactaatttcaaataagaactaaatatttcttctaagcctatagtttttctttttaatttcttctaagcctacagtttttctttttaatttcttcttgtaacattggcaaaaagaccattcgtgtgaaaacctcagattttgatctgtacacaaatgcaggagtagagattggaagcttgagctggaaaagcaggaaatactgctcagagccttacaaggattttcagaattttcactgttgggtcctcctggttgctgcagtctaacctcgcatctccttgaaggcagccccagtttctgatgaaatactcttcagttaatttatacatatgctgtcttgctgttttcctaaggactgcaggcagaactgtggttcacctactgttttaaatttggctagatttaaaaacagatgatctcacttatatgtggaatccaaaaaagtcaaacttatagaagcagagagtacaattgcggttgtcaagagctgggggaggggaagcaaggggatgatggttaaaggtataaaatttcagttagacagaatgaataagttctggatctattgtatagcattgtgactatggctaataatgtatacttgaaaattgctaatacctgaaaatcactaagagactacgtcttaaatgttcttacaacacaccaaaaaaaggtgtgaggtaatgaatatgttacttagcttgattttaatcatttcacattgtaaacgtgtatggtactgatcttgtacctcatttcattttccatatgaatcagaaaaatactgctttttctttataatatcttatacagcatagatacaatttttagtggtcaattatattgtaatatatacataaatatatatgattttcattggtcaattatactgtaataaaacagcaaaaaataaagttgtaattaaaaaataatttggaagaaaaaattagcaagtggttggagattgaggaagatgggaccaataagtcctccaaggagagtcatacattagttttttttaaaagtccattattaatcttataatatttaatatgtttaatttcttgacacttattaatccaattaagtatgagaacactgtggataaatctaaaaaccttaaagttgagtaaaataaaccagatacaaagaagcacatactttatggttacatttatatgaagttctagaaaaggcaaaacttagctatagtaaaaaaatcatggtcctgagggaataactagagagtggtatgagggagctttctataatagtgggaaaattctgtatctttattgggatagtggttatgtgagtgcatatacttaaaaaaactcatggaattatgcccttacaaatctgtaatttttgttggtaatttataccttaataaaaaacaaaacagatgacagggttagtgattgtttccttgaagaaggtctttacatgggtctgttgttaacgagttgtagtaaaaatcatccaaaatgcttggattcaaatcttagatctgttcctaccagatgtgtgaccacagacaagttacttacattccgtcttcagtttcttctcttttaggaaaaagcatctagtttttgttgtagagattaaattagataatacaaatgaagtacagagaacagcgtttggtgtgtaacacatgttcattattagctacccttattttttagagaatggaaatttttaaatttaaactaatcaaactattttaggataagcaagtgaaacaatctttttttcaatcgatcacagaaatattttcactgaagacaaattagacatttatataagcaaactacagtgtcattaccattcaaattttcatatgcatattcatgcttacatgcatatgaaagcattacacatatgtattctataaatatatacaaaacagtaatggaaatgtgctgtactattttgaacatctttctagtcagcccggcattttatttacttttgagacagggtctcactctgttgcccaggcttgagtgcagtagtgtgatctcagctcactggaggctggaggtcctgggctaaaggaatcctcctacctcagcctcctgagtagctgggaccacaggaaagcaccaccatgcccagcttatttggtttattttgtttgtttgtttattttttatttttttgtagagatgaggtctcactatgttgcccaggctggtctcaaactcctgggctcaagttatcctcctgcctcagcctcccaaaacactgcaatcacaggcattagccactacactgacctctacattttaatagctgagtagccttctgttatatgaatatacttttttttaacaaaaccaatactccattattgtacatttaggttgtttccaagtttcactcaaataatgcttgggtaagtaagtatttttatttattattattatttttttgagatggagtttcactctgttgcccaggctgaagtgcaatggtgtgatcttggctcactgcaacctccgcctcctgggttcaagcgattctcctgcctccacctcctgagtagctggggttacaggtgcacaccatcatgcctggctcatttttgtatttttagtagagatgggatttcagcatgttggtcaggctggtctcaaactcctgaccctgtgatccgcccacctcagcctcccaaagtgctgggattacaggccgtgagccaccacgtctggcctggataagtattattttagctaaattgtgcatatttattcccttagagtaaattcctggaagtaaattgctggatcaaaaccaggtatattttaaagaattttccttttctacattaaaaataattataattctgattacaagaaaggaaaattatggagcttcataagaaaaaattagtctcatatttcatacctcatattgcatatttaataggtaaccagtgttaaatttgttgtgtgttttccactgggatttctttttatctcctttaataaaagcaggatcagatccctcagattactttgtaacttgcttttattctactttttcatacctcttagcatgaatgtctttccagaccagaatacagagatttcacttactcatttatgagctgcagaagatgactatgatttattcaaccattctcctattgaagagcatgaatattgcttcagatacttttgttattataaatattagtgcaattaacattttaaagtcttttgatacatattcccaacttgttctccagcaattaccatttttgcattcccaccagcactggggctacttccctttagttgcaccatcatttagcattatttttgatcttgtgccaatctaaaaggcaaaaagtggtatcttgttgttttaatttgcatttctttgattactaattagattgaactttttcatttgttcattggtcaatttgcatttcttcttttgtgaaatgcctgcttgggtcttttatgtactttaccattaaagtgtttttcttgattaaatagattatgtaactgtcatatgttgcaaatatttctgtccatttggcctttgcttatgactttttatgagtctttaggacttttgaggtctttattaggtattcaataattttaatgttaaatatattgatgtctgtcttcctttgtgtcttacggcttttctatttaaggttacgtaaatttctaatatacaaatattggtgtatattatgaaatagggccctatttttctttacaaaagattagtcagttctaaatcatcctttgctatttctagcggcgcttagatgccaccattatcacatcagtgaatttttaaatgtgtaattgtttcctgatctattcatttctctattcctagatacttctattgtaatagctttaccaaatatatctgatagggtgtgtactccccctcattacttcatttatttatttatttatttagagacagagtttcagtcacccaggctggagtgcagtggcatgaacttggctcactgcaacctccgcctcctgggttcaagggattctcctgcctcaacctcttgagtagctgggattacaggtgtgtgccactacacctggcaaatttttttttttttttttttttttagtagagacagggtttcaccatggtggccaggctggtctcgaacttctgatctcaggtgatctgcccttctcggcctcccaaagtgctgggattacaggtgtgagccactgtgcctggccccctcattgcttttaaaacattttcttactgtaatatatttattccaagagaattttcaaatattttatgagattccttgtccattccttacatcaaaaaataccacggagattttgattgaagttctattataagtagttacttggggtggggggaggggggagggatagcattgggagatatacctaatgctagatgacgagttagtgggtgcagcacaccagcgtggcacatgtatacatatgtaactcagctgcacaatgtgcacatgtaccctgaaacttaaagtataataataaaagaaaataaagagaatactggcatggaaaatatgtaatcttggaacttgttgtatctccacttattcaatcctttgtctctcagtagattttgaatggctctttatcccacacgagtctagaatcattttgctaagtttattcctagatataatatgctaattgatatgggaattttttttatctccattataccttcttcttgggtgtagacatatttgtagccagcttcctcactgcatattttttattaggcctaatggcattaagtttattattttggattttacaaaaaaaattatgataacatctttaaatagttagtttcaactcctcctttccccttaaatccatcaattactgtcttttatttcactttccttatgtactgactagaatgcctagaataattgaatgctatgagtaataataggtattcttgccctgtttttggaaatccttctggatttcagtaagtgtgatgttggcttttggtttagtatctttaaatttgcaatttacaagatattttacattggaatagtcattgagttgttaagtaaagcacaaacatgttaaattcagactgaagtacaggacttcaatgaaaagttaaaagagtttatttcatcactttcattttttctttccctcagtggctgtttgtcccctccccccaccccgctccatcccccagcttccttcctttgtgctcttattgttctaggtttgactacataaaaagagactctcaatttatatgtgatacaagaccataactaatattataaaattagtctagaagaagttatttgcaacctatataataagggactaatttcaagattatttgaaggactttaaagattggtaagaaaaaaatagacaaccgtttagaataaggcaaagcatgtgtagaggcaactcttaaaaaaaaaaaagtgagctgggtgtgatgatgcacacctgtggtcccagttactagggaggctgaggcaggaggatcacttgagcccaggagttcagggctgtagtgcaccacagtcacacctgtgaataaccactccattctagactgggcaaacataagaagactctgtgtcttaaagaaaaagaaatgaaaagatattcagtttcattaattgtttgactagctgatttttggaaaatacccacaaatataaccaagcctacaagttattttaaggtgggtaagagatacatcttatctatatgcattcacctatgtgaagcggacacccagtaacacccccgtgtggaagacaagcttccttaaacttcacaggacagtatttcccatgtagtccatcatagggtgaggatttttcaggacctttggtaagcctgcttgctttcattcttgagggtagaggaagggtgcaagacttccctggtctctcccaagcattttggggaccctggccataagcctacttgctcaacaggtgcaaatgactggtaatatgctgaccagatgcaagtgtaccaccaatgatttgctgtgactgagtttggtttcctttgcatatactatccagctttttgtttctaatatattcttccttaagggaaccaggacttcttggggaatccagatgagcttgaaacactgtttttataagagaagggctgttttcaaaaacatctatagttcgtaacaaaggagttagattgaagggactctcactgttcagtctgtgacaagcatgagtgttaaaatggagacaagaattttagttaattgtaatgttgaatttgtaaaaggctataacttcataatatgatcaaggggaacaagcaatctaaaatgtgttaaagtagcattttcaaagtgcggtccagggactctcagggttggtgaggtcacaactgtttttataatattgctaagaatgtatatcactctccttctctccaaggatacggtggagttttccagaagctatgggatatgtggcgatagccttgccctaatggagtgtgtgctttgtgctttgcatttttgtcctttaaaaatgcttggttttaattttgaatacaataattatagatagatataacctacataaaccaaagttatttgcggccctcagtctttaagggtgcacagtggggcctgagactaaagagtttgggaattgatgttctagagaaaagtcagtcttactgatgagggttaatcaattagtatttactgaccgggacaggacaaaccattcattttataaagacacacagagcatttcactaaaatacttttactctgattaagtggtgattttagtaatagtaatgattgtttgattttctgatacctgaaggaaaaagagcctgttgaattgatactttgagggtgttgagttttaggtcactgggtgactgtagaaatggaccaggagaagaactgaaacttgagccttctaagaaatagaagaccaaaaaatgtttagtgttaccctatcccatgaccacaataattgagaaaaaggcctttccgttccctcttccctaccctcccccttctcccctaccctctcctcccccctcccctccccctcctctcccctaccctctcctcccccctcccctccccctcgtctcccctaccctctcctctcccctaccctcccctccccctcctctcccctcccctctcctcccccctcccctccccctcctctcccctcccctccccctcctctcccctcccctccccctcctctccctccccctcttctccctccccctcctctccctaacccctcccaacctttcccctccttctctgtccccctccccctccctccctgtcttcctcccaccccccactccctgtcttcctccttgtcttccatcctcccttccttcctttccttcctgtctttcttttcctttctttcctttttcttctttccttcctgtcttccctcctctccgtctgtctccttctccttgtccccttctctctgtcttgcctttcctttccttctgtctttttctttctttctctttctttttcactcttcctttttttaatttcccttttacttgccttctctctttcattccttccatgctttcttttttttagtggtatgtatactttgtgagcaatcagactatagcttgcagaatagttgggagaggccaaaaatgcccctgagaatgcaagcaaggaacttcttagtgagcatatgaacatcctcactccaatcggaggataacattgttcatacttcaaggactaaaaagctgagagagggtctctgctttctgttacttttagcactcgagtcatttctgcatgtatttctactgattactttttctcctattttggttcatatgttttctgcttctttgcttgtctagtgattttggattagatgagtgacattgtgaattttactgtgcaggatggctgaattttttttctattcctgtaaatatttttttggcattgttctaggatgtagttaagttacctggaaaaagtgacatccttttgagaggcttgcttttaagttttgttaggtggaatcacagcagtctttagccagctcactaaggaccaatactcttctaaatacttaccataatgtcatatgaatttccatgtttttccacttcagctggtaggaacacctgtgtcatctctaagcattgtactgttaattcttctagtagttcttatctggctttgtacatctgctgatcaatactttcagctaaagtctcaaggggacctctgcaaatctacagtgttcactgttcagctttctcttctgtagtaaattgcacagtgaactctagtccccttagccttcctgaacccccagttctccttaactcagggagatcaccaggccccaccaggattcctgtatctgccctgtgacctggagattctctgcaggcaataggttggggcggtcgtagggtccactttgttttcctcctcttcggcttcactgtcctgtgttacctgatgtccaatgtctgaaaactactgtttcacgtatcttgtgtgcttttgtagttttaggtgaaaggtaaaactagtttcttattattccacattggccaaagcagaagttttggaagtctttttttaaggtctaaaacacttctactttgagagtcaattgaaatggtcttttccacaataattattttctgacctatggtttaaagataagtcatgaaaattttatgccactatttttttttaagtctgattatggttaaattcagggggctatttcctcctagattgacagagtttataatgtttcctactcacaataattgtacttctgcttcctctttgcatgtgttactttaatgggaatgtatatttccttttcgttaaggctgccttcaacaatttgtcataaagtcacttctgttagtgaattctattttttctgttactttactctatccttagtaccaaagagctccttatgtgacaccaatttattactaaaatgtcgctttgtttatgttcttggaattcttcatacattgactatcctcagatgtcgaatgttgtaggcctgtgtggcagggactctcttccatttattctatttttaatctaattcttgacaaaataaacccaatttttcttttcttcccctttccatctcacgtagggactggcataaagggcaatccataaaattacaaatgatgaatttttttggttttaactattattcatacatttaagatatggtcacaatttttatttcttactagtaattcattttattttttaacttttaggttctggggtacacgtgcaggtttgttatataggtacatttgtgtcatgggggtttgttgtacagattatttcatcacccaggtattaagcccagtacccattagttatttttcttgatcctctccctttgctcactttctaccctctggtaagccccagtgtctgttgttcctttctatgaaacacaatggttttaattggaaaatttatttttttttcaggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggtaagtactcctcatgggaaattttaatcagcccagtttccttgatatacatgattaatctagacatgttttgagtaaaaacaactttagtgatgttgagatagtttccttctgttcctagtttttgtcgtgagaaagtgttgaaatttgctaaatactttttctacattaattgagataatcatatttttccctacatcctgttaatgtggtatcttatattaattgattttcatatgtttaacatccttgcattccaggaataactccccaatggccatggtgtataatcttttaaagatgctattgaatttggtttgttaatattttgttgagtatgtttgcatcaatattcataaaacatattgttctgtagtttttctgtactgtttgtctgactttggcatcagggtaatactggcctcatagaatgagttaggaagtaactcttgaatgactattttcatgaagaagcttcaataatctgaaataaaatacttaaataatttagttcacctgagagttgtttttagaagcgtatttatttttctattaatgtcttttttgaactatataagaatgtattctccttccactcacacattgatggcaagtgtgtatttgtactctgtggcctgaaaataagatttttttgaataatcttaagaggccatgctttatactctggtaattgagaattacctatttcacagtagctttttctaaaggttaatttccagagaaaagagaacatgtttattaggatatatctcttaatgaattcagtgtatctgaaatttctaaatgacattttcatattttgcatactaaataaaattcataagtacaaatataatgcaattcataagtacaaatataatgcaatttggatttctagaagttatctagttaaaatatgatcttaggatttattttttttgtcttagatttatgaatcttgcttgtttttctgttaattcatttcttcttgtttgctgcatcagtcagatcagagtagaggcagcttgtatagttgatggcacagtttagggttagatggcacaggatagaaatgggtgctagacaaagagcagtcacagaggcatgttagaaatttccagttccagcatcattgatgaagaaaaccatgaggacccaagttgatcaaaggcagccagccaataaagctatgctcatgcgagatgagctgaagtgacattacattaaaattggaagaccctcttactaagtggctccatgcttccctgctagcccctttgggacttccaagaagacttggttatttcaagaagacaagaacccacagaggctgtagtttagtttatctctctggaaacatagagaatatgtataattaaataaaagcactttaatagtgaatcctttacagtgttatttgaaatttatgtcaagtgatttaaaaagtaaaaatgaaaattaataatttcagtggaagtaaattgattaacatgaccaggaatacataaaacttgcatggtcttgtctataaaataaggatatgtcatttaattaggagagtcaaagctcattcttgcgcttaaggtctgaggaactcttctcccatggggcttatgaagggctacactgaggcaacttcctcaatatatctcagccataaaaccaagagaaagtaagaagcagaggacatcacaacaaagctcaattcagtaaaagcaattttataggagtagagggacttgtcaaaaacaaaaacaacaacaaaaaacaatgtccaaatatttattcagcttaatgagtgatgtttttgtttgatctagggttaaaatctagacaaattacagagatgaataaactacatatcctttagtctaccatcctctgaaaatgttactttttgaaactttgattttgataagagctggaggcactcagggagtcattctctggcatggtctttgagtacagagtgattttgctgattaaaagcaaatagattgacttttaaaatcaactcatacaaacaaactgttaaaatcctctaatgagagtgaagaaacctaaccaagactgactgatacattactgctccatctctgcaccaaagtggactcagggaggcctgtaggagatgccaactccttatcctactccccacaaagacagttcttggctatcttcatcagacacaaatgaatggttgaggctccaaagctctctaccaattcttgtgttacactggcacttttaaaaaattttgtttattttttatttttaaatggagtctcactctgtcaccctggctggagtacagtggcgtgatcttggctcactgcaccctttgcctcccgggtttgagcaattctccctgcctcagcctcccgagtagctgggattacaggcacccgccactacgcctggctaatttttgtattacttagtagagatggggtttcgccatgttggccaggctggtcttgaactcctgagctcaggcaatctgcccaccttggcctcccaaagtgctgggattacaggtgttagccaccgcacctggctggcacttctcttaaaactaatatctcaagaagttttttctttaagaatcttctttcaattgcaggtccatgtagttctggtattcattaaagtgcctatcccaggggttttggtatgttgtgtttcaattttcatgtttcaatttttttgatttatgcattaattttgttttttcagaattcaggtgcaggttgtttagtttccatgtatttgtgtcgttttgagaattcctcttgttcttcatttctaattttatttcattgtgacctcagaagacacttgcattgattttgattttttttatcttattgagatgtgacttacgactatgtggtcaattttagagaatgttccatgtacagatgtgaaaaatgtatattttgtgttgttgggtggaatattctgcagatgtctgtcaggtccatttggtcaagagtctgatttaagtccagtgtatacctttgttagttttctgccatggtgatctgtctggtgctgtgagtggggtgttgaagtcccccactattattgtatagctttttttccccataggtctagtagtatttgttttatgaacctgggtgctccaacattgagtgcatatttatttaggatagttaaatcttctggttgaattgaaccctttatataatgccctcctttgtctctttttgatgttgttggtttaatgtctgtttcttctcatacaagtatagcaacatctgttcttttttaattttctatttgcatgctagatctttctccatcccttcactttgagcccatggttgtcattacatgtgagatgggtctcttgaattcagcagaaggttaggtcatttaaaaaatctaatttgccactttatgtcctttaagtggagcatttaggccatttatgttctaagttaatattgatatttgaggttttgttcctatacatttgatatttgtgtattgttaagtagttgctttctagtttgaattgtgtaattgctctataagatctctgagccttgtacttttgtgtgcttatatggtagcaagtattgttcttttgtttccatgtttagaactccttggagtatttcttgtatggcaggtgtggtggtaacaaattcccttagtgttttcttgcctgggaaagactttatttctccttcatttatgaagcttaatttggcagattatgaaattcttggctggcattttcttttttctttaaggaggctaaaagtaggcccctgatctcttcttgcttgtaaggtttctgctgagaagtcctctattagtctgattggatttcctttataggtaatttggcccttttctctagatgcctttcatattttttctttggtgttgaccttgcatagtctgatggactatattccttggggatggtcatcttgtatcttgcaggtgttttctgaatttcttgtatctggatgttaacctctctggcaagattagggaaattttcctgaattattgcctcaaatatgttttccaatttgcttacttcttcctcttctccatcaagaatgccagtaagtcataggtttggttgctttacataatcccatatttatcaaaggctttgttcatttttcagattctttatgtttgtctaactgggttaatttgaaaaggtggtcttcaagctctgaaatcttgtcttctgcttggtgtagtctgttgttaaaacttccaagtgttgttttgttttgttttgttttgttttgagatggagtctcactctgttgcctaggctggagtgcagtggcatgatcttgactcactgcaacctctgcctcctgggttcaagcgattctcctgcctcaccttctggagtagctgggattacgggcgagtgccaccacccccgactaatttttgtattttttagtagagacaaggttttgccatgttggctgagctggtctcgaactcctgaactcaggtgatttacccatcttggcctcccaaagtgctgtgattacaggtgtgagccaccatgcctggcctgcttccaagtgtattttgatgttccctttagtgaatttttcaattccaaaagttctatttggttttatcttaatatggctatctcatgtttcatatcctgcattgtgtttctggtttatttgaaatggattttaaatttctcttggctctcactgagtttccttgcaatacatattttgtttttttagtctgtcatttcaaagttttcaacttggttaggatccattgctatagagctagtgcaattctttggaggtatgaagacactctttttgtagtgttggagttcttgggcagattccttcttatctgagggagctgttgattcttatttttgaatttcctattggttgggcgggacttaaactttttttttttttccccttgagggtatgactatggtgtatgttgtgtgtgatcattcaactttgtttctgggtgctttcagggggccaaggctctttatggattccttgggcgtggtagctttcttaaatgctgcttattgtagcaatgtattggatttgtgagctgacactctatctcatgtggggctgagggtgcagaagtctcaggaagcttattttgtggagtagtgctaagcctttctggtagtgggctttttatttgatagtacagttcaggctgcaatccagtagatggcacttaaaaaataagaaccagcttgccctcagttaggctgatgtccagtagaagcacctgtcctgacaggggagtgacaggaagagattctgttggtgtgtgccgaggcctttggggtcgctggttggggggagatagggggaggtgcactagctcctcatgcaggaatgtgatctgcttttctatcataccccatcagagggctcatgaccttcagttcataaagattttttccttgggttcccagccatagtctgtctgtaggttatgcatatgcccctctgaaggcaaccaccaaaatggtcttggggcagagcctcttcccccagtctagggcagacaactccatgacttgtatgtcctccattgctgggacactgctgctctgtgtagggatggggagttgggccccaccctttatgtaagcctaagtggcattctcactttcagcaggggtggagccatcttgaaaaccatgaaaaactctttcttcgagtacctgtgctggcccccagtgggaagaaccactgctgcgtcttcaacagcgtgtggggtgggagggtattgccacagatgaccccctctccatatccgttccttgacatggtgttgccccctttagcgattggcactgtgcccacctttcctttgtcccaaaggggttttggcaagttgtgtccctctcccttataggtggcctacactaggggggttagatctctagaggttccatagctccctgggaacttgctggccccctgggcttttcaaagtcagaacaggttatgaggtatgtttgctggggatctggtgctacagagactcaagggtagagaatccctgggcagagcagaggcccaccactggtgcacaagcaatatggtgaccaccatctcagtttgtgtctgaggggagtatgggaacccctgcaggagctggccacccagttctctatccctgggaaattcctaaattaccaccaataacattgccctgggtcacaagggtggggccttgaattctttgggggttgatctctgccagactctagctacttttcctttctgcaccccagcttcttcccatgggcactccaaaaggtcctggctctctttccccagttttccattagaaacttgtccatttgacagtaactttgatcttctttctaagaagagctggcatccaaggtctgtggtcagctatgttggaaaaaagaaggagaaaaaaactagtttgtattaaattctgaaagactagtggcactggttaagtctttaaaggattgttaacaaaagaaaatctttttaaaccaaactcctaattttatcagaattgtaactgaaaatataaatgtatgaaaacataggtattatgtaaaatttgctcaataaaagaataggaaaaactactatttatcttggactgatagcatgttagtttgagatttgaaccctttctactctagtaagtagtggtgggaaaaattcactgtaggagtctgcagacataacaaactatcattagactgccaagacctccacataataaagcaagcagagaatgtcaaataagtatgtgaaaaatgatcaaaaaagagaaattgaaaatataaatagggtgctattaaaaaaggatagcatttatgttatgacatatgtacacatgaatatcactttttagaatttcatccttcttaggacttattcctgagtccgaggattgagaggttctgataaaataagtctcagtgggttccaggcatgggctttctttaaaagtctctccagggattctaatgtgttgccaggaccaagtaccatggacagccaagatctcatcagcacagtttgattgaatgaacttatgtagaaccctgaatgccacacttaaccaaagaaacctttccagggattaattataggtgacagaacatgctatattcttattaaatattattaaaagttaagcaatacccattcctgattcatgtaaaattctcacttattttccaagagttttactgtatgactggtttatgggatgcttggaaaaggttgacagacatggcaaaggttcctgcagtgtttctctttgtccatcaacagccctagctcataacctctaccctttcagctaaaagcaattagctcttcagaagtgattcattctatttatacttgggataagtaacatcaggcagtcttccctagggcttctcacgggccctggtggcatttttattctaagagagggttatatttttacatgtaattggtcataattatactaaaaacaagtaattggtgtcttatacaagaaaattatatttctgctttagtcattgacagagtatcctgagaataagagttaagaagtatattcattgtcatcttatttctgatatatttcaaattcttttgctaggaagaagcccttttgactgtgctttgtgtaacaaaacttcttcggagaaacaatttagataaactttgtcagatcttatgtgattatattcaaaatgctaattgaagattctctaaacattttcagtaaaatgttgaattgttttcatgctgttaaataagttaacatgtcttcctttactaaagtcattattataaaaatgtaaatcctaatgataatagctgatgtttattaagcatttagtaggttccattttttgatagcaacttttatgaattatctcattaaatcttcataataatagcatcaagaactacaaatatgttttcatgtaagaagggaaataaaattatgagttttgctgtgaggtttgaagaatgaaaacaatgcatgacttagaaaatagtataattaagtgaattttattatcattatcatctcttagtttataaatgaaaaaactaaggcttacataatgtaaaaatcagttaacaaggttaaacaaccgrtagatggtagaggaggagctgggaataaatctgtacatgtctgaatctggagcaggaacccttaactgatgtgtcattctagcaggtcatcagttactctacaatacctattaagtatactttatttactgtgtttagatttatagtagatttagactctactgtaaaaacaaggacttcatacacctgctagaaagtatccatatcatcttgtttgaaagttgtcccgctctagtgttcttttctaatcatgatgattcagaactccaaactcttgaagcagggcaacccgtagggtcagcattcataatttctcaatacttaaaaaagtttcctcatgactgttgctattattgagatttctcaaatgtcttggcctgaattgggtgtgcactatgaaaaaaaaaatggcagacatttctttttgttaaaggaattttaaaaacacatataaacacactgatttgtgacagattaccaggctttatgtttagcagggtttcctaagcaaaacacaaattctgtaaatctacagaattagataaaacattgactcaatccttagatgagagtataatggattatcacttaataacttctgtcactgaaaataaatgatgtaaaaagtaataaagttctactctcacagtatgaataaataggaaatacataatactttaaattaggcaacaaatcattaagcccccagcattcattagactatcattaatgataataaaattgtgtggtatttatacagatattatatgtaactccaggaattttgttataattgtgtatgaatatatttgttgtttgaggcaggtagatggatatttgcagcagctatgtgctgaagcattctggtaatagttttcaaatcaaccatttttttctccttgtcgatcatctttaaagcaaaagcaccgttttttactatattttttgaaaaaaatacattaggtgtaaaattatatattttgaagaagttcactttctgtttttactagtttcacacctttgttattttttcagtggaaggagcagagataggcaaaggcgaagcctgtgtgtgtggtcaggttcctgggcccttcatagcatctgatgccaagctgtgttctcttttgtgtcattgccttcccacttgctaattacgtgacagagctagggacttccctctgtctagaatgccccccatctcttgtttgcctagtgaaatctggtttgaagttcaaggtctgatacaaaccaggtgatcctctgcaaaactaactgtacctgagcaaaccaggcacttactcttttatatgttcctggcactgctgatactctgatagaaaacatcatcacttaatgctaactgtgggctcacaaaggggatacttctactgtaagaagactgtaactcttcttagcacagagattagtaagtacttgaaacagagtttcacatataataagtgttcaataaattttattttttatttctaacacttggcacactgcatagctcagtaaatgttggtgaagtgaactgagtattctccttatctattatgtggtaggcattattctagttgcttctgttataaaccaactcatttaatccttatcacagcacttttattgtggtcaatattttttaatcctcacagatggctaaggaatcagcactctgagagattggttgacttgctttgggtaaggtgcttataaagtggtagaacaagattcctatccaggccttctgattcaaaaatacattctttttttttttttttttagtagtgttttctggaaaggcagggtataactgactatgctgtgtatttgggactaagtatattattgtcaagtatattaaaaatgtcgcaacactggaaaggagtccatcaatgggctatgcaggttgagggatttgtagatgagaaactgataaatttggttagcaaggaaagccatcaagctgtgaaccctttatattggcaaaagagagggtcctttgaaatctaagggaacagaactttcctgttctccaagtttggagcagaataggtaagctctaggcagtctaatgcccaacttttaccagtggtgttttagttttttttttttttccaaaaggaaatgatggaattctttatatacttctgaattgtctatcttttcaaaaataaaaattttcattttgcagtacatacagaatcaaaagactttcaagtcctaactccacaaatgtttattttgaagctctttaaactgtttaccacggatattagtaaatctgtcagaaatgaggtgacttacttatccttgtcccaccagatatgtgggaaggatgatcacgctagatagcatggatgggtcctctatttatctctttttacttgaatggaaaacacatcattcagattaatcaattagtcattgtgactgatagaatttttatatggataatctgggtttggtccctagctttaccacttacttggggtctttatgtcttctatggtctcctatctgtaaagggaagttgataatgccaatctagctaggttactgagatgcttaaatgtgtaatgtatgcaaagcagcaggtactcaataaagggtaactcttactattattgtatagctctccaggtatgtattgagcttctatagaatccatagccccaaactctttagccctttgagaccaagattaagcattgtctttccagaggagagggtgagagagattgccattatactaatagaattcatcattatcaccgtcatcatcatcatcatgatttcttggtgtgtcatggaatgtactgtgtttcacattaccaacagatgttaattttcacaacatccctgagacaagaaactatgattacattttacagataaggtcatgcagctataaagttgtgaaattgggattcaaactcaggcagtctgtccccacagtccatgttcttaacccaccatgctctcctgacacttgaaaagttaggaggcgtactccatagcctgtaatgttgctgcagagagaatctaattttaaatccagtgaagcatattagttgctgtctttgatatgccattcagattgtgctatccttatgatgcctaccttggttgtatatgtaactgggcgtcaaatatataaatactcaaaaagtgataggtgccaataaaatattttatagttaatacttatgtaatctgtgttctctgtgtttgagggctggttctaaaatactgctctatatttgacttctggttaaaacaataaactttgctcatattagttatatagttgataccattctcatgttgctaacatgtctgtaagtaacagttgaaattgatctggcaattttagagctgtcagacccaggagatgagagaaacatttaaaatgtttataacattaaatcagctgagtcaagagagagaaagagaaagatgattcagatttcttgtactggtggatgtaagtgcttggaactgaaataaaggagaaggtgtagggagggagaaagataaagaagtcttccctttatacaagttgaaattgagttttctttgagatatagaggtgaagacattttaagaaacttcttaaaactctctaatgtggcttttcaacctgtttccatcaatttggcacatctcacttttcggcacaacagaatattctaggtttatctcacaccttccttgccccagcccaggaatcagccatttctctaagaaactcttgtttattttggtggggaacagtattgggaaaccaacatctgggagctaaatatactcctagtggttaggaggtcataccttgtagactcttgtagctgacggagttaggacatatttattagaaatcataagtttatattgatcttgctaggatctatccaatcctacaagattcttccctgtgtctctcctttgtatttgtgtatcctttcttccatattaagaactgtggctcccaacaacaaggcatgtgcccatttgcccaatcgtatgatgtataaaaactactttgagaaaagtggcagccaaaccactaagaaaaataaacttgctgaaatgagttcaagatttattggcagctctttttttggcccctagactgaaagtatatatttcaagtattgtgttcaaaaattatttgggttagctttttccacctttcataatagtaatattatttacttgaaatacagttggctttgtttctatattcagtttttttctctctatcttcattaatttcattatatatatttaatatgtaggacattaacatgtttccaaaagaagaaaacactccttcctgtatcatttccacctcatctctcttaccccttataggtaaccaattgcactggtttctagtttatcttacttatattcctatttgaaaagttacctcatatatgtatgttttttaaatttttatacttttttacacagaaagtaacgttcagtatgtactttgccactttccttttaaacttaacagcgtatactggaaatcactccatatcgtgtcacagagagcttccttatattttttaatagctgtataagacttcattgtgttgtctgtaccatattttattcacttccccatgtgtggacattttgactgtttctagtatctgcaattactaataatgctgcagtaaactttgtgcatatcgtaccttggtaaatttctagacatagatttctgggttaaaggttaagcacatgtgtagttttgttagatattgataaattcctttccatggggtttatatcatttttaaaatatttaccagcaacgtataacagcgtccattacttcaaagcctcaccaacagattgtatgttttaagtacttttatgttttagaatttttccaatgcgataggtaaacaatggtatatcaatatagttttaatacattaaagttcagcatcttttcaagttcggctagtctcagggctattcttaatatcttgtgaattatcttcatattattttcccatattccataatacttttggttttttttcctcctcaattctgacaagttctttatatttcaggaatattagccattttatttgatatgttacaaatatttttctcccaatatataacttttctcttataacgatttttttttcatgaaaagtttttaattaaaaccttttatgggcccaggtgcagtggctcacacctgtaattccagcactttggaaggctgaggtgggcagctcatttaaggccaggagttccagaccagcctgaccaacacagtgaaaccctgtctctactaaaaatagaagaacattagctgggcttggtggcacatgcttgtgatcccagctactcaggaggctgaggcatgagaatcacttgaacccagcaggtggaggttgcagtgagtcaagatcgtgccactgcactccagagtgggcaacagagtgagactctgtctcaaaattaaataaatatataaacaaaaccattatgggccaggtgcagtggctcattcctgtaatctcagcactatgggaggtcaaggtggttgaatcatttgcgccaaggaactggacagaccagcctgggcaacatgggaaaaacctctctctaccaaaaaagaaaaaaaaaaaaattagctgggtgtggtagcatgcaccagtagtcccagttactcgggctggtcacatgagcctggggaggtcaaggctgcagtgagcagtgattgtgccattgcactccagcctaggcaacagagtgagaccatttctctaaatacatacatacatacataccttttgtggagttaaatttacacactttttctttattggctctggcttttgcattgtagtaagactttctttacactcaacttatagataaattcacccatgttttcttctagtacttgcatagttgaattttagatctctagtccatttggagtttattttttgtatggtagaaggtattgatcctattttttcccaaatagttgttacccagttgtcccaaaacaagttattgaaaagtccatctttgtcccagatagactggaacaaaatgaattaaagacttaaatatgaagatttttacttgtgtatcctttcttcctagaaagaaaacataggcgtaaagcttcatgacgttgaatacttcatgccattggtctggcaataatattactattatgaaaggtggaaaaagctaacccaagtaacttttgaacacagtacttgaaatatatactttcagtctaggggccaaaaaaagagctgccaataaatcttgaactcatttcagcaagtttacttttcttagtggtttggctgccacttttctgaaagtagtttttatacatcatacaattgggcaaatgggcagatgccttgttgttgggagccacagttcttaatatggtagaaaggatacaccaatagaaatatttatatttaagtctggcaatcatttttaagatgtgaacttgaacaggcaacaaaagcaaaaataggtacgttggattacatcaaacccaaaagctcttcacagcaaagggaacagtcagttgagtgaagagacaacctatggaatgggagaaaatatttctaagccacacatctgacagagggttaatatccaaggtatataaagaactgcaacaactcaatagcaagaaaacaaataacatgaataaaaaatgagcaaaggatctgaatagacatttctcgaaagaagacataccaatggacaacatgaaaaaatactcagcatcactaacaatcagggaaatgcaaattaaaaccacagtgagatatcgcctcacacttgttagaatggctgttatcagaaagataaaagataagtattggtggggtgtggagaaaaaggaactctagcccactgttagtgacagtgtaaattagtatagctgtgatggaaaagagaatggaggttcctcaaacagtttaaagtagaactaccatatgatccagcaattccacgactgggaatatatccaaaggaaatcagtatattgaagagaactgtattttagtgattattgcagcattgttcccaatagccaagataagggatcaatctgagtatctatcaatggacaagtgataaagaaaatatggtgtgtatacacaatgggataccattcagcctttgaagagaaggaaatcctgtcatttgccacaacgtggttgaacctggaggacattagctgagtgtaataagccagccaccaaaagaaaaataccacatgatctttcctatatgtggaattttaaaagttgaactcaaggaagtagaatagaatggtagtgaccaggggtatgcgataggctgagggatcaaggagatgttggtcacgggatacaggatttcagttagataggaggaagaagttcaagaggtctattgtataccatggtgagtatagttaattataaagtatacttgaaaattgttaagagtagattttctgttcataccacaaaatgataagtatgtgagataatgcatatgtaaattggctcaatttagccatttcacaatgtatatatatttcaaaacaacatgatgtacatgataaatatacagtttatttttaattaaaaattttaaactctctaattggtcttcaacatatagtacacaagtcttttcacgactctttataatggaacatatgttcttggaatgctaaaaattattttttttggaggccctgcaaataactaaaaatttatcttaaaagccacacctaattacttacatatgatccagaaaggatactttgaaaaagctttttaattgataaaatcattaaggtaaaacatattcataaaagtgttctctaataattttataattttctagttcatgaaggattaaatatacaactatcatttgaattggattttttatgaggttaattgtatttaaatgctaattattttaactaattttgtggttgacttctatgtagagtagggaaaaagaatttcctaaagccagttacgtatatctctttttagtctggatttttaattaggaaaagtgatatagttaaataggtctactctatagcatcttctaaaatgagtaaaaattcattatatcaggataaaaaatgataaagatatatggatgacacatttggctgaatttttcttcttcgctgttctcttgctctctatttaaatagtcttagctcttttatcatttaaattctgaagtattgaggtgattattccggcagcaggtgattctgctaattactgttcagtcagttttagctattagaaacagagatatgtttacattgctgggctgcatgtaaatttagaagttacatggctttgtttttactttgacttacggcattaaaattattttcatctgtgtatgtaaagatctgcatctataagcttttgtggataataaggtgaaattgatgcattttaatataaattgccaatataaaatatctctaactcagacctctactggaaagttgtcaaatcttatgtaggaaaggcttttaccatcactgttacacattaactgggcatagtttaatattaatagctcctgagacttgtggttaactgaggtttctatttcctgtgtttgggttttatctttgcaacaacttggttgcttttctgtgtaaaatagtggtgaatatacacaagagtatgacaaggttctgggctcttaactttgatgaacaccatgccatttccatcatgctgcactcaaaacagcacagatgtgagtctgggagtggcgtccctgccgctctcatgagcctttgtttggagaacaccctgattaacccccacccttcacggttcattgactcactgatagatcaagtttaaactagtatatattagcacatttgttaccaacagaggaacagttggccattctgttttacattgctggttcattgcaaactggcgtgctaaaaaggtctgtactctagagtatgaattgggaagttaccaaaggactgagaaccaagtcagttgcatattaatgttgaattatacctatattttaatcttggattgtctacttgggggatgcttacactgttgtcaagttatgaataagtgataattaccactttgaaattcatctttttttttcaaggagtttaggggatttaggtgtctcaatatagctttcatattaaacagtttgtcataattggatgagagcagagcaaggtcatgactacctgatgccttgtgttggagcattttaaaaatgttttccagagagttatttgtacctaatgactttacataagtccttacattatactttatttctaggtcacctaaaaatgttaattgtttagtcaagagggttaggatgtgtgtctgttttctcatgaaaaaaattaagctgttccctttttatcaattttcttgcaatctaaaggcttttttttcttaccttcctaacctagtgactaaggtcatcttattgttacagttcctttcatgggagataggtttactgcatcatttggcagtttcatagggtgaattttgtcttggcttcatctttccttactggttgtcatcccctgggccacctgcttttttgcattttcctttctcttgtgagatgatgaagctctgtgccccgatggggatgagagacagcactctgagttcaagtctaggataaggcaatgggcttgcttttcaaaacaaactagtgtcatacgggctgctgctttcaggtccactgtctgattttatcactgatgacttgtttctggaaggcaaactgatttaagttctgagcaaaagggtcggtgtttattttcaatgctactattaatttagagttttaatttagaaaagattttttaccagttctcaaatatgatttttctattgactttaagtttgtagatataaggagtagacatgagatagagactgaattgcttttttgtttttaaaacttggcagtaataaggggttgcttgttttttcatgctaaatattttttctaagggatctagatacctatcagaaaacttaactttgataactctggttctttattaagtatttttgtcttattttaggaattaatagaaatagttgtaattttagacttcctttataaaataccaatttaaagagaagctttttgcttaaatgattgttttgcagtgttgtgcttttgttttctttaatgcagttgaaatcgcagctttataacttattttttaatttggggtttttaaaagaatattagttatttatttatatttattgggcacctactgtgtgccagacactattctaggaactagtaaacatagcagagagcagaatcatgaagttcttgacctcaaggagcttaaatcctagtggtagagggggaattcaaaaaaatcaaataaatgtatttctattatgtcaagtgatggtatgtactaccaggcaatcagatgaaaatatttcctcttctatacacagtgggcaaggaaggcttcattgactgtggagttttagaagaaagctgaaagtaatggggaaagagagccatatcgatatatgaaggaaaacatggtccaagcagaggaaacgaaaagtgcaaagaattgagcaagaaagtcatgttcaagtggagtcagcaggggaaagagtaggtcacaaatgcggctgagggtgggtcatgaagggccttacaagctttgtatgagtttttacttttattctgaaaaaaacaaaaacaaaaacaaaaaaaaccggggagctatttggggattttaatagaaaagtaacataatttccttttaaaatggatatgtggccactaagtggagagagtggtgtatatatgagtggatggaataattgatacaggcaagcaggagacaggttaaatgaaaaatggattaatccaggcaaaagatggtgacttaaattaagctgggagtgggagagatggtgagacatgcttagactttggattcatttttccagatagaactggctgacagagacatgtcatttaccaacatagacatggcagattttttttttcttttctgagacaaggtcttgctctgttgtccaggctggagtgcaatggtgtgaccatagctcatggaagcctcagactcttgatatcaagtgatcctcccacctcaacctccctagtagttgagattacaggcatatgccactgtatccagccaactttttttttttctgtagagacaatatctctctgtgttgcctagggtagcctttaactcctggcctcaagcattcctcctacctcagcctctcaaagtgctgggattataggagtgagccaccatgcctggccaatatggcggttattaagaggataagtcaaagattacatgaatattctgttatgaaaagtgtcaaacatatagaaaatataaacagtattccagtgggcacccatatttttatcaccttgattctacagatcttaacatttttctgtatctgcttcaaacattttattctgccaatgtgttctaaagtaaattgttgatattgtgatagttctctccaaaatgctgcagtgtgtagctctaaaaatagatatttttcagataaccaaatatcattaacctgccaaatcaatgaatgataattgcttattaacatttaatacttggtccatagtcaaattctccatattttccataatgtcttttatagttaacttttaccaactagtgtctgatcaagaatcattcatttaactaattacatttaaactgtaacattacaacatgttttttcgtatgttttattctctctgacattgacttatggaagagactagattatttgtcctgtagacattttatcatacataagagttactaggagagctctgattactagtccccactctcagaaattttgattcagttgctctttccagtgagctgctggtgatgctggactttcattctgaagaccatactttgagcactactgctgtaccactatccgatggcttctttgtgatatcgtttaacttgttgttctgttgcctgtatttcctctaaactgaattttcaatctaaaggcttactgagattcatgtttgatactttgggcaagaatacttcataagttctagtgcttaatgttaggtagcacttaattctgactatttcactattcatgaggctaagctaaggaggtgacagcctgatccttctattgtaatgtttcatgtgaaactactagataatttgttgagttggggggtgggtagggaagagatatctagttttcaataaatatttcacctaatggttttaacacacattgatcatccttgcctgaactaattatttaattagggatggcaacatggagactttctaattcaatctttttttttttttctaaatgaatggccttgtttttatttttaaatggatgttacttcgcaactggggttatttgattacccagaaatatagcgcatattaaaaaggtaggataaatgcttagttaactaattaagcaatttttaattaccagttttcacagtaaggcactaaagtttctgacttgagcaaagataaagtggaaagataaagtggtcgtttagtgagatgggcaagactgtggataggtagactaggtttggtgggaaagtcagaatatcagttttgaatatgttaagtttgagatgtctattagaaacatatgttgacgaggccaggtgcaatggctcatgcctgtaatctcagtactttaggaggctgaggtgggcggatcacctgaagtcaggagttcaagacgagcctggccaacatgtgaaaccctgtgtttactaaaaatacaaaaattagctgggcttggtggcatgcacctgtaatcccagtaatcccagctacttgggaggctgaggcgggagaatcacttgaacccagggggcggaggttggagtgagccaagatcccgccagccactgcacttcagcctgggtgacagagcgagactccatctcaaaaaaaaaaaacatatatatatatatatatatgttgacaatatttcagttgaataaaataaaatattctagctattttaggtagaaaggcattttataccgatactactactaaagggtaagaagatatgactgtagtacattaaatatgctgatggcctacaactgttgctgtgttgctttttcctcttcaccacacatatgcagcctcatgaaacattttccatgaccagcacactgaaggaaataaaaggaacctagtttagagatggttctgcatgatacaacaaaaatgagctgctaaagcattacaatcccactcaagagtattcccccatcaaatagtggggctggtattttaatcagttgatactaattgtcaaggtgtgatggccaagggattgatgtttatcagtgtatggacagtggttcagagtttggtgaattagtcgagttgaaagagaaagattggtgacaaagatgtatgaggtggaaagtatactttcacagaataagaacagaaaatgagatttatgtttttttgtaaacgttcaacaaagaaaattcattcagaggaggaaataggtaggcaagatgccctattctacagatgttagtcagcatcactgcaaagcaacctcagggcttatgcagtggacacttaaaatagcactggtgcagggatgggagaaataaatggatttaataagcactgctgcttaccaaggttgattgaattgccactattgccaagtgttctacctgcaaacagatcaaccttgagccctggatatggcaccatgtcccagagcaaccagccagccacctggtggcaggttgattgcattggatttgctccattatggaaggtcagtggtttgtcactgctgcgatgaatgcttactgtacgtttggatttgcattccctgcccaccatgtttctgtcagcaataacatggccttattaaagccttattcaataatatgacatcctatataatattgcttttgatcaggagactcattcacatcaaaataagtgaggcaattggctgtcaactacaggattcactggtcttaccatgttcctgttgtagcatattgtattctacctggaagatgaaaccttgtgacattaaagtagtttttagttccataaacataatacaggggtctatgaatcaagaagtggaggtagaagtgttgtcttttacttcacatctaatcacatgttcaaaatattttttcatcttgcctctgcaactttgaactttgctgacacactgaggttttagtgtgaggaaacaatactttcacatgggaacatgatagtcgttcaattgaactggacatttagaataacctggccacattactgaactgtataactgaaacaacaaatgaaaaaaatgaagatgctacgctggcaaagatgattaattttgattattgggagaaatagtattgctactgttaggaggaagactatatgtctagaaactaggaggaaacctgggttgcctccttgtagcagggtaaaatgagtgagtaccttgtctaagaaagggaacatgaccaaactgaacccagaagacataggaaatctaaacagatcaattaacaccaaagaaacgggcattttttggtacttctaaaaaagtaccagactgatattttcacagagatgttcgttatacccttaaggaacaggaacagaaaacttctatactatttaaactattttagaggatagaaaaggaaagaaaactccagattttatttatagaacttgcatgaaattgataccaaattctgacaatgcaagttcaaaaaggaaaactagagatcagtgttacttatgtcaaacagctcttaatagaatagatggatatggttatcaacatgataaatatgtttatcacattttaaagcctacatggagaaacatttgaggttttcttattctagaactgacaggaatgtcctttattatgagcactattagtcaaatttttctggtggaactaatgtaagtagactgctgaagaaaatgaatggtatgaacattggaaaggggaaattaaatgattattatttacagataaaataattgttaagctggaaaatccaagtgaataaagggaaggcctacaattaagcagttaaggaaagggctaggtatagaaatcaatagttttgatatatgcaggctatagccagttaggagatcagttaggggaaaaacacgttgacagcagcaacgaaaagctgataaacctagaattgttcaccacttatcttaaaatgtttaacatggtactgagggacacaggagattatttatgtggaaaaacataccatgtttctatacagaaaaattgaacatcacaaaagtattatttgatcttaagataatttatatttaatgcaatctcagtgaaataccaggagaatgtttttaagctagacaaacttatttcaaagatcatatgtaaaaataagcaaaaatagatgtgaaaaattctttaaagtaatgagagaccagtcttattgactattaagtcattataaaactataatgtttaaaagatggtactgacatatgaatagatcagtggatctcagatgggcagtgcagaaagagatccaaacacatacaaaaatttagtacctctaaaggtggcatttaaaatctgtggggaaagatggattttccaatgaataatgttgggataggtagatagccatctggaaaaaatgaaagtcaaatcccaactttttaccttttatcaaaatgaacttcagatacaattgaaaatataaaattgagaccataaaagtattagaagaaaaatgcagtttttaagtctcaaaaggggactcttaaatatcatacaaagcccagaggccataaaagagatgattgataaattcaaatataggtccgtgtaagcgaaaactttcagtatggagaaaacataagttattaaggcaaatgacacactaggaaaagcatttgtaactcataacaagcctagttttcttactgtgtaaagtactgccataattgacaaagaaaatatgaagaattggcaagtgacatacatagaaagttcatggaaaaaataactcttaaacatttacaaaattttacaacctctcatgaaaagagaaatggaaattgaaattagagtcacatacagtatttcacttttcatttgtcaaagatcaaaaagtttgaacatactgtgggtttatgtttataaggatgtaagaaaacaggcaatctaaattccttgtagagtgtaaattggtagtaataagagaaaaatttactgaatactttgtgccaggtgcttttctaagcactttacatttaattatctcaattaacttatccagaaagtaccattatttctgtattacacgtgaggaatttgaagaaaagttagacaagtaattcaaagtcacacagttaataaatgacagagtgaagatttgagaccatttcctttttctcaagtgtccacttttggtcgcaactctgctgtttctgtagtgagtgatttaacactatatgataaaaccttaagagtacgtactctttgatccagtgattctacttccagaagtttgtccattttgcatcaaatagatggagaatagcattcattgcattgttatttgcagtaaaggaagattggaaacaacctgaacatttatcctcaaggactcatccatacaaaagaattgaagtaaattcatccagatgaatatgaggcagctttagatagagtgagatggcatcctatgtagtgatatggagtcatctttaaaatacagtaaaaggaaaaagcaagatacagaatagcatgtagggaagctgctgtctatgtgaaaagctgtagaatatacgtgcatttttgtatatgcatagaatattcctagacaaggacaaacatggtggttcatacctgtaatcctagcactttgggagactgaggcaggtgattcacttgactccaagttcaggatgagcctggccaacatggcaaaaccccatctctagaaaaaatataaaaattagctgggtctggtggtgtatgcctgtggtcccagctacttgggaggctgaggcaagaggattgcttgagcctgggaggcaaaggttgtagtgagccaagatcatgccactgcactccagcttgggtgacagagcaagacaccattcatctctctatctcttttctctctctctctttctctgtctacacacatacacatacccccccacacacatatatatacacacatatatgtgtgtgtgtatatatatgtgtgtatatatatacgtgtgtgtatatatatgcgtgtatatagatacatttctagaaggattctcaaagtgatatcagtgattgttgtgcaagaaggaaactagatatcagtgaatgcgctaaataaggtgattttgaattctgtagcatgtgtatgatttacctatagagaaagcagtctagcatgagcgtgggtttctcaaatatagaatgtttgcagtgaggtcacttggtgaaaagtatagccatgtcagacagatgtaggttcagattccaggacttccaggactgctgaaagggaaaggggctttggatctccttcagctccaggcagcattgctcctttcccagctttgacattagctggagggaagacaagttcttagagctctatgtgcttgggacaagaccccttccccctactgccttactcgccaaccataactgctgcaaacaattcttacctcttccaccccatgtcactgcctaaaacccttcatcacctggcctcccatgcctctaagtctctgtacatcccctagcctgatactgtccccaaccctcctcaactccagacaccattttactctaccctctggaattgtccattattagcaaaatctcctttattttcaacctcctttctaagtatttcccccacattcttgttgtaatagagacacagctttcccaggactgtatagctttccttgcagtcctctaaagtggtaactggtttctctgccatacatttcataccactggtcctggagatattgtcaatatcttaatgtcttccttccatctcacttaaattttgagaccataattcctttttcctctcttaaaagttctcagtgttgaagctcaatccattagatacctctagctggcactactagttgcagtcctgtgcagactactgagtcattttctttactccctgaagacttaaactctatcttactctcactctctctgacattactcctattaaaatgttatgtttctttagctattctttcagtttttggtctcctctccttcaacgaggatgatttctagaatgttggttctcaaaatgtggcccctttgcagacatcgtcagcacctgggaacctgttataaatatgaatctgcagaccacaccccagactactaagcccaaaattctgggggctggagcccagaatctatgttttaagaagcacgtcaggtaattctgatgaatatgccagttccttagatcttgttattgtcattactgacaactttctctgagaccacaatttgaatctaccaatttttcactagtactcacccatcttaagtccttactttccccttaccagccagacatttgaatattccttgactcttctctttcacatactatatccaaagagtcaacaaatgctgtcagctataccttcaaaatacatgtagaatctaacttttaacctccactgcagtcacttcagtccaagcacaaccatttcccacctggagtattgcaactgttcttgtttggtggcccttggccctactttatctactttccgcaaagcagccagagtgtttctttcaacacctaaggttatatggcttcattgattgaaattcaccgtgcttcacctctttctctacaaaagccaaagtccttgtaaatgcctgtaaggctcgagggtgatctgaccttccctggcctgtcgtgtttcggtaaaagtaagctgagtctttcatagttaaaggacagcaatattgtcctgcatgatattttaaaaacccaatcaagaatcacacattgcatttaattttcatgcctttagtctccattaaaagtgtgccctttgtattaataattggagtgatgagggacagagtttaagaatatataaatattttgtccccaactgactgtcactggatggctttggcacccattggtgattcttacctgaatcagtaattattgtgatgactgaaaatagtgatttttctcactgtataattcttctatatttattaattaccttaatattatcctatagaacagaatgttcccttctcatcttttgtttgtttagtgtcagtattactcatgaagttgggtgtttagaaaattcaatgttgtataatactgttattattcaatattgtattttctcagtttgagtcttccatctgcgtcctttcatgtaaatagtataaagatcagtaatagaggaacatagagtaaagtgtgagcagagaagccttactctgagacaaacttcagagaggtgaactctgttgctgattaagaaaggcttcactgaggaagtgttgtttgaagtgagctttgaaaagtcataaaattttgacaaaagtggggatggggtggagcttaaaggaaaaactgtctgaacaaaggaaggcccggcagactaggaatttggcaataatacagtggttttggaccttgatgaggaagttgaaatggaacataaaaaccctctgcatttagctccatttatttgctcaggcagctctcactgcctaaaattttcacccctgctgttttgctcaggggtgggatgaggggtaatgagggaggaaattttagggggtgaaaacagcacaagccaaaaaccctgctcagatactcccttctcttgaagccttttccagatccctaataagaattaaccaccctctctcacacactctgttgtactttgtccttctctgttaaccagcctctgtgttttgtgctgtctgtatttgtggatacatcttcctcctttaaagcacgaatcatatcttaatcccttggcccttcttcccagtacttagcacaagtgctcaatacatgtttctttaacgcgtgtaacagaggaaggcgaggagagtgagtgggattgggagcaggaggattctgaatgtcattttaaggggtttgggctcgctcttcaggcagcaatgagccatagccgcctttgaactgtgcagcactgaccagagctgtgatgccaaaggatgcagtggaaggggaggacagccagcatgcctgggcatggtccccaagtcagaggacatcagtgggagaagggagaaggcatggaagcaagtggctaccatcttatgaatctgagcactcattcaaaggtggcaaggaaaaaggaaggcattgagcacggttttgaggtttccagcctgggtgattggaggctgatgcaggcttcttaccaaaaagggccctaggcagtttcaccaggaatgtttaaggagtttatcatgaccctatctcttcctcgtctaaaactctccctaaaatcaaaacagtatgtcctgttgaaatactttattgtatcaaatataatgagaagtaaaatattctctctacttgatgtatgaaacactgacttcttgtagtggacaattttcacttgtctttttagtaatggtttttattaaaaatagatgttaataactgcttgtttaatctttaaacgtggccctctgagagcagcttaccgtaaaagaaacggttgtcagctttctttttgctcctcagtccctcctgccccttcctaacaacagaaaatttgctttgcacctgctccaactgggttcgaagagataagcatcttgcaagcccagaaaattgtagtatcaaatctcagccccaactgtgaggcagcactatcattgaatccctgctgagaggcgttgctttcccaattcccaaaagagttctttctcccctggccccttttcaggcttgaactctgaccgaaaccctctttttaactcccagcatgcactgcacttggtactgacactgacccatccctgcttcctctgttctgcactggactcatcagtaggtcaggcgttggtagccctggggtcactggggtgcccaattccaataatgagcacatttagctaaggagaggaaatgtacccttctatttgttacagtccattgctttttttccagaaacaaatgctaaaagaacatttgatatattgtggtttggtaaatacacatagcactgcctaatattcacaaagttgcctcttttttttgcatcttccttcataaattaaatatattgttctaactcatgatttattttaagagggatatacctatttcacagctaggaaaatgttttcaaataaagttatattcagaatactcttgcaagaatttcaaataaaaatagcaaatactatttaaatgcatataacattctaacagacttgtgtgtcattttaaagggaaagaaaaaaaatgatgacaaggactttacaactttgtctttaaaatttcttcttaggctttccaaacagaccgaagtcattaaaaatactccttaacccccaaagtcacaaaaaagaagctacccaggtttattatgagaaggttgaacctctgttgaagcttgcaggaataaaaactgatgtaacaagtaagtaattttcagaatataatttcaccatctacaaaaacatacaaaagcaaaataatctgaatttgtccttaatgcaaacttgggaaactacttgtaatatctatagcatttttacgtcttcataacctactgcagccagctcgagggttataatttaattatttttgttatttttattagaatattaatattttctctttagaattttttcagatattttttcagacttaaacaattgttagatataattacaaaggaagctgtatacttgtttacatcttcatggagatgtttgctacttacacgttaattttgcagttaggcaagaaattgattttttgctcacttatatagttgatgtctttccatggaattcttccttgggttgttttcgttctgactctgacccctggtggttaggtcaaaactaagcactgaactgctggttttattaatagatgaatttagagatgctagaagcttaaatttgttgtctaaactaagaaatgtacttaggtttgtgccaaggaaaatagaaacttgttaatgctaaacttaatagatgattagtaatatcctttttgatttttttaatttggtagtcacatttctttgtttctttgagacttattttcgtatggtggggaactgagtagaagagtcgatgctatggagaatcgcaaccttcctagctttatttctatgtggcttcgctaacagtggaaatttgcaataaattttaattgatgaaaagtattataaaataagcctactcaggggacaagcccagagtgcaattggaacttcctagtcccagttatagattcctagggaagggattcacagtgatgtggctttactcagctgtaaacaaaggagataagtttcaagatgttaataatatcattgaaacctacacctagtgatctgatggattgaggtagaagaaagttcaaaaaaaaaaaaaaagcaagttttgtaggaaggtcagcccccatgaaatgtgcctataactatagaggttcgagagaaactaccatgaaaaactcaagaggaatttttgaattaaaataaagttatagtgaagaagttaacctttatgtttgtgaccttcggcttatttagaggtgatttacaagtaaaagagaaaattcagatttatgttttctttctactgaagatttccaaagattggctgaaggaaaagtttgagatttgtattagggtgagacaattaaaagttgaataaacatattggcatactcaatgactattttgttcattgcttttacatgtgaatactacaaagcagcttaacatggatattgctatatagcattcacttcaggaatctcattgtatgcttgctctgtgttcaacatagtgcaggatgcgagatgaataagctatcatacttggatgactttctacattattagagattcaaaaaaatgcttaaaaccattataactggggtatacataaaagaactttgatgtctcagaggtgatattttgatcggaagattcaagaaaagcatttgaactaggcagtttttaagaggcagacaaaaaatgagggaaggaagtcaggctaacaggcatgtactgtaaaagttgggagggggggcggagagagagagtgtgtgtatgtgagagagtccatgtgtgttacacccatacatctggagagtttgtgccataactttgctctactttcctcagtttttacattatctgaaatcttactctatcatcataaaatagctgccagtgaatttcatcctttcttattaatatccagtgggatggggagaggtgtgcatatgtgtgcaagagagacccaacatgctttaatcctgaagatgaattaaaatttccttttttaagtttgggcacagatactgtattagcgcagtcaatctggaataatcatttatttaaccatcaagactcttcccaggggctgaggacagatccccttttcctgatgactgaaatgcctcagctgaatctggattctgttagggagaagaaagggcaaaatgacttctaggaaggctctcaacaatgtatactacaggaggtataattccaggttatggatggatccttaagctgcactcagcagtttactcatcgtgtattgatccacagttggtgtaaatttttttttatcatactgttgcaatctggtttggcaaagatgactccaccagcagaattaaaattaaaaaggaagagagaaaaagagattggagacaagaaaactgatatacaaggcctgaactaaggcagaggaaatcatctaaatgtgctttccttcttaattgtattggagacaaaactattatgttctaggatttttttctctaaatttgtaaatattactaagtaccatatttaaacataaaacaatagaatattccgtaaagcaaatttagaatttacttacatttgtgcagaatggctaattattagctgcctaacactcctcctacaggcaaatttataaaattacatcatttgcttataaaaccattttagtatgcatattggctcaatatttatgaaaaatatttcttgaataaacctgtgaatatttgaaaagttttagtcttcctgcctatcttacagtgttatttttgtagttgaaataatatatttgaaactttgtatattatactacagaaaggtggtcataatactgttagtttcagtttcaaaaattatgtcatagtaagatcgaattcgtactttatttgaaagtatatggaagagtaaagcagaaagaggacatatcttctgcatgtccagtgggacattgttttaatgtatccttgtgtgaatgggtgagtccaaatggaattggaattacaaaataaaccctatatgatgagttaattaggaaatagtgctatataaatatgaagtataatatgaagaattacagctagatatatacactataaggtactgtaattttttcataaatttattttaaaaatggatcttaccacattaataaaaacacacttctttcattttgggttgtgctgaaatcctaactacttctgaatatagatcagcatcttttgaaatatttgtgctaaagttgcatccccactctgctaccaccaccaaggtagtatcttatctaatagcatcagaaaaacttccgggagaacctggaaagaattattttttcctaattacctattcgtacacaaatcaaagaagagtatgaacgataagcccatgctggcatatgatatcatttctcttgcttctgaaacaaagcaagttttagagattgtaccattaaaggtgtgacagatattttgaggatcagagatccataggataattcatagtacaatagagtgaaaaagttaaggcagcagagaaatcagactgaaaagaactttcgaggccatatggttcaatttttctccttgtgggtggagcacaggtgtgtggcactcaactttggcttggccacctacactagaggcagagtacgttgttactggacaatactgtttgacattcttatgaatgttcagagttactgtacctttgggcagattagaaaaggcacctcctctgtgctgacttacaaaaaggtgccctttcttccagactaattcatcctttgcttataaaaccatttcagtatgcatattggctcaatatttatgaaaaaaatatttcatactttcaaaatattcatatttcaaaaatattcagcccaaggtcactagattcagcctaaagtcatttgttagattgcaaatccgtcattcccgttagccaagtacctttgtgctaggcataaactgtacaaaatgagaacttgtcagctgacattcgcctctttgtaatttttatgtactagagttaatgttatctcttgtagtaatatgaaataaatgtgccccatctattgtataggagtcattgagatatttgaagagagatatcctgtctgcccctcatctcttgttcacgataggtacttccatcgccttcagttactttttgcattaacagagctgctagaccttatcatggtcattatcattatcatactcaaagacatttatctgaaggaaaccttgatctctgccagctcagggctcttgggagtgcctagtcaccagataattttacctcctgggcagagttgtcaagaaagtggtgtttgttatcattttccccttctttctcctaaaatcacgcttctaacatggctgttaacaagcctcttcatagtgtttctctggttgtttatggctctacttgaagccttccatttcttggaaatgcctcttgcctttctaaatctcacccagcagaaagctaggccatctaatgaaactgtgtcacaaaagattccagtagcctgaggcatcactccttccaattttacctgcattttaatacaaaatctgaaaagtaaatgttcatgcatcatatctagctagagagaaagataattctgtgtaaaagattctttttgttacctcttaaataattgtgggtgtatatggccagtcctgttcccagcattcagatgtgagttaggaagttggaactttatacctggggacgatgaagactcactaatggggtatatacaaaaaagtgatatgattaaatatgtatctgaaaatggttattctggctagagtgggggagaggtttgagggagacaagataaaaggctattgtagtacaggtggagtatcccttatctgaaaggcttgggaccagaactgttacagatttaggatgtttttagcttttggaatatttgcattatacttaaccacttcagcatctctctaatttgaaaatcatggacacaggaaggggaatatcacactctggggacagttgtggggtggtgggaggggggagggatagcatcgggagatatacctaatgctagatgacgagttagtgggtgcagcgcaccagcatggcacatgtatacatatgtaactaacctgcacaatgtgcacatgtaccctaaaacttaaaagtataataaaaaaaaattaaaaaaaaaaaaaaagaaaatactccaatgagcatttactttgaacgccatgtcattgctccaaaatttttagatgttgaagcgttttggattttagatattctggttacagatacttaacttgtctacacatgaaagatatttagtgatcagatcaatcagctaatttagggaattagctgggagaaatggaggaatgctatggcataatttaaagacagaaacaactggccttggccatggagtggttctggagagtggaggaaagggacactctagaaagaagtcattttcctgtcttggggtagatgatggaacacaaaaagaacaatatatttgagagagaatatatttgaaggtatacataatggattctgttttgagcttactaactttaaagtacctacaggacaggaaagaaaatgacatttcagtatcatatcccacactagaattttatcaccaaaccaagaaatgtttccttatgtccaaatcaaatctcacctgattttatttcaggtgattttctcatcaacattgaatatcaaccttaagactttcttgtcttcctgaggaagttgcatttgcaccaaagaggggagggggaaattcccagcagtgagaattgtgttcaaagacctgtaaactgtgaaggcttcacatctcctatttagaaagagcacaggttggcaatctcataggaaaaggcaaatagatgaaagaagaggctgggttacattttttgaaattacatttatctagcaatcctttctttgtttgtttgtagggggatgatttgaatctggctgtcactgattccagggcccacaatagcctgtctaaatacatatttggtcctttctactatatttaaatagtaatccagatcactctttatccttttgcctaacattgttttgtataaccacctattacttcatattataattcattatttcattagcatatattgtctatctccagaatgcaaattcctgaggccaaagactaattcattttgttcattttgctaatatattttatagatgtagatagtcaggttcttttcattttgtttctttgttctagatctttgattttattggacttttgcaatgttacttaaaaaattgctattttcaggcaggttgcattagtgtataatcaaattccacccacaatatcaaaaaaagactattacaaattaaaaaaataaaaatagcattcaataataacacagttctaaagctcattattggatctgaaaaactttaccaatgtaagctttggtataaaagtaaggcttggtgaactgattcttagcataaatattttttcatgatattcttatttttaatgtgtatatgtaagatgttttattttgcattttaaggttgtaagtacttgctgtagttataaatgaatgatcagcacacatcttctttgataacctttcaactttattaatattaatgtttcatatgtagttttattatggctttcttctgattggaatttaatatagagaggttttattcatgtgagtgttaatggcattttgaataagctatgggagaattacaatgtaacactgctggatacagaatgattcttttagacaccaagactaataatttttaacaatatcgaaaaacattgtaggaaaagcttgaaccatgctggcaccagggacagacaagcatgaaagattaatgtaatcttgcatataatgacacacattcttacacaaaaaatccatctgcaatgtcatgtcagtcagcagaaatctttgatgggtggatacagctgggctgtctcttctggcagagctgccctggaaaatgctaaatgtggttgtgatgcttggtgccatctgcagtgtgcccgtttatcctgtcttcactggcatttacgatactgcatagggcatcagtgactgtggagacagcgatacagagtgacagattcatttcctcggagggtctgagctctggtgggcctgtgtgccaccctccttcttgggtctgggtctcttataattggtgttggctttactttgtattttcacatccaactcttcctctttttagtctaacagttccagtacacattcttctggtttgtaaatcttacactaaccttttgactaatttattcatgtaaggttgccaaaccgatttaagattgactgttcaatgccagctaatatgccttatttccaaaatactgctcctcctaagcctctgatttaaaggacatgtgtcttatttagggaatactaaacaggcaccaggacaaattgggtaaccactatgcgtgggatattcccaaatgactttatgtagttgaaacaaatatatgaccttctcttacataaagctataaaacatcaggccagtaacacttagtcctcttgcccatgattaaaatataaatattcaagaataaatgctgttttatgacttgaccatatgtttatcatattattttgccagaacaagttaaaaagtgtgatcattgtttaaaactgtcactttgtgtatgtgtgtgtgtttttttaatagtaatggaatatgaagggcacgctctgtcactgcttaaggaatgtgaactccagggatttgatgggtaggttatattattaatcaatatatgttatatcatttatgtattaaatgccttcactagttttagctacatatttggaacctaacatttaaaaatatttgtagtgtatgtactttggctctatcttgttcatatctatgtaataataattaatgataatatgacatggtcatctatctctcaggatctggcataggaaagcaaaaagaggaatctaattattaaaatactgggaaatgacagtgtactactctatacttactaatgtgcatacatttgcatctataattatttgcttttaccatatatctagagaagcactaatggaagatgttatactggtcacatggcataactatatgatgatcttcttttgcaaattaattgataggtttaatagctacccattggttaacttgtctgtgatagattgagggaagatattttataaatacaagtaaataaatacattatttccagaaacaataagaaataattttaattatctcataatgtagtgactacaatttaggtatgttattcacagtgggcatcggaaaccattgttcgcaatacattggagtgtacagagattgttcactggcatgcaaacgttagaaccaaggcaagtgatataaatttcattgccattttttaaaattaggtgaaccaatttgctaaagtgttggactgatgtgtaagactaaaacatattatattcctttagggaagttctttttacgtgagtagatatttgagaatttaaaaagttgacaagtgtgtgaattatttgtgttacatggtgatgggcagggggcaaagacccataaggtcaggaaagggagttaggtctgtactttcaccaaagtgaaaggcattaaccttcccaaagactgatttgaatgtgctggggagggaagtgatgcaatcaaaatggagtattggcagggctgtttttcagaaatgcttatttatttatttattttttggatgaggagaaaacaatagctgttgagaaagaaaatgtggtaagtaaaacatgatttttccaaaaggaatctaattgagggaagtaaatctagatagcaatattatataaacattgggaatcaaaaatatggggtaggagattacttcagaactttatacttagaggtagacaaaaacattaataggcttcatttagaaaattgtcttacaagtatacaatttaagaaaagtccttgtgggaatcatgcataccaactacctatttgaatatgctgcatagtccctcactagacctcatgagtacatgaaggtagctgcattgcaaatgagtacctgcttcaaaacttgattaaagaatgagaataaagatatcacagatattaaacttgttcttacacagcagcattacagaatgttctgctgaatgcagtatctatcaatatgttttactggtatttgtactgggtaaagggatgaaaagaactttgcagaatgaagaaagacgattgctgaagtgtagtacaataatatttttctctttacctgaacatatttaatccttatttatttttcatggcaggtgttgttatttttcagtgtagagctaaaagatgtatagatttttcagttattatattttataaaccaaatagtttggcctaaccattatatgaattgagttatgtaagtgtttctaaactctatggcatgctgatttatttcagacttacaataatttcaaatttctactgaaagtcatcttccgtgttctaagactctttaaatcaggggtccccaactccgagactgcagatgaatatcagtcagtggccttttaggaactgggaggcacagtaggaggtgagtggcaggagagggatcatttccgcctgagctccacctcctgtcaggtcagcagcagcattagattctcacaggagtgcgaaccctattgtgaactgggcacgcgagggatataactggtcatgcgagggatctaggttgcgtgctcttgatgagaatctaatgcttgatgatctgaggtggaacagtttcatcctgaaaccatccgtctcccaccccaccctgcagtccatggaaaaattatcttcccacaaaaaagtccttggtaccaaaaaggttggggaccactttaaatagcttatttatttttgtggggtcagttttcccagtagaagctgatatggtagttggagtaattatcttaataaactggcaattttaagtcactgtacttagaattacatagagagatatatgaggagaataatagaaacatagtttcttcaggtacttcaaaggaacaattctcttgcaagtaaaattgtttgaaaatggaatattctacattggtgagttttctattcctgaacctgttctaaagagtggctaaaggaaaattttgggggaaatttatagaaaaggtgcagagatgagagaaggttaaccccaaaatgctatggcattttgatgagagacagactcaaatttctttaagaactttggcctgaagcacctccgtctgacactagtggaactattaatagggagtgattaggaaatcacctaacagtttggtttctagatacaggctgaagaagttaagagccaagaaagattctatgtatagtatttagtaaagcaaaacaatttggtaagtaatgtttaagaaatgctatttcctaagattttggagttgtatttattttttttaatgaattacatatgtttctatgagacatcttgtgacatttctaaacccaacagaaacagtgtatcagcacttatgacagctagttctccactgcagtgtgtcctaggaaacactctaagatccactgttaaaccttatgagagcttcagattctatattgctccctattttactgggcatgagtaggaagttttaggaaggaaaataaaagaatatcagctgcatagacttgaagcagtaacacttgcatttataagtgtgagtatagttttaaaaatctatagattttatgcaattgtaaatatatgaattcctcgctattaatatttgtttcagaatttttaaaaaaattgttgagttacttttcttttgttcatttcaccattaattagacccataatgttgtagacattatttggattatattgacattttatcagattgaacatatctgtattacttagtaaggtaaaaagcaaaaacaaaaacaaacttttccagaaagaaaaaaaactgtgaatcaaaactacaacaatatattgaacatttcatagatgatgggttcatagataagtataaaaacattcattaaaaaaatctttatcactctttgaaaaaggatatattatcacccagtgtttcttttctagacagaataattctgtttggagccatggcaaggagtttacttattttaaaaacaagatttgtcacatgcaaaggattagttactctaaggtttatgttttagagtgacacaagtgtgattaactcactataaatgattgaatactttgctttttgcctttcttgtatatttagactcttgtgatatttttgtaagaagctgttgatgaaaaaaaccaaactgtaaaatatttaaagaggtttattttgagccaaatatgagtgctcatggcctatgataaccccaggggggtcctgagaacatgtgcccacagtagttgggttacaacttggttttatacattttggggatacagaagttatagccaaagacataaatcgataaatgtagggtattcattggtttggcccagagaggcgggatatcatggagctggtgggaaggggagctcacagatgaattcaatgattttctgattgtcagttggttgataagctttgctgaaagattagaagtcagcagaaagaaatgcttgagttaagataaatggggtggtgtaggctgggtgcagtggcttagcagtggctcacacctgtaatcccagctctttagaaggctgaagaggggagatcacctgaggtcaggagtttgagatcagcctggccaacatggcaaaaccccatctctagtaaaaatgcaaaaattagccgggtgtgatggtgtgtgcctgtagtctcagctacttgggaggctgaagcaggagaatcacttgaacccaggagggagaggttgcagtgagctgagatcacaccattgttctccagcctgggcaacagagcgagactctgtctcaaaaataaaataaaataaaataaaaaattataaaaataaagataaatgaagttgtggaagcacaggttcttgttatgtagatgaagcctccagatatcaggcttcagagagaatagatggtcaatatctcttatcagaccttaaaaggtatcaaactcttagttaaatctctcctggatcaggaaaagacctggaaagggaaggagattctctatagaatgcaaatttctcctgcaaatgatagctttgcagggccatttcaaaatatgtcaacaaaatacattttgggataaaatactttgatttcctctagggcctgctatttgttatttaatgctataccagagtcaggttggagttggggatcttattgctaccaagtctgttttgtcagtcttatgatctattttttttttttttttgagataaattctcaccctgtcacccaggctggagtgcagtggtgcaatctcagctcagtgcaacctctgtctcccaggttcaagcaattctcctgccccagcctcctgagtagctgggattacaggcatgcaccaccatgctcagctaattttttgtttctttaatagagatggggtttcaccatgttggccaggatgatcttgaactcctgacctcgtgatccacccttggcctcccaaagtgctggaattgcatgcatgagcctggccaatgatttacatcttaatgccagtgctggccatttgcgcctaaactccaaaagacaagagggtataaggaggcatatccaacctcccttcctgttatgacctgaatagtttttcagattttctttgtgaccttcatggccaaaaggggaggatccattcagttagttggcgacttagaattttatttttgttttacaaaacttatttcctaggttgagtcactttacctgaacatgatcttaatgattgaatagttgttaacataaataaatacatattttttctaactcacttaatttcacactggttctactggtaaactgtttttcaaaataataagattctcataaggctatttttattaggtttcatatatagaaaaggtatctaatatattgaataatattgtagcttctaagaccaaaatgtcttatttcaaatccctgttctattacttactagtggtacaatcttgaaaaagttactttatctttctatgttttagtttcctaatctgcaaattgaaggtaatattacctattgcatacagttatttctccacttaaatgagttaatacatggagagtgcttaggaaaatgtctgatatatatatatagtaattattcactaaatatttctttattgttataattgtcatttgtattagtttcaaaagatttaacacagaatgtattatgacaaaatttcagatgtttcagaacatgctcatagggaggccacctctaataactctagcaatatgttaacatatgcatgacgctataattgtatgcaacattctaggagttaagtgttcgcatcctatgtatgtaagggtcaagttatttggtgctaaattagatttttttgggtatgactccacatagtctttttggtcacacccatatgtcagcatttagacagccatggattgagggttacgtttaagttcacagattagaaatctcatagagatttttgaaatcaggtaagtttcaagtcaaaccttggtttttttcattcataaagatgggactgtggcctattttgcagacttctgaggatttaatagaaattagtaaacacattacctgatatatagtttgtccttagtaaacatcattccttttctctgaataggtggtcatattgcgaacctctggaatcagtttagacataagaataaaacacacctaatcaaacatgacctgggtcatatcttgagtcttctaaccagagtagccttggattgcccaggctatgtggagctagtgggatgaggaagatggggactagagggaatagatggccgagagaaagatggtgggaactgactggaaagacactttcagcctttggtcaccaccctccagagcttcctaaacttagagaaccagtaactactgctgactgtggcccatagacagttttgtttgaaatagtgtttttaaatatattgaatgctagttgcttagtatttacaaattaggagactcagccttaaatcagaatctctggcttctgtagaaaaaccagatctgggtccattaggcctcacacgtgatgtgagtgggccacagcaaagaagtggctgcgcctttagattgagcctactcttccattcctgctgggcccttgtagcccttgagttgtgacacctgctttcactgaggcaaaatccactttccattgggttaactggtgacattttgatacgtaagaatattttgcttcttttgaacataaatgattatgaaatgaatttctggtacttctgtgttattttaatggattctgcccccatagtctacttgatataaagtcttaaaaaatatactagtagtactatctaggatcaaaggctaatagtattacatctagaagcaccgtatagcaataatgtcaaggagatgaaattcaggtcaggtttgtaattactacattcatatagtaatgataattagcagtttcttaaagcttcatattttatatgatttttattgctatctgtcttttcagagctttattgagaattagcaggattttatgactttggttggtgttagttaaatgaattgcagatgacagtattattaacaagaaatgagaatgatatgcttttggatgttaacagagcaaaacgctggtcagatgtgaattaacatgttcaaaagttttcatatctcttaacacacttaaagctattttgtctatggggaattatctagttattatatttgtgaagtaaacttacctgtgttgtgtttgtgttgtcttacccattgacacatattaacatgtttaaaggtacatgtgagcagttatgcacatagactacaaattagtaaactattttgaagtctagatttcatgacttattaccaatcattctgaagttttgccttctttgcttgatttgtatttttctagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggcaagggagtggctacagattcattaaactgacccttctccctcttttcctttcttacttgctaatctagacagcacaacacagaattaatgaacagactttgaaagatccagacttctggcatccccactagcaaatgtgagacttttgacaagtcatttaatctctttgagccttatttttctaatctatagaatagggatcacagatatattattcactttattacaaggttattgtagtactaacgtttggtttagtaaagggtttaatatatagttaaaccatcagtatatggaatggttattattctcccttcgcataaaaaatctgttgattacacagtaccaggtaagaagtttcaaaacagggccactccagtctagctgcttacaattccatatgaggtgaatatggtaacttgcataattgatgtataaccagataaccttgagaatgccaaaattacttgtgactggaagggaggataaggtttggaagggtgagattcttaagggcaaggctttttaatctttctactcactgccatttttcagcatctagaatagactatgccacagtgatgctcagtgaagcctattaagtgaatgcatgtaaagaagactttatatagtaaatgacacttggattaggtcttaaaatgggttggagctggcctgaaaaggtgagaatgagttattttcttggctgcaaaagtaataaagcaaaggcaaaacccaggagtgtttgaggaatagtgaaaaggccattcagtggaagataatggtatcaaaataggcccaaccatggaggctcctacatgccacagtaaggtctctgaattgtatttgataagcagtagggaataatgggatgtttcagagcaagggggcaacctgattggagcttgttccaggaggattcattttgcctcaccgtgtggaatgattagaggttgggagcaggagaaagtagaggtcagagacacggagaaccgttagagcaacactgtgatccagaaaagagggaaacatcattcaaaagctgattgtattacacaatcactcatccctatttaacgaacggtgctgggaaaactggctagccatatgcagaaagctgaaacaggatcccttccttacaccttacacaaaaattaattcaagatggattaaagacttaaacattagacttaaaaccataaaaaccctagaagaaaacctaggcaataccattcaggacataggcatgggcaaggacttcgtgtctaaaacaccaaaagcaatggcaacaaaagccaaaattgacaaatgggatctaattaaactcaagagcttctgcacagcaaaagaaactaccatcagagtgaacaggcaacctacagaaagggagaaaatttttgcaatctactcatctaacaaagggctaatatcctgaatctacaaagaactcaaaagaatttacaagaaaaaaacaaccccatcaacaagtgggcgaaggatatgaacagacacttctcaaaagaagacatttatgcagccaaaagacacatgaaaaaatgctcatcatcactggccatcagagaaatgcaaatcaaaaccacaatgagatatcatctcaccccaggtagaatggtgatcattaaaaagtcaggaaacaacaggtgctggagaggatgtggagaaataggaacacttttacactattggtgggactgtaaactagttcaaccattgtggaagacagtgtggcaattcctcagggatctagaactagaaataccatttgatccagccatcccattactgggtatatacccaaaggaatataaatcatactgctataaaggcacatacacacatatgtttattgtggcactactcacaatagcaaagacttggaaccaacctaaatgtccaacaatgatagactggattaagaaaatgtggcatatatacaccatggaatactatgcagccataaaaaatgatgagttcatatcctttgtagggacatggatgaagctggaaaccatcattctcagcaaaccatcacaaggacaaaaaacgaaacaccgcatgttctcactcataggtgggaaatgaacaatgagaacacttggacacaggaaggggaacatcacacactggggcctgttgtggggtgggggaaggtggggagggataacattaggagaaatacctaatgtaaatgacgagttaatgggtgcagcacaccaacatggcacatgtatacatatgtaacaaacctgcacattgtgcacatgtaccctagaatttaaagtattatatatatatataatatacagccttatgaacatatatatatataaaggaaaattaggcaaaatagcattacttgaggtactcaatagcctggcagagcagacattaagggtaagagagactggacttgaatttcagtttggtacttgactttgggtgggtaattagcctttattagtcttgattacacatttaaaaggtttaataaggccgggtgcagtggcttatacctgtaatcccagcactttgggaggccgaggtagtggatcacctgaggtcaggagttgaagaccagcctggccaacatggtgaaaccctatctctactaaaaatacaaaaatgagctgggcatggtggtgtgcgcctgtgatcccagctactggggaagctggggcagaagaataacttgaacctgggaggcagaggttgcagtgagctgagattgtgccactgtactccagcctgggcgacagagcgaggctgtctcaaaaaaaaaaaaaaaaaaaagtttaataatgtccatccccatagggccattacaagaatcaacttttaaaaagtcacacattatcactaaaaaagcaaaatatttttccctatgattatagaaaataatgcacattgttgaaaaaaattcatattttgataaccctattcatttagtatggattttagaatacttagtattgttgataagttgacagagcataagatattcaaatgcccttttagagtgtaaagtctttcagaaagtcagaatttaaaaggagagagatattcagatataatctgataattctagagtatataggaaaacctaaaatggtttctaagtagaagacaccaagatgattttgactcaaagagaaaaatgatgcattttgggccatcttttcatggcattttatttcttgacctttttgctttactttagtagttctgactataatggtggaaactttccaacatttccttccatgcaaagtggatgtgcttaggacacttcattagtacttaaattcctgaggtcattcattgactgccatacatcagaaatagaaagatgggtgtccctacaggtatgcctttgacataaatttggtggttggctataaaaactggtggttattcttatgttttagtatgtaattcagattttataaagaaatagcatttagttttatcactattataattttgaagagtatttctgatttggggagcattttatgtattctttggatatttgtagtaatgccattttaacctgtcttgtttagaagacacagtatgctgccaaaattctggtcattgcataggagttctagcattctaattccatctaataggaggggaaagtcatgtgtggggtatatttaatatgatgactgtatgcctagtcagggcttttgatagagaatgggaactagaactaggcaggaagttttcaagctgaacatgaggagacagtgtgcctttgaagccatttgcctcctggagagagacacccagagggagagtgtttagtaaattaatccactgagccaacagactaagctgctgaattatggtcagactcaaatggatcagatgtggagaagcctgtatttgaactgctggccattaggaatggtgtttgttgctatgggaactggtgctaaggaactatactgagagactctgattaaaagggggagggggaatggagaaaaaagcctgagaggacataaaaataaaaaagcaatccagttgttgtaaaacaaggctcaagccacatactgatggctgtgaaccatatattcctatagagtttgcataaataaattcatgctttccaattaatttgaggagaataaaatattgccgagggactgttaatttctatgatatttcaggcaaagaaccaaagtgtaggtgccgttttcatgagaattttagatatgcttgactaggaagtcattacatcacatttatctgtttggatgtgggagacattaacagccttatgaatattcatggtatctggttaattaagttaattgttctgcagaagtgcttgcacttccaaggacattttttttttttttttttttttgcctccatagtttctccctggtatttcatcagtaattctttacatgaactgctacttctgtccttacttttttgtatttggaacattttagcagctctcaggaggaagtggtaggcaaagtttctggtagtgttaagaaaaataactttcaggctaattaaaatgtttaccttgaggtagaacatttatagcttttgtgagaacattaaaattacgccattgttatttatgtgagcagcatgttcttttggcatgtagacatcttttcaaatagagtacagtttcctgaaacaaaatgtaatccatctttcagattatcccaacaaaatatagaacaagctatcgttttgcaattttacatatactttctcataaactttccttttttcttcagagtgtcaaaaaccacatttaaagactaagatacagattaatgagtagtcaatgactaaaataattttctgacttctagtcatgtctgttatcactgccaacttctacagaattagagaaaagttgcaaagcctgagaagacataaacaatttttaaagccatctctagcattctaaaaaaattttgtacttgggcatacccaccgtacttcaaactcacagggaataaatggtctttattttcttaagtcatgatatgtgtcattctctattgcacatgacattacattatgttttttaatagcctttctagaggaatgcttttacggtctactcataattaaccatggtaatggaggaaatgtgtttcatggagtactgtaatccatcgataatcctaaatatctgactctaattatgtggcctcctccaaaatctttaccacaaatctgattgggaagcacaatggattgacttgtttcttccttttctcctgatccattccagatttattagcaattagatggtcaaagggcaggctgtagagggccacaagatcattggaaagaccttgataaagatccactgagtaacaggtttctacactacttgttctcaaaacttagggtccatagactcaccttgtgaacttgctaaaacagagatacctgggtcctccctcctccaaacacattctgagtccatgagttggaggtagaacccaggaatgtacgtttttaacaagctcccaggtaatgatgctgcttggaccatgcattccagaggagtttctcaccaagtcactgtgcatacaaaccacctggggatctaataaattgcagactctgaatcagtgtgtctggaatggggcctgagaggcaacattttaaaaataatatattttttacttccattaatactgctattactgttttaatacctattatccttatttttaaatggacaaaaattgtatgtatttattgtgtacaatgtgatgttttgaaacatgtatacattgtgaaatggctaaataaagataaacatgcataaaattgacataatgatcacatactgattttacattgagaacacttaaaatctcccttagaaatttccaagtatataatgcattgttactaactattgttttagcctgttctcatgctgcaataaggaaatacccaagactgggtaatttataaaggaaagaggtttaattgacttgcagttcagcatggctggggaggcctcaggaaacttacaaccatggtggaaggcaaaggagaagcaaggcacattcttcacaaggtggcaggaaggagaaatgctgagtgaagtggggaagagtcccttataaaaccatcagatctcatgagaactcactcactatcacaagaacagcatgggggaaaccacccccgtgattcaattactcctacctggtctctcccttgacatgtggggattatggggattaaaattcaagatgagatttcggtagggacacaaagcctaaccgtatcaactgtagtcactaggttgtataacagatctcttgaatttattccttttacctgaaattttatatcctggaccagtatctccccagtccttcccacccattagccccagtaaccactattttactcttcgcttttatgagtttaagtttttcagattctacataaaagtaagtatttgcctttctgtgcctgtcttatttcacctagcataatgtcctccaggtttatccacgtgttgtaaatgacaggacctctttaatgccaaatagtattccattgtgtatataaacaggctgattgtccctaatctgaagacttaaaatccaaaatgctacaaaattagaaatgtttgagtgccagcatgatgccacaactggaaaattccacacctcatgtgacaggtagcagtcaaagtgcagtcaaacctttgtttcatatagaaaaatattttaaatattatataaaattatcttcaggctatgtgtataagatgtataaaacttttatgtttagacttgggtcccaccccccagatatctcattacaccaacagtgtaaaagtattcccatttctccacagccttaccagcatctattgtttattgactttttaataatcgccattctgactggtgtgagtgtggttttgatttgcatttctctgatgatcagtgatatttagctttttttttatatgtttgttggccacataaatgtcttcttttgagaagtgtctgttcgtatcctttgcccactttttgatggaatttttttttcttataaatatgtttaagttccttgtagattctggatgttagacctttgtcagatgggtacattgcaaaaattttctcccattctgtaggttgcctgttcactctgatgatggtttattttgctgtgcagggattgttttcttgatttctttttcagatagttgtaagtgtacagaaatgctactgatttttgtgtgttgattttgtgtcctgcaacttaactgagtttgtttattagctctgacaattcattcatggagcctttagggtttcctaaataaataagatcatgcctacaaacaaaggcaatttagcttccgtatttatgatttgcaagccttttatttctttctcttgcctaattgctctggctagaacttccagtactattttaatgacagtggtgagaatgggtattattgtcttcttgaggaacaagacattgtttctcaactcatgagagtaattttaataagcactcaagtattgtcattcctgtttgacagtaggccgtattttgagtaacaagggtcacagcataacttgccttttggtgaatcagttggaaccagtttgccatttagttaaaataaacttttctttgcactggtattactagaagtaattgtgcttatttataattaataataattaaatatgcttattcttagttacctaaaaaattatgatattaatgacctcttggttgataatggctaagctgcctcagcttctccaatttagcaacccaagtacatatcagttcaaagtaacacaaattgaagcaattatgtatgatcacataggaatgcttctgattaacaaaatccagaggactggtctttgccttcataaccggaacacaccacatgcatggtttcacagctcttggctattattggacttacttattatattctttaattcaagaaaaattgtagcttcattcattctgttcttaataattttaaattctctttagcctcctgggaatgggaagggctagctggtatagtcccctgtatctcagatttcagttacacataaacattaaaggggcctgacttagggcgctctttgcctctgtggactggtggggaaaatccaggtgtgtcttaaattctaataatcatgaaaatcagaaatcataatgtttcaaatacaaatcttcatacatgggaaatacaattgaattaaacattttcttcaatgtaggagacatttgtcagataacagaggggattctcatttggctaagagcttacctctaagattcattaaatgtgtttagagcatattttttgtagtttgtagttattttatttttctgagttattatttggattattttctcttttatttatgtatgcatttgtcactgctccccagaggcacctcattttggcattgaagctaaaaacccattcattaaggttgggatggagtgggctttgatatagctagcatttgggaggtagaaaatagacattcgtgatcaaaaaagctgtaagcggttactataaactatttttaaatttctaagtattttaaatattgaacaaatgtgtagacatttgatgtgcatctatactgtgaataagaacttaaacttctaatattcacattaactttcctgattttataaattctcgtttatttttcatctgaacattgaagaatgacatctacataaagtaaaagcaaatgttagtttgaacacattctaccctaatagtgcatgttttaaaattgctttggcaggatctaccaatgtattggcacattctcttcatggagttcctcatgtgataactgcaacattgcacattataatgggtaagaattcttccaaagcagttcatattttataaggaaatgttgatttatataaggaaggccatcttatttccatcagactttaagaaaaggcaggttctttgtctcttagagtagagaaatgtttgactaaaaaaccaaaaggcaatgctttactatgtggattgcctgtcttttcaaaatacttgctttgtaaagagcagtaaatgaagttttattgtaatctgtacagaaaaaaaatattgtagtgtgctcaaaattataattttataaccagatgaagaacattaatgaatactccttaagtatatccaacactgatgtaggactgtaccaagactctaggactaggattatgttattaatgaaaaaacataaccagaaaaaaatttcagccagtagatgtctatagatattttattatccctattggtaaaaagcatataagctcaggtatatgtaacactaaactactgttaaatctgtgtttaccttgcctatctactttaacttcgtttctttgaccatgttttataggaaatagcaataagctgaaaaatttagtactctgtgtttcttcactagtacctgaacaagttaaaaatggtaattattgtagttataggtaaagggaactgaagagaaagtgaggatgttcatggtctacagtacctttagatattctcctataagccaataaatatgctctcttatgtttgctgttttgatacaagtcctactgtactcactgattaatatttaatgtaatattcaagggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaagtaagtctttttcttaaaccaaaaattgtatcccaggttcaatgactgttaataacaaatttcattacattttagggcagaagactgtgaaatatcatttttaccatttaacagctctgatgatgtgcaagaaaggtaggtaaaaactcaatgtaatacagataacctgtatctttaaagcataaaacattctgacaaacaattgatcagacttaggatctttggttatttttctaacatagtagtaaagaatatagaatcacagactcttacaggtcctagtaagcaaacaactactcactcagcctttttctctttttccttccttctttcctcccttccttccccctgtctctccctccctccttccgttctctttttcccttcccttcccctttctttcctttcctttgtttttttccctttctttccttttccctttcccttttcttttgagtgcctactatatgccaggcactttgaatacaacaatgcaccaaaaaatgaacaaaacacacagttttgtccctcgtgataattttggtctagtgtgtaatacaaatattaaagccatattaaagaagggttatagtctttaaagaaatagtacattattattccttataatactagtttacctttaaatgaatcaacacattatgttggcagcaacaaaattgtacgtttttacttactatctaattgaagaaagtatttaacatatataatgatgagttctctaattttctcatatttaatagatttgtgtgtgtctgtgtgtctgtgcgcgcgttatctgttttatgtctttgttttgttttctttcttttaggagggcacagggatctcccaaatctggtgagtcgaaaagtatctccttgagaactgtgccaggttctgttgacattttgttctggtgagggaaaataaccaatcactttcattacctttagactgtaatgatcaatggcaaatgatccagggtcagttcttgaatgtcagcattatggcaattccttgcctgtgttcagtggcacctagaggcttggcacctaataccaggttagtaagcatttttattgaattgttgatacatttcttatagaccattttttttccagggtatccaattaactgttggttagctagaaacttaacaggtagtttatctttgtatattagagattctaagggatttgtcatcacagtaggttgagaacaactgttgaactggaataattatcagataatcattgactatttaacgtcactgaggctaaaataatatttcctaagttttattgatagaattttatgcctactttacttgatttattcatttagttgtggagaacattatattaaatactgatatttcttgtgaatgtctttgctttccaactttaatgcaaacataaatatccttagcatgaaaatcacacatatgtatatttgatactgtattagtctgttttcatgctgctgataaagacatacccgagactgggtaatttacaaaagaaagaggtttaatggacttacagttccacgttgctggggaggctccacaatcatggtggaagatgaaagtcacatctcacatggcggcagacaagagagcttgtgcagggaaactcctatttttaaaaccattagatctcatgagacttattcattaccatgagagcagcacaggaaagacccacccccatgattcagttatctcccaccaggtctctcccacaacacatgggaattatgagagctacaagatgagatttgagtgggaacacaaagccaaaccatatcagatacttttagtcaaaagaaacatttcagttctatttaatgtgaatagtagtgcatatcaatctcctgcccacattttcaattgaataaaatatgagacatcttatatatatctttttatccatgggatatagacattccttctcttgcacattcttcttaatcagctgtccattatggggctgaaaatatttctttcctgaatccaatcctgtagagtgtaggagaaaggatcgtgagtgttgtgaaatataggcaataaacggggaaatattcaaagttagagaagaaaaaagagaaactgcaaacttcgatattgaaaacccagatggcaaggtcctcattaattacatctagtgctaaaacttcaaaggagtattttgaaccttgtgtgatttagaaattgagcctggtggttttccccgacaccttcagaaatcctagatagctgtgtgctttcataatgtagtttccctgactaaacttgaagacgtggctagctgaccaaggagctatgtttggcaggacttgagacaatgtttatctaaccctgtttgtttaaggaccttcttgggagggtagacctgctcttctgggaacaatcgattcatagctccttcaaagccactccataaatgttctgcttgactagaattccactgttgactctgcaggcttaatcagtattaatgaatttttcagagaaggatgactaattagagatttcttctgtggtttataatcacaacatgccatctttgcaaagaccttttgatcaagactcatttgaccggagatttttcagagatgtagcttctgatgattcaggatgattgaacaggagatttcactttcttctttttcccccaccatgataaataataatttatgttagaatatctcagtgcaaattgccagtaggaactaatattcttatattctaagtattctaagattaaatgtgttcatatatgtgagacatttaaagcagtgccagccatgtaagttgtgtttctatttcaagtaaatattgcaaagcaggcataggatagtgcttttaatgtttataaattatgcaattaaagatgcacagtaacactaccatgaacgttttggtgctgtttatttttaattgggaagaagaagcatgatggaaagcatactgagcacctggagtattggtgctgatgaccattttttctctgtgtgcctttgaacaaatcacttaaacttggagttgtcttttccctctacatgaaatgagcgaatgatgagataatctctaaggtcccttacagctctgacttgagctttcataagatactaagagctctttttttattttgttgttattcttaaattaacttcatgtttgcactgaaatcaagctagaagtcatttgtatgtatttctgcaaactgcattctatagcttgatgcatttgtgagtggctgttttggcactaaatcacacctctgaattttcactctcttatattggatggaacagttatgcaagattaaaatgttcagtcatttaactgaacatgtgtggcagcatttgttcactccatttcatccatccaaaggccactttgatttatttcatttcctatgtcacttagaccttctgtctataaataaatatttaaatcacactttagattttagaaaatgttgagctatttgttacacaacttgtgcatattaactcttctataatacatcttttaacaacatagtttcacatttagaatttctaattacattgtattttaaattatgtcttgatatgtgagtaggacgcttgatggtttgctttgtaaaatgctctaatgtaagagcttattgagaaggaagccagtgatttaataaaactcatttgaaagcctgcatcatttaaaaaatagcaagatacggtttatgaattttaggtaaacgtaacatggtgatttatctatcttgtccaatactttcagtaaacagtatacttgttataaggaacagtatgtcataatttttggtataatctcttagtaaatttcttgatgtctaatagaaatatttaatttcagattaaataatggaagtatggctcttataattgcccgaaacacttctcggccagaatttataaaacacctgaaaagatatgccagtgtaaaaaatcaggtatagtaaattctttttgttacttatttgcaaagctattaatcatgtagaaaaagatgctgcaagaattgacatcgaatcctgcctcataagaaggttttattttcttctgaatatattaatcttctttttcccaatctatttcatccaaattttgaaaagcatccgccaggattaatatagattggccttttttgaatgatgaattagtggttatgtatctgtaaccacaaagataaaataggaaatgtagtgttatattgcaatgtgaaataaattaaggataaaattccatactcaggctgttcttcagaatgaaaagaagtgaaatttgagagtttagccttcttgatattatggcagcagactttctaaagttatgatctttagatcttcctgacatttgtttgcatatctgcattgattgaaatagatctgtagatatgtatttaaaaatatgacagttttatacaaatattcattcaaaatgagaatatgtgaagatatacatttccacttaagtgatttgctttaaagagaaacagtaactattacaagccatattattttggcagctgttttgacctgattattaggaaaatgatccttgaactatgtgaatttctgaaattgtgagtctttgaagtacataggtatggttgtaaaaccctatagtttcacactttttctttttctttctttttttttttttttttgagttagagccttgctgtgtcacccaggctggagtgcagtggcgtgatgtctgctcactgcaacctccacctcccacgttcaagcgattctcctgcctcagcctcccgagtaggtgggattacaggctcacacctccatgcccagctaatttttatatttttggtagagacagggtttcaccatgttggtcaggctggtctcgaaactcctgacctcgtgatgtgtccacctcggcctcccaaagtgctgggattacaggcgtgagccaccacgtccggcccacacattcttaaaggtataaaatggtgcttggatagagttgggagataacagacgggaggaggaggagagtaaacccagccaatgactggcagctgaaccttgcttatgtaccttagccatagcaagtctctccatttttgcctcattatattttaaaactttcttaggccatcttcatgaagtttgatctgtcagtaacattatttgatcctcatgtattgaacaactaactgggctgcttaggaacttaaatcataaaaaattacagtcccactttctttatatgtcaaagtagatcagcaggtataatgtaggttgtgagcctacataacagttttatgtatgtgtttgggtggaatatggagatttattgattttcaaaggaatatatgccctttcacattttaataaatttctaaacattaaaaccaatttttaaaaaacccaaagcactatatattcattgctgtttttaagtcagaaaatagaaacaagaaaatgattttaaagcactcaaaattccatgttcctcaagattagtgtcattaccttggtagaattttttccgaatccttttttattaaataaatgagaagtaaagtaagtattaacctcattcatgtacctctatttgagaacttaaatagtattaacctattaatgtacccctgagaagttctgtatttattttggggaggtgtatgttgcacaaattgtttatggaaggtctcttttgaaattgcctatggggcaagtctctcaggcaatttttgtaaacattcttcttcttcatttttttaaatcaatatacctttcttctgattttaaaagcaatggttaccttacacataaagacagacatacagaaaataataaaaatctgtatcgataggaagacgttttctaagagataatattatgcaggatttatcatattttctcatgtactctacgaggcatatcttgcttttgacacaagaaacagttgcctgtgtgtgattcactggccttaactctgatttatttatcaactttcaaaaattaaaatccatgctattttttttttttttgcaaagaattctaaaatattttgcatagtgtatatagtaagaaagattgattcccagggtgactgctttcaagcaatgttaatttgatttgttaattatccacacaggtgtgtttatttaggctctttccttcatggtgacattaaaaatgtgaatttatataaattttgtaagattatgaaaatcagatctatgtaaaaatcatgtctactgcataattcatagcagtgctggtattcaggaaggaaaatgtggcaattcagtttaaggagagtaacatctgcttctctgaaccatttttaccaggttgaataagcgaatgttactgtataacactgtaaaatagattgaaaccaccatgtgcggagtggctcctgttccttccccatctctgtgtaaaattagatagaggctgaacactacccttcaaagtccttgcagctccatcctattgctttgccccccttctcactgtccacacttttctctttcattgtgaccatttttggtagggagtttaaaaccttaaatgtgagtgcttcccccaggatttctttgcagccctctcatcttctcaggatgccgtctcctggatggcctcattgcccctcacttttgaactgtctgaacatcatgcactcccaagggttctgtcatctcgtcttatctgcaggacctctgtcttcttgtatgctgaagaggttctgaaattcaccggcatctggaggccaacatgtctacagccgaccttatcttttcccctaaagttgttccttctgcgttgctctgtgcgggtcaatggcaccactttctacccatccaggttaccctgaactgttccttcttcctcattcctcactaccagtcccctaacttgttctgttggtctcctcttaaatgtttctaaaatttctccctcaccttaattcaaactttaatcctttcttgcttacagtagcctccttttggccttcaggttctctggtcttgtcttccatacctctttttagagaaacttttttctaagacacacattggatttctctcctgcttaattcttcagtgcctttctcttgttgtcagaataatatggaatatcctcagtctggaacacgtggcctttgtatccaggtccctgcctgtgttgcaaccccacctcttattaccaccctccaccacattcccagtgttttggcattttattcgttggctaaggttgccataacaaataccacagaaaagatggcttaaacaaacagaaatgtatttctttcatggttctggaggctagagctgcaagacaatgtcagcaggtttggtttgtcctgagtcttctctctctggctggcacatggctgctttctcacagcacccacaagtgagtggtctttcctctgttcatccccgatgccttttcctatgtccaaatttcctcttcttataaggacaccagtcgtattggatgagggcctaaagacatcattttagcttaatcgtctctttaaagatcttatctccaaatatagttatgttctgaggtatacagagcgaggatttcaatacaggaatttgagggccaaggggcatgatgttgagcacctaggagtcacactgaattctgtgtagttgcttgaccatggtttgcctctagttttgtaaatgcttcctctctccagactttcttctccaggctaaatcttatatgttctttaaggctcaattcaaatgggaagctttcccaacatccatagcctgtttgcctcctcttgtttcctctgttgaactccacacttgcaccatcatggcactcccctgtatcaaaattgtaactgtttacttctcctccccgtgccccaaacataccctcacacaggatactaagctcttggctcccgaaagtcccacttaacagcgtctgtggcttcacagttaaagcatttgaaggatggctagatcttcattttgtgaggagtgcacatgacaactgctgatttaagataatagacttactggtggtggctgtcaattcttgacattccttggcttacagctgcatccctccagtctctgactctgccatccttggcattcttctctcataaggacatcagtcatattggattaggtcccgccctaatgacttcatcttaagttgattctacctgcaaagaccctatttctaaacaggggacattcacaggtaccaggggttaggacttgaacatagttggggtggtggagggaaatataatttagatcataacaggcagttgtgtgttttaaatgaattatcaactaacatgaatgattatgtagataattctacaaggatgaggcatgtagccaaggctttatacccgaggtaggaggtctaacgcagttactgtcaaacagttttgcttggggccctctaattctgtacctcagtcacaacagctgatgccatcatatcatctactgtttaactgtgtttacagtataaactggaaagttggctggaccttggtatctacatatgtaaaatatgggtgttggggaaaatattagttttctgtcaacttttaaaactgtttcattgaggtttacatgtggaaaaggggaaaaactatgtagatgatgtttaattaggaatgtatctcatgtcatttttctgaaaactgaaatgagtagttatacatttctgctcaagttatttggctatattttcttaattatgtcagaaaatacatagtgctttttcagtatagtttccttaggcaaacaagaaaaaacgcaagttgaagtttaccttgcaccattctatagtggtaagtaaacagtgatcttgcagcttgtgtccattgttaaagtgggaatggggcaggcaaacaccttttaaaatccatatttgattggctttctcttttaaaagaagacatacatcccattttatcttcagaagtttagacttgcgttcttccaaattaaattccaagtgtgaaacttgtactagtttgctttatgtcagctaaactaattgacaagttgataatggattatatgtcttctgtatctacaggccagtattaaagattatctttaattgaaaaatctacagtatcactattttatgtaacttctcacagatatgtactatttgtcataaaacaagatttctaggtgctagatctaaaagaacccaaaaggctttggataagagattccttcttccaaaaaaacttggagatccctgttcatagtctcaaagctattaaaatgtcagcatacatgctgatatttacttgtgagagagggctcagtgaactttgattcgcgttagtagctagagataaaccaagtataatgattatttgtatttatttttagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattaggtaagtctatttatttcaccgcttattgtcaaccagtaaacataaatctaatattacaacgaaagctctcttctctgaactatcaaagcaggcagttggttagtttttaaaaaatcagtaaatcagggaagcataaagagacatgcacaaatttcaataaataaaaagcaactttacatttattcaactgttatgtagacccaaggcattttctttggttatgcgtgtctacattggctttctaatttattgttgtgcataaactacagataatgtctacaacttccattttggatttttaaaaatggatcaagatcttaaatcttttagtggagccatctgaatagtaaagtgttagatttttatccttccatcttagtttcctctcactcataattactgtaacatgttttgttcagtaatttgcttttattaggcctttacagagcattcaacttcccttgggaacaattttacatagcaactggtataaacaggtttaggaacctgcaaacgcattcttggtaggcattgtgacactcagtggttagaagaagcatgcaggggtgcccactagacatgggtgttctagaggcataactgactgttttacagaggtaatggagagcattggacaatcaaggaagtcagttaaggaggttttagagcaattattgttgttgatgatttatcaatcagaccttctcagttttctagattacagctctgttgggaatgctgtgtttgttatcaatttgtatttggcattggcattgtgtaccatacttattaggtgtatgtgaaaaacaacaaaataagttgatgaaataatgtattttctttacagattgcatccaagacttatcagtctttatggaggaagcatggaagaaatgattccaaagtaacatgtaattgtttctaaaagaaatgtacaaactagaattttaatataaagaaatgtggccatgctttaaacctgtggtccccaccctttttgggaccagtttcatggaagacaatttttccgtggatgggggaatggtttcaggatgaactgttccacctcagatcatcaggcattagattctcttgaggaacatggcactctagatccctcacataccagttcaccatatggttcgcacttctatgagaatctaatgctgctgctgatctgacagggggaggaactcagtaatgctccattgctctaacctcctgctgtgtggccaaacggatatcctaatagaaattgatgttactaacaattagcctctagggctttaaaagtcaagatgaaatatcaattcaaattctgtttttagatatcaattcaaattcttttttttacaatgtgtttattggacacacaaaaaaactttgcaaccatcataatacatcaatatttaacctagataattctgaaataatttggattctttcatttttcaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttcttaaagtggtagggttttaaaattcatgatacaagtaacaaagtaagttgataacaaatactattttgaactgggcaaaatctagcccaatatgtaattgtgttccccttgtatctgagaggcctgtgttggacaaccatagtactctgctttcactgtgctcagataacctgaaatatatagttgtttctgagtagttctgagtaggaaagaaccaaatgtaaatttccttagagaccatcctggagaagacagttctaaatcggggcttgatttttcatctatgatcctagatgttctcctgaaagaatgactagcctttttataacgatacaaagttttttaaaaatacataaatgtcataaagtttattcctgtgtatacacactctgggttcaggaggttttgtgcttacatttcactactcaaatgccttcgcaaatctcagaacattcctcaccatcactgcaggcctgtgaacagataactttcatcaattaggatggctggctagtggcagggacttcatataaagaaatctttcccagaattgtttttccacattgccttctaatttgatcactccctataacagatgttcaaaattcggccacagctctcttatgaaggcagagtcagataaaatgatattctgcaattatctagatcataagcataaaataaatattacaaaaatgattgtatttaaagaaattttttaaaatccagaaagtcatttaaaatagaacctcatatagtatgaacaaactataaaaatattttacatttca

SEQ ID NO: 15 - DNA, 145347 bp, Homo sapiens
  mutation 60587: c/g SNP in forward strand
attgctatttgggcaacaatatggctccttcagaactggtcgagaatttctgtggtctttgcttgaccttcaagttgggagtttcaaatcagaggctttgaagtctggaggagttcgcagccattaatccttccggggttgtgctaaaggcgtttctagaaagagatcggaaagacccgttcagcacaggcccattgcatcttctctttgaaaacgcttgtctgaatcaagtatcttatacagacccgagactgaggggagcaagagcgcaggtccggctgtggcgaggtgtccaccaccgtacttgtggtcaatgcctggactagagagccgaggccgtccagggcgggctggccagggaaccagaagcgtccctggactggctgagtgagggtgccctttccagcaacccagtggccatggttaaaaggcagaatacaaccgtcaaagaagtccccagctcccacataagagagcgcaaaggccaatggaaccaaggcctcctcgcgagaactagctcgctttgaggacaagatcctggggatggaggtggggactgacgtagtgagagggtctggaggaacagtcgtagctgaaggtcaggacatgaagaattgcacgtatggtagggatagaatggcaggtacaacttttctgtactgaaggaactgggagaggacgatccggttagggaggttggggaactaatctcaacgctgcgtttacagatgaagccgcttttatatggcgtatatgtttgcttagaggggccgacggagattaggagaagccatcctttggcgccaatgatcaaagcgtctgccaaggagaagaagccaagggatgggcctttcagagagggcaaggagtcatgctgctctggatgccagtgtcaggacaagaaatcgaaaggagcgaggactcttcactgcgtgcctcagtctccccgcttctgcctctttcacctctgtcctacttccggcgcgaaagcaggccactcgctctgatctagacctagttaacattagcttttcccttccttccctcaaatcccctcccccctctatccccgtcccttctgccgcctgaaagggttaatctctcctgcgggtaaaaacaggtccgcggagtctctaactggcgacagatgggccactttcttctggccacaaaggggccggaatggagcgctccgcggcatacaaatgggcaggtcacgtggttccaggctcttggctggaccgggaagaccatatggcgcatgccggggaggaaggaggaggggcgggggtaggggtggagggtgaggggagcggttgtcggaggagggcgggagacgagcaaggcgtggggagaagtggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaaggtaattacagttctttcatttttttgccccagaatagaagcaataactgaagactgatgaacctacatattctgtatgtgtgcgtttgcgagagtgtgtatgtgtattgagaccagcatccccctccataattgcccataagtactcacacataatgagtcgtgtcactcaagtaccccctgcaggctttctaatttaaattttaaaaatttgggtttcttttgtggatagcataggagcttcttggattttttaaaagaatgcacggtaactatgattatctgctagtgctgattttaaagtcccaaaagcaataatgacttcactttctcacttcttacagtaagaaaaaaaaatctatgttatcaatatatattttgtgtgcatgtattttacgcacattgggagtgtcaagctgtgttttcagtgaatgaaagggacatggataccttgagtattcacaccatggaaaataaatcaggttcagagatagtttagttgagaggggggaaagtggagaaagggagagggactcactcctgctacctgttaccgctccagaggcggccaagtccccagcagccactactggagccagaaattcagttgttttactaaaggctttttattttccttactagaagcggcaacttcgcggttgccaatcgctgaccattataattactcaatcttttaaagggaggtttgaggcgaactttgaaaagccccaataaagagcgggcggccctttcaatgggctgtttattagagaggagccttccgcacctgatccccggcgcgtgggagagcgctctgcgccgcgcccccagccctcgccctgcagctagcgcttttgtacaaggtggaaatttagcggtgggccagagatggaaggcaagaaaagaaaggcgagggaggggtggaagaccctgtccacttttgttgccaaatgttacattgatggtgaaacaatttggtggaaactatttttcctcctttctgcatttgcttttcagtatcccgtcgatgtaatcttcttaaaaatcgctgccagtattagtaaattacgcaatggctgttcaacttaaatcgctaagtatctggaagccaggacagaaatggaagtagaatgtgtgattttacagcttttttttttttttatggagttgtgagtaactttgaacacatttggataaacatgaagtcgctgaaatgtacagtcatttccacacacattatcctgtcgggcaaccaccataaacacatttaagttaatcactaggatacaaacacatatgcgtgagtggtgtacacatatacatattcactaccctcccccagtcctgtcctcactcctacgtactagcggggcacacgcacgcgccattataaaacactgcatttaactttttctcagaggcattcattttgtaatgggcaggtacttttcgcaagcatttgtacaggtttagggagtggaagctgaaggcgtatctggcttttgaatatagcgtttttctgcttttctttctgtttgcctctcccttgttgaatgtaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaaaccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtgagagcaattgttgcatttcttcttaaagggattctgtttttatttttggggaaagtagttgcttttttgctgagttaaaaaatactaaacactatatgtagaataaaagaaaagaaaaaagtttaccttggcatatgctcttgtctgtttatcttgcacagggagtcaccagttctatgtagataatgaaaagacctaactgatatttcattatttggaatatgggactggacggcagtacaaacagtgtgtttttttctttgttttaagtggcttagcctttaggttttttatttccatttttaaaaatgattgttacatgttttcttctatttctttttttaaaaggtggattttaataattattaacaagcaagacataaacaagtatcctagcttagtttgtctatacatttaagatgtataaaacattactattttcttggtcttctgttatctgtacatttttctgaactaaacagttttatcttgcaaactagtactgtcccagaaaaatttatacacctttaggaagtaccaaagggaaatgagttaattaatttaaagaatccaagagaagtaacattttataattgttctattaacatcttgtgatgatttccatcatttttccaagaaaaagcataatggattatttgtactgaagaacacactatttgtactgtatttaggaaggtgtaattatttcctccccccaccctttggggcactattctgttgtttcatgaacacaactcactggaaaaacttatggatgattctgtctattgttaagtccacttcaaaaaaaaaaaaacagtttggcatttcttttcctctggatgtattgactgacagtcatgattcctagggaatatcattttggcacttgtgccctggctctactgtggtgctctgattactgtcattagtaactccattgtttctactctgattcgggtgccacattggatgactaccccccttcccaagcttgttcctttaatctccttctcattggtgatttaggggttccagaaagctgacctcatttagcaagctgctccagaaaaatgtgagtaatgtaatggacaggaacaattagccatactaataacattgccaatgaggctgcgtcaagctgtgacagaagcagtaaggaatacttcgacgttaaaaaaatgtttgagagcaatttaaaatatattattttaacatgttttctatcagccttcatcacatgacagaaatacttttaagttagtcccaactttatctaaaatgcagcaatctcattccaagtgaatcagagttgttattttggaatcaagctgttgctttctatatcctggattgttctcactgttcttactttaagagacataatactgatatgatacttgaatactaccagccttccagtgtaggaggtaatgaagtgagcattcagatctgatctaacctattaagtagctcaatttcacctgcaattaaaattagacatcttcatgcaaactaaaatctgttgctgtagtgaagagaagaaataaaagaatgccattttgagaattccagcttccaaaatagcaaacagggaaatctagactgtgttcttttgtaaggtagaaatgaagactaaaagttaggttttttttttttttcttcccattttgccaatacaacttcattctaaaacatagggattctttcagtcagtcaaggagtaactcacatgccaccatcttttattcaaaggcaggcacagatgttccttctgcaggggaggatttaatttatgaaaatgatattgtttatgcatgaatgaactgcatgcactctgcataacacatagcacttccatctgatcagagaaataccacagaaccagtgccaatgtcagaaacatattctacaaatttactcacttaaatgtttaatgaatatttggaaggcattttcaaaccataagaaacattttaaattatcttcttttatgaattcctacccatatttaaaagagactcttacagtttttgtaattggctaatgcttatacccagtttgtaagaaaagaacatattttactaaatgaaaaccaaccaaaaaaaaatgctggcaagtttggcttcactggaaaaaatatttcgtttagttttgctgtttaatgcttgtcatgaataatatttgggattctatctgtttcttcatcttgagccacgactattcctatcaaataagatgcttaggtatacttgtttaatgtgaaaatcctatgaatagttatttctagaaaaagctggtatgtaaaatcagggggaaatttcataaagatgaaattgggctaaatattgtaacatgcataattactattgaataggaacacttcacataacatattttactttatataaccaattgcagctatatagtatgatctatctacttttaatcattaaaacaattatatataaattaaaatgaaagattataatatcaagagtgttctactaattttaggtttataatatgttacagtaaaataccatttgaaataaattttgtgttctaatttatcttaaaatctctctgtttttacatttgaaagtccttacattcttacaaaattaatgcattttctgaaagaagctagcaattactaaaatgatatatggatcattagctaacagtttgaatcaagctgttttagttctataattatacaagaaatttaaagtgaaaatacctattaagcaattaataaaactaggtttcaaaatattggctaattttctcctaatgggaaatgtaaaatagcaaaactgcttcttaaactacacaaaaacctcctcacttctccttttctctctctctaacaccacttatttcctgaaaatcatctaaataaaatatttaattccagggtctgatgaagaataaaagagccaatgcaacatcttgtggaacaccaggactgagaactcttgttgttaccattgcaaagaggcgttctggcgtcagatgcacagtgatttgtatggtggcataatcattggctcctggccaggcattatgtttcagaggacactattgtcaagaaccattcaactagaaatctgcactgtatgcactcaaaagttgagatcatctgccttcctatgacaggaagaattctgtgctggcaattgactcatggactctcttcacatacactaaggcttggtccagtggctctgatggaattaactgtgcagccaaactagtggcattgacaagacagggccacagtctctggggacttcaggagaaattgctaattttaaaatgcagagtattatgttaatgctggattaaatcttcagatacattaaatgtggatttggccatctaagcattattatgttatttgcccagttaatttagaggtagatggatggtgacaataaccatctctacagatccacaattctaagagatggatccaattgtgaaatgatatggagagatagagtaagttcaatctagcatatatgaagtaatttggtaactgacttttcttttaacaagatcaaaagctaacctgctttacactttcatgtctaaggacagccaaccagagagatggcttcacacactagcccactgctaagtgcttttcattcactttcatatttcatcatcaaagcaccctcctgccttatttatagatggggaaacttcaggaagttgagatacctagatatttgcattcctgtcttcctttcttcattcaggtttttctttcattgccacttcctcaaagaagcttttactgattcccatttaaaatagcaactgacttcaactccaccaaaatcactgtattgcccctccctctttccagagcatttgcctatcaaatgttatcttatgtatttacttgtatagcttaattttaaactatctatctctaggtcttctgagcacctgagaaacagagacaaagttgtctcttctgtgtgttgctgttcctctggtgcttagaagacctagaggatcctcaataaatattaactttccaagggaactgaagagcactaatgtgatgctaaagcctgttgccttaaccactatgctataagtcaaatcagttgagaatggagaggaccacaaattattttcagtccagcaagtgttataaacattaattctataaaaagaaaacaattgaaactaatttcttattatattgcatggcaccaaactccccccacttcctttttgaggatcatgagttgtctgtcattgtttctttttattgatatcaattggttaaatataatctggaattggaataaaagaaaaactattataggctttttccagaccatgtatttcaatgcatattattttttcctttctgttcattattctttcagtaattgcacttgttctatttttagtgttatgtaaaattactgtagctcataatttctattttgaagggttcagtgtataaacttagcacatcaatactatctttttagtgttcgcgctcaatggtgtcagttaagagatcaccatcacttttggtgacgtcaatgaaggggtattgcaatgcttaagagaactgttaatccctttccactggtgtcactaacaattgtagtgcttgtttattcatagcaggtacgtgactaagtaatgttaacatcaaagcagaaagaggataatagagtgttctaaaaagaaaattcggtggttgggtgcagtggctcacacctgtaatcccagcacttttgagaggccaatgggggtggatagtttgagcctaggagttcaagaccagtctgggcaatatggtgaaacctcgtgtctacaaaaaatacaaaaactagtggtgcatgatggcatgcatctatagtcccagctactcgggaggctcaggtgggaggatcacctgagcctggggaggtcaaggctgcagtgagacgtgattgtaccactgtactccagcctgggtgacaaagtgagaccctgtctcaaaaaaaaaatgatttgagataacatcacttgtcattgtttgttaactgaataatctttattctagccagtgcctaaatacataataaatgatagtacaaatggatataaattataactaaacctaagtagtgatatttatcacaatatttctttactagaagaatttctttgttaatagaggcaaggctacttgtttagataccttaaaataacataagatttttggataaataaattaatgattctttgattctgactggcatattaaaaatattaagcgaagagatctttgcttcccaggttttattttttgtctaattaactactggtgcatttatattaaaacatattgtcaagggaaaacgtatatatatatatgtgtatatatggtgtgtgtgtgtgtgtgtgtgtgtgtgtgtgcacacatatgctatacttggttgagtagtatccccttcccttgcccacctctctcccaaatttatgtccatccagaacctcaaaatgtggcctcatttgaaatattgtctttccagatttaattaagatataagatgtaaattgatacaagttcatgctggattacggtgggccctaaatccaatcactgatgtcctgataagaagcagacagaacacacagacacacagcatacaggaagaatggcatgtgaaggcaaagacagagactggagtgatgtgtctacaaatcaaggggccccaaggatttggggcccacatcagaagctgggaaagagacaggaattctcagcttctccttctgaatccctaagaaggaatcaaccctgctgacaccttgattttaaacttcttgtctccagaactgtaatataatacatttctgttgtcttaagctacccagttgctggtgatttgttatggcagccctaggaaactgataggtatactaaaatctctaatgaattgatgttaaatatatataagtataggagagttcatttaaattcttctgaaaatgtcttcttaaacttttaatgatacagtatataacaaccagtatacgtagttggtatcgggtttgacatttaaacaagctgacaaaaaacagctgtttaataaacatctgaattatataaaagttttattgtttattattcatgtgaatgacttaaactgacatctacatttagtgaagtgtgaatgggcctagccaataaactatgggtaatttttttaaagtctcatctttgaactcacaaaaaattatcaaatatcagctattatgtattcttcatgtgaagaaaatgtcatatttatttgatttgtggattagcatatatattaatagagcttttgaaagaacaaatgtagcactttcccgatttcatagacactcatttaacacacaagttcatattttaaagtacataattttaaaaaaattctagtccaaatgaatttaagtgccatgacttctaaaaattctgtctctatttttgggttttataggaccttgagccagtactcttctggtgagcttaagaggctaagacttcacctttagttatatggggctttcatctgattatttgtctattttgattgctctaaatacaagttagtgtgtatttcatctgaatgtatttcattataagttttggttttatgtagatctggggatctgtcttgtttttaatcttgattggtctgtttgttttgggatagttggtactttcatttcttatgcttgctttctttttcattttgtgcccacctttagtcaggtgaacatcagtaaggaataaaattttatttttttaagccactgaaaaaatttaaaaaccacatcataactctgcctctgctgactgataaaaatgctaacttattaagacaaaatgttatgcaagaagactttattggaatagagaaacatcctttttatgtaagaaatatcaacagagacatgtgcctttcttgtgacaaatgtggtatgtgtgtggattagaggtctggaatgtggcagcatttcagtacttggaggggagaattagagtagggtagaaagatagacggggagcagaggatgattctcacccagtagaaagcagagtgaagaaagaaaggggaattgttttttgcattatattatttgaactgtggattaagtctttccataagccatccctacgcctctaagtaggttttattaacttaagctggtttgagatgggtttttggtcacacacaagaattgcctgatacaagagaggctttgattttgttgttgcttgctcatttttatacactaagatggagaaaaccctggacatagtgaagacgaaattgaggaaggtgttgggtagagtggagggtagaagacctgtaacataggtacagaattacattaaactggaaggacttatatccagatataggagtcagggtagaaagagagaatgttagcagtaagggtaacagagtagcagaagtttattcttaccaggtcctgttatgtgacagtggaggcatgttgaccttctgactaggggagttaaaggagaacactgaaggtttagaataatgtctctaaggatagaaagagaaagtttcatcaagactcatcaataatagggcagcagggcttagggccaagcaaattcagagaccatgatattatagtagtttgtagtggtcttaatccatctaatttttcagcattttctcaatggccaatacttagcagtggtagtgttttatggcatttggacaacagaagtgaaagcactggtaagagagacgttgaagtgaaacaccatggggctcagaaaagcagagttgatccatctggtacatgggcaaggatggtcctgaacaattctgcagtaagttggaagatagaaaaaatacctaacgaacttgtagatctgggtaaggagatttttggcagaatattgtaaggctaattggcttctcttaactatatgagatagggttttacaagggagagataagcgagcataatttagaagaactatagggggtcccaggcagactctctggctggaaaattattctgatagcaagaaattagccccaaagcaaagatgaaaagtagggtacttccaattaaacatgtcataagggcaagcctcaatcaagagtgtggctagaaggcacagctcacctggacaaaagtgcttctaagcatattaggagcatataccacaataacctgacttggacccaaagttgagagaggccagtctcaaaaaaatttgagggaattgcttttgcataatatgatactttatatacatatctgttacatatcatatatatcatattaaaaagaaaaaaaaccctgtttttccttccgttctttcatataacccttctgacaacaaatgtggagtttttcacacactaagcaattctttagttcttgctggacacttcctggatgtcctacaattcaactcgattctcacacaactgcccagagtcagtgcagacccgcagattaaaggcttagccccaaaagactaccccccactttagatgtcaatcacaagtctcaacttcatttacttctgaaggacgagctatacattggaggaaacccctctttctttcaataatttgctagaatggctcacaaaactctgggaaacatttacttatggttaccaatttattataaaggatataactcagaaacagccaaatggaatagattcatagggtgaaaaatgggggagaggcatggagcacaactctctcagcacctccatgtgttcaccaacccagaagctctcagaactccttcatttagggcttttatggagctttatcaagtaggaatgattcatgaaatactggcattggtgattaacttaacctccagcccctttcccctccctcaacattgggggtgaagctaaaagttccaactctgtaatcacagggtgagcttccctggcaactagtcccctgatccttagggggcttctgaaagtcacctcattatcataaactcaggtgtggttgaaagggatgttttgaataacaaaagatgcgcctttttcctttatctttctgagttgtttcaggagctagggacaaaagactaatactataacaacaacaacaaaaaattcaatttttgcttttatctcttgggaattacaaggattttaggagctctgtccagaagccagtgatgaagatcaaaatacatatttcttattatatcacaattcacacatgtacatgatatccgtaagataagtgaactacataaagtaagctcacaaagtttctgtaggagttttgtccatttacaaacagtttgtaagctaaaagtatctgtgacaagcctcagtcaatttagaagttcatttttccaatgttaaggacatgcctgtgacacagcctcagaaggtcctgatgacatgtgcccaaggtgatcaggctacagcttggctttatacatttagggagacataagacatcaatcgatacatgtaagatgaatattagctcagtccagagaagcaggactactgaaagtggaggcttgcaggtcacaggcagattcaaaggttttctgattgggaattggttgagttattatcttaagacctggaattaataaaagggaatttatcatgcagatgaagctttaggtagcaggcttcagagacattagattgtaaaggtttcttatcagacttaaaagagtctgttctaacagtctttaggtctcagtgttgatgttaatgctggtcagctgtgcctgaattccaaaagggaggagagtataatgaggcatgtctgagtcccttttcccatcatggcatgaactagtttttcaggttaactttggaatgtccttggctgagaggaggggtccattgagatggttgggtggcttggaattttatgtttggtttacaagtttaacattaaaagcctctgtacctccaatgttttatggacaaaaagaaggctgaaaaagctacttggctgtaatcatgggccatttcttgctgaaaagaagaataaaatggaggcagaaccaaaagcccagaggctagagccaagagctgctgagaatgatgaattagggaaccactctcagagagcagatctggatgtgagataggaacattttctttctcagggtctatgaaactggcaacatatgctctcctgaatttcagaattgctatggaccagtgactgtgatatgctttctatatttttcccttttgaatgggtgcatctatcttgattatcctctgtctcattattgtatgttggatttgtgtgggacgataacatgtgtttttagttcctaggttcccagaataagaggagcacactcaaagagcgacatttatgagatactggatttttcacttgatatcataattgggtgagacttgaaagaaagtgaacatattttgcaaatgggagggatgttaaccactgacaaccacacccacagggtccactgtattagcctatctgcaaagacggctgccaaaaattccttctgtccatatatacattcccttttttaatgtgactgtttcacctgccagcaactgaagggctttatttccatttccccttgtgacttgtttgactaacagcaagaagcaaaagtaatgctattccaattctagacctgggccttaagaggcatgacagcttctgcttttactctcttgaaactcaatgtcattttttaaaagctcaggctagactactcatcatgagggaccacatgaaaagagataggcccagctagtttccacccattccagccgctccagatgagatgccagacatgcaaatgaagccatcttggatatttcagccccagctgagcttccagctaaatgtaagtacattcagttgatacctcatagagcggaactactgagctgacttcatccaactcacagaatcataatgaataacaaatcattgttgctttaagtcaatacatttaaagtttttttgttatccagttgtagatgaattatacagcctggggggaaaaaggagatagcacactgttagttgcctcatcaatattcatccccaaattctttttcctttttagtaggtctcacctcccacctggaagctgaaaacacctttcccagtctctctggaagctacagcacaggcatgttgcccaattctaaacaataggacatgataggaggtctgctgggtgggatttttgaaaatatttttttttctggttaagaaaaaagaaatgcccaaggaaaacctacaaatgccccttccattcttgcttttggacattttttgggagagggtatgatgcttagcactcctgcagccatctcggggccaacaatagaatccttgttgctacctggtgatagtgaagtagaaagctacaaagctcttgatttcttttcttttttttttttttttaaattttattattatactttaagttttagggtacatgtgcacattgtgcaggttagttacatatgtatacatgtgctatgctggtgcgctgcacccactaactcgtcgtctagcattaggtatatctcctaatgctatccctcccccctccccccaccccacaacagtccccagagtgtgatgttccccttcctgtgtccatgtgatctcattgttcaattcccacctatgagtgagaatatgcagtgtttggttttttgttcttgtgatagtttactgagaatgatgatttccaatttcatccatgtccctacaagggacatgaactcatcattttttatggctgcatagtattccatgctgtatatgtgccacattttcttaatccagtctatcattgttggacatttgggttggttccaagtctttgctattgtgaatagtgccgcaataaacatacgtgtgcatgcgtctttatagcagcatgatttatagtcctttgggtatatacccagtgatgggatggctgggtcaaatggtatttctacttctagatccctgaggaatcgccacactgacttccacaatggttgaactagttcacagtccaacagtgtaaaagtgttcctatttctccacatcctctccagcacctgttgtttcctcactttttaatgattgccattctaactggtgtgagatggtatctcattgtggttttgatttgcatttctctgatggtcagtggtgatgagcattttttcatgtgttttttgactgcataaatgtcttcttttgagaagtgtctgttcatgtcctttgcccactttttgatggggttgttttttttttcttgtaaatttgtttgagttcattgtagattctggatattagccctttgtcagatgagtaggttgcaaaaattttctcccatgctcgtgggtaggaagaatcaatatcgtgaaaatggccatactgcccaaggtaatttacagattcaatgccatccccatcaagctaccaatgactttcttcacagaattggaaaaaactactttaaaattcatatggaaccaaaaaagagcccgcatcgccaagtcaatcctaagccaaaagaacaaagcttggaggcatcacactacctgacttcaaactatactacaaggcttcagtaaccaaaacagcatggtactggtaccaaaacagagatatagatcaatggaacacagcagagccctcagaaataacgccgcatatctacaactatctgatctttgacaaacctgagaaaaacaagcaatggggaaaggattccctatttaataaatggtgctgggaaaactggttagccatatgtagaaagctgaaactggatcccttccttacaccttatacaaaaatcaattcaagatggattaaagacttaaacgttagacctaaaaccataaaaaccctagaagaaaacctaggcaataccattcaggacataggcatgggcaaggacttcatgtctaaaacacgaaaagcaatggcaacaaaagacaaaattgacaaatgggatctaattaaactaaagagcttctgtacggcaaaagaaactaccatcagagtgaacaggcaacctacaaaagctcttgatttctaatgacatcatatgggatgaaccaacccaggaacagcctgactctggacctcttttaatgtcagaaataaaatcttatttgtaaaccactcttagttgttcaggttgttgacacaggcactgaagtgcctccaaatggtgatgaataatgaggcaaaagtcaaagacagcaagtctagtgtcaaattttttgatgcctatgggtaagaagttcaagaaagtgagctattttctttctttttaaaatttatttttatttttgtgggtatatagatgtatacattagtcagctattttcaatagtgagaagggatgttgccacttagtataatgcctttttcatagctatcatagaaaccatatatacatatagtatagaaaatgaggatagatttctgacttaaactgcctatttcatttgtgtgcctggttacacctaattcaagactctacaatacagcattgctagcaattactgtgagaatatttcaagctccctatttgctggaaatacatttcatttttttgttccaagtttatgaatattagaacctatctaaaaaggagcttttaaaaacttgaggaaaggaaaagggagggcctacttttcttgcctgtgttatttcttgttactgctgattgagatgctagagatcatattgggtgagatgtgtcttagaatacagctgagcaattcacttttaacagtttccatctgagtacaaaaaactggtatgtgcagaaaacttgatattctgacttggcgggattctaggatttgttctatttttttctgtaattgttgtagggacatatggccctgtaccttttgggcagcaggagccagaatagcaggaacattctgacaaaattcccactcagcatgagagggaagcagtccccttgatacactgatgatgtgcccacttagcattacaagtgtttgagaggtggacacaactaaaactcacctcactcaaaatatatattgacacggagaaagtaaatacaatttgctgttattaacctttcttctcaccattgagacatgttaaatatctgaaattaataaaggaattaaatttaaaaagtttacttatcatgcatttaacacatttattgagcatctgttatataaatgcactgtttcaggcacaagagatagagccataaataagcagattaaatcactattctcaactgaggtactaatctgatataagagaggagacagaaataagtaaacattataaatcaactacatacttttacatggtgtaaagtgcaattaagaaaatattattgaatagaggtcaattttggaatggttgggcagggaagaccttctgaggtgacaagaagttggcctgggcaccatggggagctctaccatggtgaaaagtgttccagacagagtagacagcaacagcagaggccctaaatgagaatgcacttggcttatctggagagtagaatgaaggccagtgtggtaggacacatactaataataggagaaaactgatagaaaagagggtttgagcaggtgggcaggaattggacaacatggtgtctcatatgtcataatagaagtttggattttattctacctgcagtgagaagttcttaataaaaaaaaaattctataaactggagtttgagaaagaactatgttgatgatagcataagccctcaatcacttgtcacataaactccaaacttcagcagagactcagggagatcaaagggactaccacaggattacccactggctaaaattcagatccatggcagttggtcctgactggaattagacttccttgtctgttgccctcattgcagtgggtctgaatgtctctgtcggctgtgaatttttctccctctatctgtggcactgagaaggtggcccagacttccagagtctgtctcattggcctattacttggggatttgctgcccttcttctggaagtttgggtatttgttttcagagcatacttaaaggcctcctgaaagcaatgttaacaatagcaggatatattttacagtcttctactcagacttggatttttaagaaccagggatggagactgtgtttccagatctagtcaaatcccttccaaacataaagcaacaaagtgccttttaaactaggacctgtactgtttaatgctctggaaacaaatacccaagcttcagccaaaggagggaaagctatgttcaggaagcttcctgaaagttttttgaaagcaattttcatgcattagtattttacatatatatatatatatatatacacacacacacacacacacatatatataaacatatatatatatacacatgaatcactaatgagacaattgatcttcaggaactaacgtgaaataattggggtatcttggtattattgttatagataaatgttgaagaagttcattctttcagatattaattgagcacttactgtgtactaagaactgtgatagatactggggatttaatggtgaacaagataaattctctgccatcagggggcttatattctaacaaacttaaaatttactgagtgttctctgtatttcagtattgttactaagtacactaacttagtggggaagctagacaataaacaaagaagtatgtaataagaattaatagtaagtgctgtaaagaatactaaagcaggttatggtagagagattaatggcagcgtgaagatgtccatgtttcaatccccagaacctgtgaatatgttaccttacatagcaaaagaggctttgaaaacataattaagggttatctgggcaggcccaatgtaatcataagagtccttatctaagacgggggacaaaggtcaaagacagaggaaaagagacgatttaaggatagaagcaaagaggagagatgttagactgctggctttgaagttggaaaaagtgaacatgagccaaaacaaacaaaacagaacaaaacaaaatccacaggtgacctttagaaaaggggtccccagtctctgggccatggaccagtacctgtctgtggcctgtttggaaccaggctgcccagcaggcggtgagtggtgactggtggacaagcaagttttaccacctgagccctgtctcctgtcaggtcagtggcagcatcagattctcatagcagcctgaatcctactgtgaactgcacatgcaagggatctagtttgtgctccttatgagaatctaatgcctccaaaatgctcaccccttcaaactgcccccatccgtggaaaaactgtcttccacaaaaccagtccctggtgccaaaaaggttggggactgctgctctagaagccagaaaagaggagatatattttcctctagagcctacagaaggaatatataggcctgctggcaccttgattttagtcctgtgaaactgattttggatttctgacctccagaaatgtaaaacaatgcattggttttgtttcaagtcactaaatttgtggtaattagatacagcagcagtaagaaatgaatacacaggtttacaggatggtgaattatggagggtgctcaggaatggcctctttgaggtggtggcctttaaacagaaaaatgagcaaagtgaaagaatgaaccatctggtggggagaaaagcattccagtcagagggaacagcaaaagcgaatgctctgagaagggattattcttctcaatgtgtttgaggactggcaagaaggctttgtgtgaatgagcaaggggaaaaagttagtaggtgatctcggagacatagccagggtccagattataaaggacctctcgccttgctaagcattttgactttattccaagaataatgggaagtcaatggaaggctgtgagcagggttatatgctctcgttattttttaaaggcacaatgtaactccaaaatggaaaattggctctgggctggaggtgccagcacaggggaaaccgaaagcagagagctgggttgggagagcggagactgaagttgtccagctgaggggtgcagaagtgcagactgcaatgacagcaggcagaaaggactatatgttctagacagaatggacaggatttgctggtagattggattgaaggcatgagacaaaggagacatggatgatatcaaggattttgatactacagatttgaaacattctgagagggacaggtttgtgatggaaaatcatgagtctggttttagatatgttttagaagcttattggacagccaagtagagatgtcaggtagggagctggacataatacctaaagttcaggagagtggttggagctggtgacatcatttgcagaaccctggatggtacataaagcacgggacagtgtgtggatagatcctaaagagagccctagggcactccagccctggaagaaggcagcttatcaaaggaaaaagaaagaaagaaggaaacacaatccttattacttccatcttcaggacaattcaaagccagtgtttttgacttcctggcttgagtgaagcttgaaaaatggcaacttgcccctttgcaaagctcctaaggagtagccattggcttggcctgtttgcactggctctgggtgagcttttaaaatgccagtgagctctaattgtgttgattgcctaacagctgtgaatacaagatgctgactccagaactgcaactcattctgcgaagggcaccgtccttttccctctaatgactgctgaacagagccacctgaagcctgcatggggtttagcagcagctgcacttctgctctaagaaatagctcactgcagtcagatcaaactgaagctcttccttgcttttcctcgaagcttgggtacttattgtcggagcattaaacagtaagagtcctagcttaactggtgcacagtgctttatgtttggtagggatttggttaggcctacaaaccgtctgagctaagaaccttgagaaactcctgctatagttagctctttctgtgactctgcagtgtgaccaggaatgaggacagaattaagaatttgctgcctctatgatagaactgtttaggcactagaacactggaactagatctacaaccctatgaatttaatttccttttcaactcccctactccttcttttcaatatgatgataatgatcttgtttaaaaaaaaaaaaagccttctgctttacttcccactctgctcctcttcccagggactcactttcttcttgactgcttccccattacaagtactcagctccctgttttatcaccctgcttagagcagccattatcagccttggctgaacattggaattacctgggaacttttaaaaatccggaagtctgggtctcgcctccagagattccagcttagttgtcttgagcgtggcctggacatttgggttttcaaaagttccctatgtaactttaatgtgcaaccacaattgagaatcactagcctccagactctctgtgttatcaaaattaatgagcagctgattttagaaatctcagttatcaggagaaaagggtgaacccccccagggctcttctccttttccaggtgacacttctttatggcagtgcgtgaaagtgaagccctgctgcttgtaatctccctcaagggagtgcaagatccaggcaaagacaagactgcagaggcgctaccttgggggaaagtaggaccctaaatacttacacctggaggcacttacctttaatactgaatttgtcagatgcaaatttgtctatgcaaaccagggccttatctctagcttcccctcaggggttttgggaagtgcgctactactctgaaacagggttgtaaagcgtcacctgtgctctccagggaaccctctggaaaggaggtggaaaaacagaggcttccacccttgcaactctaagtgtgttccttggccagtgggatccatcacctagtattttcttagatatgtggtatctgggggccagtcccacacctatgcaataagaatctccatttgaacaagatgcccaagcgattatatgcaagtttaagattgaggagggctggtttaactcgagggtaacgaaaagtacgaaatcgtactttacaggagaagctaggcggagggagccacttattcttcctcttgcagctgggtctttttgtggtgagtggcgaagcggcgaggctggcaggccagggtgctggactgggtcaggcgcggccccgcctccctcctgggtccctgccctgcgcgccgttgctgtggcagcgctggacgcggctagagctggggctgccgcgccctccacctccttctccaaaggcctccccggacccctggctcgggcccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgagtgcccggccccaagcgtcttcgcctccctccgcgcttcctccctctccccggcccaaggcctacacccacgagcttttgctccaccctccccttttctcgcctcccctccccgtgctcgcctcactgcccggacaggttaccgagtccccaagtcgccgcctcctccttcccaactgggaactcacgcctctcgccccatcccagaacccccagggattctttcgctacctagccttttcccgcctccgagaccttccccgggcaaacgtcacaagcagcttttgctcagagtctcagcagaaaatcttgagccccaaaggggaggtaatttacaaatgtgagaaggtcaactactcctcccctccaagttgaaaaagttttaatccattaactttgatggtacattgaaactataaacatctcacagattatgcctacacaagagttctgaatccaactctcattttgctgacttgaaaatgtaactccagagctttgggagtgtttctgggtttttttctgcccctcaccttccttgccattgtctagaattaagacttcttcaggctcggtctagaaacttttgatttttaatattgaccctagattattggatcacagttttgcgatgcttagttacgtcaagcggtttgcttaacgtttgccttttattgacttaaaattttagttacctaaaaaagttataatgctgtagtttacaacaaatacttcgagtctattttcacgtcttagtcaaatagccttatagacttaacagatattttataaagaccattttgcaagtcttataagtagactttcatatagtcttatttctaagtccaaactcgagaaatactccccattgttgaattagcttagatgtgagcggtgaaagacagatgaaatgggggaggaactacatcaaggttactctacttgcgaggagatgacttgggggagatggaatttggtattcaacctcttttagctaaatacaaatttatgaaattaaaaaaattgccttcccctgttggaaaacaagacacagtgtggtatttatgttacagaatagactcactgtcttaaagtcttgctcaaaagtctaacaaaatgaaaccaactagccagggattcagcactggttgcgattgtgaattctgcctgtgctgcatgtgccatgctcgctcgcttcacgaaaacagtctttgaccttaaagtgttttcaggtgttttaaaaaccaaggtgtagtattttcttgaaccttttaagttaaaagctagggatatagctatggaattatttgtaagtctttcaggcaattcgagttatgcaatatagaagtttataattacagtttggattagcccaaagagccagtttaacctacagtgcagctgaaatgctatagaattaaaatgagacattgtgcaatgagaggtcatacaaaccaatgttgcagtatttgtgtacaaaaaaagcaaacaatgacatgagaaaagaaatgctgttttatattgagtggtgattaaggtaaaataggtttaattagtgcacccctggcagtagagtttaaaatacatcttgacagatttgtaactttaaaggttgcaagtactgattctttgtttaattatgccctaaaaccatttggtggtcttttccttcatacaggtgtaccctttttctttgtaattaatacctggtattcaaaccactttgggcctctaaaattgggggcacagaagcctagagccttagtaagtacttctgtttatggaagaaaccaagagatgttttatttaggtaaaatatagccaggcgtggtgtgtccctgtaatcccagctacttgggaggctgaggcaggtgaattgcttgaacctgggagttggaggttgctgtgagcggagatcacaccactgcactccagcctgggcaacaagagtgaatctccatctcaaaaagcacaacaaacaaacaaaaacaaacactgggaaataagaaggagatattaagagatgatatatttaaatgttagaaatgctctgttgttgaataagcttagatgtgagtggtaaaagattaaatggaagagggagctacatcaaagttactgtacttgggaggacatgatatggtaggatgtggtggggggagagcatgtccattgctggttggcaagtgactggctgcctcagaaaaggatgagggtgggtaggggagatcactggagattattagaacatacgtatgttttcaagattgcttagtttttaaacctcatagtactttgttttcactgatgaaataaaatactatgtgatctttttctaattttccatcttgagtaataagcaaagacattaatgtattttatgaaggctctgactgccaaaattgggacaaattgatggtcttgttggcagggtaaatgagcataaccgtagtaattgtagttctttttattgggttcagggatgacctggaataatggatgtgttattacccttccctgtagaagtgaggctttcgaaaagaggctataagtcaatttgggaggcacaaagtatcagcgctttttggggattttttttttttttaagtagagaaatattttaaatgtgtgatataaagttatgcatgtgcttcttaagcacattaactcaaccagatccaacagctggtctaataactttttaattgtttaaaaaaatttaattgacacattgtaattgtatatatttatgagatactatttgatgttttgatatttacgttgtacaattatccaatcaaagtagttagttatccttcacctcacactttcattatttccttgtgggttagaacattcaaaagactctcttctagttattttgtaatatatagtattttactgttaaccatagtcaccatactatgcaacaaaacaccagaatttattcttcctacctagttgtaactttgtgtcttttgactaacctctctccatccttccttctcccctccccttcccagtctctggtaactattctaatctctgccttatctatatcaaccttttataatagaaaaagattctacatgtgagtgacatgtggtatttgtctttctgtgtctgggttacttctcttaacacgatgtcctccaggcttagcattcacaattgacaggactttattttttaatggctgactagtattccattatgtttctgtatcacattttctttattcatccattgttgtacgcttaggttgattccatatcttggccattgtgaatagtgctgcagtaaatatgggattgcagatctcttcaacatactcattttatttcctttggatgcatacctggtagtgggattgctggatcatatgatacttctatttttaattgttttaggaacttccatgctgttttccatattgactgtactagtttacaatcataccaccggtgtgtaagtgttcccttttctccatatctgtgtcagtacttattttcttttgtctttttggcaatagccattctaactggagtgaggtgtatctaattgtggttttgatttgcatttccctgatgattagtgatgtcaagtatcttttaaatgcacctgttgatcatttatatgtcttcttttgagacctatcaattaaagtcgtttgcccatttaaaaaatcaagttggccaggcacagtggctcacgcctgtaatcccagcactttgggaggccgaggcgggcagatcacgaggtcagaagatcgagaccatcctagccaacatgatgaaaccccgtctgtactaaaaatacaaaaattagccgggtgtggtggcacatgcctgtagtcacagctacttgggaggctgaggcaggagaattgcttgaacccaggaggtggagattgcagtgagccgagatagtgccactgcactccagcctggtaacagagtgagacttcatctcaaaaaaaaaaaaaagtcattattattttatctgttgaattaattttcttatatattttggattttatccctttgtcgcatgtatagattgcaaatatttttctcccattctgcagctgttttcactttgttaatagttttcttcaaggtgcaaagttttttagtttgatgtaatcttattttgtctatgcttttgaggtcttattttaaaaatccttgctcaggtcagtgtcgagaataatttcccttttttcttgtaatttcatagttttcaagttttacattttaaatctttaatctatttttatttttgtatatggtgagagggaggggtttaatctcattcttctgcatgtgaatatctgattttcctagtaccatttgttgaagagactgtctttttcccagtgcatgttcttgacatcttaaaaattcagttggctgttgtaggtgcaaaaatttatttctgggctttccattttatttcatgggtctgtctggttttatgctagtaccatgctgtgttgatatagttttatcgtatatttcgaagtcaggtagtatgatacttccagttttgttctttttgctcagggttgctttggctatttggggttttttttgtggttctgcatgaattttcagattgtaacatttctgtaaagaatggtgttggtattctgatagcaattgcattaaatccatagatcactttgggtagtatggccattttaacaatataattatttcaatccatgaacatgtactatcttcccatttattgatgtgggaagataatttctttcatcaaagttttatacttttcagtgtagagattctttcacttccttggttgtttatttctaggtatctttttttttaaaaaagtactataaatggaattgttttcttgatttttcacatagtacaatattagtgtatagaaatgctactgatttttatatgttgattttgtgtcttgcaactttactgaattctaacagttcttttgtggagcattttgggttttctatctataagatcatatcttctgcaaacagggacagtttgacatgcttctttctaatttggatgctcgttacttctttctcttgcccagtttatctggctagaactttcagtagtatgttgaatagaaattgtgtaagtggccatcctttccttgttattgatcttagaattgatctcgttattggtcttttcccattcagtatgatgttagctgtggatttgtcatatgtggcctttgtgttgaagtacaaactttccatacctaatttgttgggtttttaatcatgaaattatgccacattttgtcaaaggcttttaatgcatctattaaaatgatcatacagtttttgtctttgttaatgtgtatcacatttactgctttgtgtatgttaaaccattcttgcatgcctctgatcccagtgatgaatcgcacttgaatgtagcaagttatctttctaatgtgctgttggatttggtttgctaatatcttgagaatttttgcacctatgttcatcagggatattgtactatagtttcctgtgttgtattgttatctgattttggaattagggtgatgcttgactcatgaaatgagtttggaagtattccctttgcttcagttttctgaaatattttgagaggaattgatattggtttgttaaatgtttggttgagttcagcagtgaagccattcgtttctgggcctttctttgatgaaagactttattactgattcaatttcctcacttattattggtctggtcagattttatgtcttcctaacttaatcttgataggttgtatgtgtcggggacttcgttttttctatgttatcaaatttgatgaaacttgttgaaaaccaactctaaattttgttcatcttttgaaattatttttagtctctatttcatttatttctcctctgagttgaattacttccttacttctaccaactttgggattagtttgttctgttcttttttttctttctttctttttttttgagatggagtttcgctcttgttgcccaggctggagtgcaatggtgtgatctcggctcaccgcaacctctgcctcctgggttcaagcaattctactgcctcagccttcctgagtagctgggattataggcatgtgccaccacacctagctaattttgtatttttagtagagacggggtttctccatgttggtcaggctggtctcgaactcccgacctcaggtgttctgcctgccgtggcctcccaaagtgctgggattacaggcatgagccacaatgcctggccgattagtttgttcttaattttgtagtgccttgaggttcatcattaggctgtttgtcagaaatctgttgtcttttttgatatgggcatttaatactataaacttacctcttaaaactgcttgtgctatgtttcgtaggttttgttatggtatattttcattctcacttgtctcaagaaaaattttaatttcctttttaatttcttcactgacccattggttgtttaggagcattttgtctccatgatttgtgaagttgtcagtttttctcattgttgatttctagtttatttcttttctttctccttccttctttccttccttccttccttccttccttccttccttccttccttccttccttcctccctccctccctccctccctccctccctcccttctgtattgctttgtctcccaggcccaagtgcagaggcacgatcttggcttactgcaatctctgcctcctgggctcaagcaatcctctcacctcagcctcccaagtagctgggactacaggtgtgtgtcactgtgcctacaggtgtgtgtcactgtgcctggttaaatttgttttttgtttttgtttgttttgttttgtatgtttagtagagatggctttcgccgttttgccatgttgcccaggctgttctcaaattgctgggctcaagcaacctgcccaccttggcttcccaaagtgctgggattacagccatgagccactgcacctggcctgatttctagtattataacgctgtggtcagtaaagatacttgatattatcttaatcttttaaaatttgttaagacttgttttgtggcctaacatgtgatctctcctcaagaatgttccatgtgcatttgagaagaatgtgtatctgcagctgttggacggaatgttctgtaagtgtctgctaggtgcatttggtctatggttcagcttaagtccaatatttcttgatctctctgtgtgtgtttgtgtatgtatgtctagataatttattcattattgaaagtgggctgttaaagtctcttactattattgtattggagtttatctctttaggttgaatatttgctgtatgtatctgggtacttaggtattaggtacatgtatgtttataattgttatatcctgttgttgaattgatccctttatcatattatgaccttctttgtctctttttacagtttttgacttaaagtctattttgtctgatatgagtattgctactcctgctcacttttggattctgattgcatggaatatctttttccatttcttcactttcagtctgtctttaacggtgaggtaagcctcttttaggcagcatgtagctgagttttttttccagtcctgcagctactttatatcttttcattagataatttatttacattcaaggtttttattgataagaacttatttctcccattttgttacttgttttctggttgtcttgtagattctcagttcttctttctctcttgtttacctctgtggtttggtcattttctgtggtcctaagctttgttttccttctatctcttgtttatgtatctgttgtaattgctttctttgtgggtaccatggggctaacataaaaagtcttgtagttataataaactattttaagctgatagcaagttaactttggtcacataaaaatactctagacttttttcctccgccatccctaatttatatttttgttgcctttatttctttagtatgtgttccctagccattgtagctgttgttgtttttgaccagttgtactttaaaccttcatctagaggatcgacaggtttacatagtaacatgatatcactggggaattctgagttggatttatacatttacctctattggtgaggtttatattctcacatgtgttcatgatagttatcattttttcatttacagctgtagcactcctgtaaacattgcttgtaaggctggtgtaggagtgaattccctcagcttttgtttgtctgggaaggcctttattctcctccaggatagttttgctggatatagtatcttttgtccttggccgagactcgtttttttttgttcttttagcatcttgaataaattatccctttctctcctggcatacatcagtaatttaatgttactgatgagaaatctactgatagtctaattaggattcccttacatgtaacttgatgcttttctcttgcagattttagaattctctgtcttcaacttttgacagtttgactataatgtgccacagagagaatctttttgggtttaatctaattgggaatctttgtggttccttcatctggatgtctatatctcccccaatatttgggaagtttttagctattatttcattaaataggttttctgtgcctttcttcaacttttctccatctgccagttctataatgcaaaaatttctttgcttagttttttttaaactttgggttatttcacaaaacctattttcagattttgaaattctttcttctgcttgatctggtctattcttgaagctctcgattgtgtcttttattcactgcattcttcagatttctgtgttttaaatgatagatcttgttttaatttctcattttataactttcctgatttcattgggttgtttgtattctcttgtagcctgctgaatttttttaagatcattatttttaattttgtttcaggcattttataaacacccttttctttggggtctgttactagagactcactgtgttcctttggcagtgtcgtgtgtccttgctttttcatgtttcttgtgacatctgcacatctagtggaatagtcacattttccagttgtatgcagtagctttcacagggagagacttttcctgtagatgggtcctagagtgttggttgggtatggtacattggctttggtttggggtggattcagtaccatggtctctgtgtagtttcgtcagctgtaatcttcacagcaatgtctgatttcctcagtggcctaggctgcaggagtttttgatggtggtatagttttgctagggacaggcatgtcatgctagttgtcaggctggacacttgcaggctcggagggctgacaagctgtcttttgggctccccagggaagagaaagtatgattttccagcttttcttctatgtttatttaaaactttgttgtctggctcacagtgttctttatctaaagtctagccagtggtggtggtcatattgcaatcattattacagcttcagactttctagaccttttccattttagtgaccttcagccttcattcgcttccattcatgaccacagaatagatgtagtcatctctattgaaggcaaacccatcccatctcttcagcttcatctagaaatttgtttcatctgttacactttctttctttggtttttagccttcattctctaccagctctttcacttaagcagagatatgttcaagactctcccattctaacagttccctgccttgatcctacaagcttttctctttagctgctaccttgctttttatttttatttttttctcacttgctctgataatctcctagaaaaattggcttactctgaccatctccattagttcacctcttaattattcttcaaccatctgagacctggctttgttctttctctactgaaactcttcaggcagagattagcagaagtcttctaattgctcaatgaagtggaaattttcagtccttattttctgtatttctccttcatttgactttgacttaactctcttggtttttgtaataccaccagcacctagtttatcagtctctcatgggaacttcattctatctgcctgccaaatggtggagtcccaaggactgtggtctgatctgctgttcctcattacatgctttctggtcagtattgcacactgtggttctcatctaccatcatctacctccagaagtgccatatatttagtaagtttacaagaaaagcaactttccttgctccgtagactaactctgatcttttgttccctatcatggttatggaactcactaattattcagcatcagctgtcagaatgtttaactttgctatttaggtttgtgtaagttatgggacaataactaggataactagaattagcttgtagcttatgtgggttagataatacaattgcatatgtaagtagtgaatattttggcttaataagtgaaggagtatttaggaagctatctggaatgttatctaagtcaggattctgaaggtaactctagcctcactgtcccttactcactatttctaaacacccaccaatcctgcctactttatttacttggtatttctccaatctgccatccttctctgtccgaccaatcactaccctagctcaggccttcaaagtctctcacttgacctactccttcacctcctttgaacctgtgcacaaatgttagcttcttagtaaggctttctctggtcacctgtataaaattcccatctgctacatacttcctggttccctgtattgccttatattcctcagtggcatttatctccttgtatactatataatttctgatctctgtcctttctattaccaccccacttcaagatggcaaggatttgtctgttatattagtgactgtcctaataggaaaaaaaatggcacatttatattagagtaacttgagaagaatttttaaaagtcagtatttataaagctgtagatatagagatagtgaagtactcttgggactagtaatcattgggcaggtgataccatttttaagcccaaaagggcatagtgaaagagcaggtgcctgaacctggattcagagagactatgtagaggaggccactaggcaggagctgtggcctttgcctcagcttggctgattacctcactaatcctcactaatcctaaattacccaagttccttcttttctggcccatttcacagtccaaagccaactttaagccagagggcaaggggagcacttgatgcagtccatgcagtatggcctcccagtgaacagggcaggtggaggatagaaactaaatctagatggaggagagggaagatattcagaatatgttttttctttactgtcagcaccttgaagagtgcctggcatatagataatatttattgaatgaatgaatttgttactggtttactggcctcatgaactttagttttgcctattctattataacttggtgactacattcctatatacttgataccaactcctcattaactacaaaggcagtattcccctctccccctttttaaacatcaaaactcttttttaaaaaaaattcttaaatgaatcgccagtatataacacataaaagtatgggtgccttgattggagtggtgggtaaatgatcctgagtctgtctgtttgggttccctctttgcctagcaggaatgtgactgtcttgtttaaagcccactgaagtagaaaacaggatgagagacacactcttcaacatggcataagatttccatgcttggctcctgcctatctctgcatcctcatttctcagtagtttcctcatattttaccatcctgtaattgaaagaattacaaaactagttctctacacaagctttcttgctgttccagctgctgggaattagcttcctttgtgcttttttttatttgaatgattcatgtttacattcattaaaattaatgaagattcattacagttgttttctctttaggcataattggatctcctatactgagacattgaatgcaactttgattgtttttttcccccattatatgttaagctccttgaggttcttttcaactttgcgttattccaggatttctatcgtaagagttaaggttcatccacttctctgatgtgaggttcatggcaggaaggttccatgttgctcagctgcagagtagaaaatactgagcagggcttaaatagattaggatgctgccattataatataaactgtgtttacgaaagagcatcatcaattcagaaaatatctttttcattgactacagtggtgcctgatgatctttctattacaatcttaaattatggtcattttaattatagaatcatacatgggtttatttatgttaaaataaggtaattatcaagctagctgtgacctatgagaaaaatcctgaagaaatgatgaagggatcaggtgactgtttttgaagtcaagtgtgaaaggtcagaccactctgggtcatgggaccctgccaaggcagagcaggtcaagtgctgtgcccagtggggccaacccccagtatggtgccagggactgggtgtgagaagtcaaaaattaagaatacacctcagaaaggggacatggacagatgccacagacttatttgcgtatttcatgatttagcccttagcttgtgctgatactggatcagatattttcagagttcagtattttcaaaagcatcgctgatcacctgttggcattgttttacatctcaaccaaggaaaaacttttgggacatctgtttaacaaggggtaagcttttatttgaaatgttcgattaaagcagaagagtcaggcatttttttgtgcctccccaaagaaagatttgtttactgtcctgtgtgaataaatataatgtcattatttcccgtaaaggaaaagctgatggggagagtaagtaatgggtaagattaggcaatgttaagctcatatattagtatgtttaagagtgatcaatttagggatctctgtgacagagatgccaaatgctcacagtgctatctcatgttggaaacatgtgtctcctccacttttcctcagtcctctgaaatgacggccctttagggattgacagatactatacagatttctgtgctgatatgtgatttgtctaaaacaaaagtttcacaaaacaattcttaccattgccatttaagagtcactctgatatgctctgtttccattgcaaacaaatgctcattatgatttgtgaaattaacttcacaatttcctaatggataacaccttgaagtatgaaaagcactacaggatcttttatagcttccctcctccagctctctataatctgctcccatctgtggtgtaggaaagatttcagcagtggccgctgaaggccctaagatcttgtctcaacagatagcaaggtgcataacagactttggacaggttgtttaacatgtctgagttactgtttattcactggcaaaatgaagggcttatattatattgtctctaagtactatcagttctgaccacctatgaactttcattttaaagaaaatacctatttctatggcctttaggcattagggaattttgtcaaattaaataaatctcagtaaggtttgatggtcaatggggcccactgtctggtgtgtgtggaggggtgttgtattttacatcaggaacttcagagccctcatgaatttctaattagaggaaccacctgggaaatataagtcaaagccctttgctcgccttactcagctttagggcacagtgactagaggtgggcaatcgctttggtgtaggtattgtcattggaaaggaagaaaccattttctggaggaaaagaattggttgaggctagctttaagcagctatttcatgatggacaaaaggactagctcatccattcttcattcgtttctctgtatcctctatcaaatttctgagtaaagattttatacaatgcttgattagcattcaaatagtatgtttcaaagattttaaaaaaaataaaactaggcctttgaatcataattatggcttataactctatttttcatatacttactatctcaagttacaaatttcatgttatgtttttttcaaaagagtattcctgccacaactcagagctcagctgaattagagcagtgactagaaaatctgagaaggctgagcttcaaaataaggtctggaaagtgtttcttattgttacaagagagtcaaaatgattttcttgagctttaagtttatgtaagtatttacttgacacttagcagtttaaaagataatgtgcaaaaatatgaaaatgagaaaaaacaatttcaaaacaagagttggtgattacgtgagacttagtagagcaaagtatattctaagtattaatctgtctaagctgtttgggaacagatgtacgtgaaatggataccgggtgttctgttgtgtacaccccaagtgagacatctgttggtagactgtgtggtcagaaataatggaagcaggggttaaaccccaatatgacctattactcatgtgaattattgaaggactaattactcagtaaaacatgatgctttgattcatcagtctacacgttaagaaaaaagcctctttagaaaaaaatttagttctgtttctaagctgtcaaatttgaggaaatttttaagatgtatgcaaagactcaaatttccatagtaactgcaaatactatctgcttataaagttttaaaatgttttgacaggtctactaatttatcataaaaatagcctcaaaagttttagctttttgttagggtaggttgggtctcacagaaaacaaatgtagagtgaattttctaaagcagggctgtccagttagacttcctgaaatgatgggagtgcactatatctgaagtgttcaatacagttaccaccagctacatgtggctattgaacagaaacatggctagtgtgactgagaaactgaatttttaattatatttaatttttattaatttgaattcaataactgcatgtagcaagtggcaactgcattgtacaacacagctctgacacatggagagttgaaaatgtttgtttactttcttcccaagttttcattttagtctttgtttctacatagaaaggaagatatagcttttgaaaaatgaacctgaatgtagaactgatatggttatgcaatttgagctgcctatttaaagataaagcaactgagtttagagatttcaaagtggcagagtcctttaacatatttcgtgggctggccacggtagctcatacctgtaatcctagtactttgggaggctgagatgggaggattgcttgagcccaggagttcgaggccagcctgggcaacatagcaagaccccatctcagggaaaaaaatatgtgtatatatatgtatatatatatatatatatatatatatatatatatatatatatgcatacacatatatacatatatacacacatatattaacatattttgtgtgtacaaaaaatatttttattatgtgtagattagttggttactagtaaagttgaagtcttgtctatagaaatcattgtatttttcatggtcattgtgatacattgtttgaactgaaatttggcaaattcaatctgtttcttactacaagaatagtacatagatttgaaatggtaactctcttagtctgtgtactctgaccctgtgaacgtctggagactaatgttattcctaaatatgctatgtccacatggcagcatctgaaggcaaacactttttaaaactgatctacttttgtggacccttcctctctctctttcctgcatcccggatggggccctctggggctggaactggcacagaactattcccctaggagtgggttcattgaagccaagggacacacaaattgagaatcagatagactggaccaaggtcattaaaccagagagggcaatccagatggggttgtccaaagtaggaagttctgaagtgaattgcagaaatccaaacatggcaaagctaaaggaatagagaaccagggcaatggatatagagaacagagcaattgggtatgcaggaagatgctattgcctagactggatgtttttgtaccctctgtaatttgagaaaatggaccgtccttgttgaaatggtcagggatgtagtagataaattcattgcagttgtgtaatctcagcactagaatactgatcataaccatatcacttgttatcccacctagcctgccacttgattgggttattagattacatttcagacattgacaagtctacaagcatcattaaaatcctaaacacagacttctgaccgtattcctacccaagttttagaagcactatgccaatgacgggggtagtatatgctgagcaggtgagttttgattgtgtgtgtctacatgtgtacgtgggtgtggtgagcaacaggaaggaactctcagccatgactctaaatgctcttgtgttggccaaaattggtataagctaggaggagaaacacaaaggagagagaggcatgaagttgaaggacattaaaccatttgcaaacttttggcatgcaaaccagaatatgaggaaacttagtgtaatgggtgactgaattcagaggtagacaggcaatcaggaaggtataggcaccaaaaatagttaccattggtgagcgtttttgtttttgtcattggcatggtgttatgaacttatgttaagcctaagggtaagtctaaaataatgtaccagctggcatcagggaattcccatgtacattcctagattttcattagaaacagtgttctggaaactaccactgctgctacacagcagtgcccagtgcttgactgaaaatagtgaacacttagatttgtttactctgccaggttctgtgctaagtatcttatcttgtttaaccttagcaaagaaactatgtagtctagatagaatttttatccctagggcccagaggtgttaaataacttgcccaaggtcataccagtaatttcagttgctggggttcaaagctaggcagtctgactccagagcctgcactgtccccatttggttatgttgcttccccagttaagcaagcaagagtctatctgacatctgagttggtggtagtaaagcatcatggtctgaaccaaaataataaaaacctttgaaacaacattatctgacttctttcaggcttttaagacagttccatcatcaacagcttattccatttctctggccacttccagtttctgaacaaatgaagaaaatgggagtgataaattggagtttttaacaagtttttttaaatctaattttttttatggaaaccaccaaacatacccaaatgtaggaataattatgtaataagtcctcatgttcaaccctaagaggggtgaagctctatgtgacccattactgagtttaaacagttttcaatttatggccagtcttatttcatctatactctacccacatcccttcttcccctggaatgattgaagtaattcctaggcatcatataatttcatctgtaagcatctcagcatgtatctctaggagataaagattttctaaaaaatcatattactactcttcaaatttaaaataatctttatagttttacatatccagttagtgtccagattttcctgatattttctctattttttaaatatgtcaaccttgaaatgaggtccatattatagctgatggctatgccttttaaattttctcatccacagattcttcttccttttttttcctttcaatttatgttttgaacaaactagtttggcctatagtttctcatgggcaagaataaccttcagactgggatggccatcactctgatacccgtaaaggggatgaggcaggttggggaagggagagcctcagaccatgatcagatgtcacaagatttttgcttacctagggtgaggacttgggaaaaagattgcccattaggagtcctgccttgggcaaaagtggccaaacttcagctgtgctgtcacaggctgtgggctgccttggaaatgtaggacctcaactcctctgaagttgaggtggagcttgagggtacgaatccctggtggccattataatgactacactcattgggatggcatggcaagttcatcctcaaagatggatcctagcatccaccatgaccaatgaggtttttttattgttatgatcactataaactcaaggatttaaacctattaaatgtttttcaattcacagcaatgattatttttactgatcttcaaattgtcacattttggatttttagaccaatgggagccccttcatcttgacttctgagttcttttgacattcactcagctgtctgatagcttccctgctttctggaatggcaagatattccaggttcatcttgaacatttcatgcttgagatatggaatcaagctcatcatcagagggtcctggttccttttactggatagtggtattagagacctcaatttgagaactaagcaacatcattgctaaaacttcccctatgtgtaccttgttacttaggtttttcaaagaacagagctagaaaatatgttgggtttttttgttttgtttttaaagaaaaaatgtatcataggattatgctgatacttccaattcaagtgcaggcctaagcttttcacattgtctcttttctcctacccttaaagtcctgattcctaactataacaacatcattactcatttgctttatcctgcattatgtagacacaatagagtaacaacaccaatgctgccaatcaaaagtataattactgaaacccacttaagatagtcctgcaatttttttttttgttcatagagtgtacactactagggaggtgtagtcaaattactatgttttaaagacacttggaataattcatatctgtgaagttatacccccaacttatttgttttttgtattattgtttcattttgcttttgatgtttaggcatttcttttttaaaaatcaattttataattacgtgaaatacttatatggttccaaaatcaaatctactaaacaaactatattctaggaagtatagcttttatgtttcccttctatgcttttccttccttcctgtaggtaggaaagcttatttgttcctcaaagctctgggttgttcttttattttatataaataaacatgtgcatatattcttttcattacccccacagtacccaccgtcttaaacacatgtacaatatatgtgtttttctaccttgatttctttcttacttagcaatatgcccagaagttcactctgtagcgctttacatcagcatcaaaatccattatgtactatcgtttattgacctctctgttggagaaatttggattgtttctagtcatttttgttatcgcaaatagtggtttaataaaaaactttactttccgttttttgtttttcaatgtgcttttaggatagatgcctagaagtgagattgttgagtcaaagaataaatgtgttaataattttgctcaatattaccaaattctttcaaaagggttgtgcaattttgctttttaaaatcattattgtataagggcatgtatttcctgaaaatttctccagaagagtttattgccaaactttaaaaaaacagcctgatacataataaatgatatctcagcatagtttaaatttgcatttttcttgttaaatcattcatgtttttactgtagtcctcctaacatttagggagcaccaattatggggtctctagaaggttccaggattctgtaatcaatttgacatgatttctgtcttcagatattcacaatcttcaggaagatatattgacaaaagaataactacatgatctattttgtgtgcaacttagtacttacagagcattataaatgcacatggaaaaataggtaaaggagaaaatcattctctgttgggcgggctgagggggaagtcaggaaaagctacagagaggttcgagggtaaactttaatgtgggccttgaagtatgatttggagttagcaagacagacaaaggagcaaggaaaccattctagaaaaagaaaattttgaaaaatctccagaaaaggatgctttggcctatttggaaaataacattgtcttatttatgggggagatgacagtgctttgtttttagtcagtagtttatacaggactttgaatagcatgcaaggaagttggcgtctcaacctgaaaattgaggaaggtgtgacaaaggctgggcattaggtgagatcaagtatttctgtttttttttttggtaaattaggtagcaggatagattataaatgggctccacactgaggagcccagtgtgatggctgatccagcagatcagggggcagtggctgcaaagctgggagaatggcaaggtaagcctggatgcaagggatattgtcaaagacaaaatttgggggatgtgaggcttaaaagggaaataaataatggtgatggtgagatttctagcttgggcagtgggatagatagtagacgctgcgcaaattcgtttttaaatcagcagaatgagaagcatcttatttgaaatatattctaccaaatcttagcatcaaatgtgctagtgactagcaaaatatgtaaacagaagggaagtagcttgaaaagtacacaaactggagaaattgctcctgaaggactgtaagttgaacccttttaagcctaagatctgtatttcctatgagccctaggctctttccttgtgtatcctgtttcttattagagtagaggctacttaaaaataatcatagtttaaagcgctctattttcagaaaacattattcattagatgttagtaaataatgtaatctttatacattcataatatttctgcattattggagtgtaaaaagtcagtgaaatagtcatttgtaaagatgtcagtttttatctgtggaaaatagctgttcataccattttaagcttaaaagttcttcatttacttcttaaaatatccatgttggtattattttgtctaatacaagtaattaatatttaccccaaattaagcttttaagtttactaaatgttacaaacataattcaaagcactgtttagtgtccatctgtgcaggaaaaataagatcaatacaattgagcagctgttagcatgtattggtttccttatattttaagtatgttttcatgttttgaaggtgtaaagggatgacagtatgttttgttgtggttttcatcatacagataaaaacttattacagttgaaatcttggtgaacataatacattttaaaatttccattcctcacccatttatctagatatttagacacagtaaaataaataacatggatacatttttgtcatgtgatttatgttttttaaaaagtagaaataaatttctctaaaagttatttttattttttaaatttagcatttttcatatttgaggaaaaaacaatatgtcttggtaccctagcttctgaactaataacacacctgtcattttacaggttattttaatgtttttcattgggatcaaacctactctggaaatatctcatgggtgagctttatttttatgaaatgttcttggcacttgaagacctttgtaggtacatgccagactcatcttacatccagttcttctgcatggaaaatatgtgcattgaaattctaagtgccttttcaaatttgaccttcttagagaataatatgagtcccaacaattaggaaaactatggaatgccttttggcctttacttttcaaagattttcagtcagtaatgtttaattagcattcattgtgtacattgtccttttttgtgtgatatggctagttccaaaggaatattctagaagatctcagccttctgctattgaaggtgataatacactactaagttatgtgttgctttacattaaaataatgttgcagcagttacttattgcttaactagcgggtataggacatcaggttgaaataactgattttgaagtgaagagttcttgtttatatcttaaactaaccaagtatgttcattaactttgagaataacaatgatctttttcattattcttgagtagactggataaatcagaaaacccatgttagaggtccctgtaaaaacttcagtcttatttggtaagtccctttataagagtttcaataaaatcaggtaaatttaaactctgaaaattctacgtactgtctatcatgttcaatttactgttaaccagtactatgcactggaaaaaatttttttcaccttaatgagaccactggtcattactgctgctactgatgctcttttgtctgcacatactgttgcaacataatgtgttgtgcatttgatacggatattatcatattgccataaggagctgctattattttagacaccaactgattccatgatagtgtcagatttctttaacatatgcttatgtttttgtacaaatgaccccaagaaacatctgctagttttgtggtggtatctactgtttcttttttagaatttgacctgtcagtcactttttaacgtgaatctacaatatttgagttgtattcctttctcgtttttatgctattgatattaacaaaattgagtcagttttatggcataattcagagagaaaccgaagctgtctatggatgttattttaaaaatacctttttcatgatgattgtgcctttaaatttttgtcattgattgacactttaaaattgaaaagtgcccttttaatggatcctttaggttccaaaatcttaagttgaaaatttctgtctattggtcctgaaagtactctctgaatttgataagtatgtagtagttgtggtgtatccttggtcagtttatatcctgtgctaattgctaatcttacttagtttctttgatgcgtgtgtgaagacaggcaaagaaaaaggaagtggaatttctacaaaactgtgaaatctttactttatggagactagagaaatttctaagtaaaagaagacactcattctattgtagttaggatcccttcttttacttgcttttcatgatcttgactgaaaagcaacaattgagatttccattgcccgacgctttctcttctgcttttctttttgtttctcttgcatttttaaagacagctatttattcaaaaacaatatgaacttttatttattggacttaaacctggaacatcaacaaaacaaagaacaaacaaaactacctttccaaatttattttattagaggatgctatcaatacaattttgtattatgttcacacttgataccaaacctaaacccaagaaagtgtgtcctgtgttacagcctatccctctgtttaagataataactagaacaatttacttttattttctactcatctgctttctgtgtatcagctgttgtcctccctcagcctcgaagcatgtcatcatttccatctccgtgctcattcagtcatccttgctgctcttagtcccctttttgtcccttgggtgacttatgtcattaggacaaccttctgtccccacttggctgaaactgagctgaggcccttgccagttgcattaggtgtggcacctttcatggctcagtttgggcctctgtgatatctgtgtgccttctactccaaactccattctgccagaggtggcagggtgactggaagctttagtttcagtgacaaaacccaagcgtggctatgctgagtgtctaagtagctttcatttaggcctgaaataggagagtcaggcgcctctgtgtcccctgagaaagagagatttccctcagctctctgggcccagcactcaaccatttaagtcagctggttagtataatttccctaaattgtggtttagtttccctatgagtaggactggagtaggaccaagtaaggaaagtccctagtgacctttctgcctcctgaggagcaggccatttactttgagttgtagcttcccatctgtctgtccccactaccctatccaaggccctggaggagccacaggatgagggaggagattcatggaaaagcgccttcaggtactgggtatgtctggagtaacatttaaagtttaaaagactctttaacaattttcctctgatacttactactgcctatacttgtttggttttagtacagtaagttttgcctatcgtgggggtgaagaaaatagaaatattcccattaactttgtatggtgcttggtatgacaccctgaacaggtgcacccgtaattgtttacttgatgttctttttaataagtcaattatatcatcggaaattgaagaatagcaaagttaatttgtttaatcattctatgggaactcttgcatgctcgttcactagaggaacattgcgtttctcccttaaaggacaaggctttgttttgtttttaataagacacactctttataattaaaacaaaatcccagtgttaagggatttctgttttaaataattggatttctttcctttgttcctctaatccctctatatgagaaaaaaatctaatggtgtcttaggataaatatttttagattaaaaagttctcttaaccactgaaatttaataatacttctcaaagtttatggatgatatagaatgtaatgtaaggttgagaattttagatttggcaaaggcaaagatacaaaaactagtgaaaaacaacaaactggaaacacttttaaaatactgatgtatttatctttgcaataaattattcagaaatataaataaactcactatttacatagttttatttaaatttgtcctcaaaatactaaatttagtactatatattttcttctttcagataaatgctttcctgaaaatggtattttaatatctacagatggtttagtttaacaatggttggggtaaaaatgacatagggaaaagcaaaatgtgacagcccagcttggttacctttagagaaactcagaataaactctattcccatttccttctctttcccctttccatactcgagagcccttttctgagactcttaagtcatgtttgggccttggagaggataaatagcagggtgggtggtaaaaggggagagtgctttgcttgaggcaaagttttcctccatatgggaccttcctcaagccctcccttcaaaccctttaaatgagagcatgagctcctaggacagaggtcatgtggaaagcagcattagcatgaaggggggtgctgtggaggggtgtaaggtgcaaaaagcagcattagcatgggggaaggtggggtggaggggtgtaaagggaatgagatgtgaagtggttaaagggccatttttctagttggcctctgggctttgatgaaccttttccagtgtgcctgtttctccacttagccctgggctaatcttgactcttaactttccaggtgtgtatctatgctgatttctcctgggtttggaagctctgagaagctctggttctagttcaatcacaagacttttaaagaaccagaaaaataaaacaattttttaaaaagtaatgaagaaaagacttttaaagaaccagtgaaaacctgggagtaaaaatatagaagacttgagaaatttcatctttacctttcaagtgggcagcatgagaaattcttgtaaatggtgctttcaaatcttacacaaggttctcagttacctttatttgtactccctagactgtattgcatcccttgctatgttgactaattcccacctaaaataattcaatggcctcccaatataatctggcattctaattaataagctaagaaattatttggtttttcactcattggcgttaaatattcttcagtgcccacatttggaaatattggaacacagaaatgaaaaaagatacaatcagtttctctgcttgccatgttttccttgatatggcaatacgacaacaggtcaccctttgaagaaaattcagagatgctaaagtagaaattaaaactgaagataagtcaaggcaggatagtataggagtctgctacagctgccatagcaaaatactacagcctgggaggcttgaacagaaatttatcttctcacagttcttgaggctagaagtccaaaatcaaggtgccattggggttggtttctgaagagggttctcttcctggctttcaggtggccaccttcatacagcatcctcacgtggccttttctttttgcctgcatggatagagatctctggtgtcttccttgtaagaacaccagtcctattggattaggaccctatgctatgacctcatttaacctaattaccctatttaaggccctgtctctaaatacagtcacactgggggttagggcttaaacatattttaggggaacacaagtcagtccataacacgtgatttgctatagttttcctttacctaaatcttttccaaccttgagagtggattttggccaggtgtggtggctcacacctgtaatcccagcactttgggaggccagggaaggtagattgcttaagcccagaagttcaagatcagcctgggaaacatggcaaaaccccgactctgggggggcagggggagtgggggaattagctgggcttggtggcgttcacctctagtcccacctactcaagagggtgaggctgaggctggaggattgctacagcccaggaggcagaggtcacagtgagcagagatcacaccacttcacttcagccctgggttacagagtgagaacttgtctcaaagaaaaaaaaaagtgggttttattcttccccttaaattcctattaatagtgaggtgaggcttcttgtgttttttttttttttttccaagacaatggttaatgtgtgattacttaaaaatgatatataacactaagaaataaagaattgttaagtgagaaggaacatattaaaatggcttggaaagatgggtaattttttacattttaagtaggttttctcaactctaactctgtggaacttggtcaatctaatcagtctaaatatagcacaaataataatagttatatggacaggagaaatagtagccctcaaagatagtgaaatacatctgaatatcactaacaatgtcatgaatttgcttgttctaaagttttctgaaagtatgaattcataactgagtttttttttttttgcctatgactactaatgtttgaggagagagtagtgtcagaaccacccccccatttattacatgtttatttcatattttggtactgaaatcagtgtttattttgtgtcttcctgataaatcttgccaataagtaattaccttccatactgaaaagttcttaggattaccaggttgctgggggcaaccttaaaaggccatgcagaacattgacttaggtggctattaccctgctttattcaggtctgagcatttactttcctactacaatcagaatactgacctacatttaaaagtgcaacactgccctgttatctaaatccactgtgttcctgagaggaaataccagaaaagagggcaccaatattatttttctgctgttcttgatcataagtgattacctttttttttggttaggcattctgcttctgaaagataactgaggttgaagttaatagaactaagattcttatataaaatcataggaaagataattttcaggattattgaatcatattgaaaaatgatataattgtgttaaaagataaggactaaaatgagttaattcaatttggaaatagttaaattagaatttgcttctgtttttgatgaatactgctttttgaaaaatcttctgagtatttaagcttttactactctagtcattctctctaaagtagacatagaagcgtgttcttatcttgatttggtaaggctctgaaaatgcaaagcaacagatgttgtacccagcataattatatgtatcctggaaacacatctttattgagtgggatttgttcttggggaaacaaaaatttggcaaacaaaggacattaacttgctgatctcagcagtaattacttgggttagattataataatcttgtgtaggtggtaactgcatgcatatattacaaaatctaattctaaaatacgtacattaaaaggaaaatgaacttgcgcaaactttagatcatgtatccccttgaagagcagaaaagatctcaatttcattatttgaaagttgtttgaacagctttttggaagaggtttccaggattccaaatcctaatatgtgtattgatactgaggctttggactaatctttgggggttactgccttttttatgcccactgaaaatagagcatttcaaacaaatgaactgatctctgatctttaagcatgccagtaactctttggaacaaatccatagttatttttaccaatgactgtattaaaacagtactttctgtattatctcttccattccaaggccattttaaaacaccctctttctcttctcccaataggtaaagtacgacagagctccttaggactgggttatggagaattatctggaggtcaatttgagaaccactgtgcaaaccatttcttaaataagtagctacaaggttgtccttacaaaaatttctgaagttgatggtgttgcgttttggagtctgaagcttaaataagagtttgtcagtggtcatggtctaaatagctgattactaccaaggtcatctaatttttttttaacacaaaaaaatgttctgagcacaaatgaaaccttcaggacaagacatttatgttttgagaatgttcttaaatgattcctgtcgtgtatcttattttacatatcttaatgatcagcatgtattttttgttgttgatgatgattttataaatgtgctatcacctagtttctaattcctaacagctccttcatcagtagaatattgctgtagcacagttttgccatctgttaagaaaagatggtgactaataagagtggcacatttcagggctggtgtgctatcgcaacatctagtgttttagtactgaggacagtgatgtatgcagtgttccttacagccatggggtgtgggaatgttttcctcttcggcaaagtctgtgtatttctatagctgaactctcaggatccagaggaaaaccacaagatgatgaaaccagatgattgtcatcaaatttctattccccactacatgattattagttttcgtcaaaagaaatactcatcctatcctgggttggaattggtaaagaattttgcattgtgactaggacacctaaaagtttttaggatgagtacaaatggaatttgatagatttccccaaaatgtttgggaaaagatttattcctccctaggaacagcaagagtagcagcatcacatgaggcaactcctggtaattttttcttcttgctcttatttcaatgatatcttttcattcttttctgtatctctcaatttctatgtttctcctcttaatgtatcctgtaaatttcttagtagaacctttttactaatgagggtttcctagtttgctttaggaggcactcaggatgcccccttttgtaaggcagtaaattgaaaataagaacttggtgaaggtccacgtgacggttagtttccattctccattgtaccaaactgctacagggaaagaaccatatttaatcaacctcaaatcctcaatatttaggtcagaaaacacttggcatagaagagacactcaaattttgcagctaaatagattattgatagaaaatatgtttcttgcctctacaagcaatatgaaaccaatacaatctctaaatatcttcagactactaggggcaaatactgtattataagaataattcttcagaaaggaaaatccagctactctcatatcacctctctatgttgaaagctagggaagataaactggcttccagccagtgagagtccatgtggacctagtgctggctggagatccctaatccaaaggcaagagccagatactggttgtctgctgaaaatcagaagatgacctctctggtagtaaggccagtgactcatccctgcatcttttatcctcttctgatttgtataaggatctctcctttttccccagtacccactctcaagaattgctttcctttttaacatgatcataccaaaatgtatctaacagtaccttgatttcctttctgaggaatttagggagcatatttactttgtcagactcattagaggtttggcttcttggtcgggttcttaaatggacaacttgtttgggtgatttggcagagaataggagaagccagtcccctctgatagagcaaacctggggagctgtggttgacccacctgctaactgtcctgtacaattaggcatgtggcatcagtgggtgactgaccagagccaccatctcaatggcggctgttctttccttcctgtgccttctcagatctcttttttgttcttgttactccactatattggtttttcttgagtttttttcaagcaaatatcattattcacttctactgcagttcctctgttgttcgctttttctcttagtcttcattgttttccattttgaacattcagagatccatcaaaaaaagtaaaataacaggaagggagaggtaaacaccagtcaaatgaagtattataatagtgtattactatactctttaaagtaattgaagggtggttttttggggtcagaatatctgttagaatttggaatttgccactcttgagactggggcaagctatttaaactctaagcttatctgtccttcctcacaatctgtaaaatgggatcataataatggcacccagtttatggtgtagtgagcattcactgacacaattaatctaaacttatttgcactacatagaacagaatttttgtctattaaacaatatagcgttttaggcatgaaagaaactttagattaaattaaatatcatttttcttaccacagggtaagtttctgttttgtttgcccctgtttctctaactcctagaatagtttccagcacatagagattaaacaaatattcgttgaatgaatgaatgcatctattctaatcctcttgttttaggaatgacccgtcaggctcaaaagtgaaagcatttccctcaagattggtgacagagttggggactaaatctaaggctttctcttcctacaccagtgtcctttctgagaacacgatgccattttctcaatatttgtttatttatatggtaaattggtaggaagctgtgtggtactataagaggataaactttgataatgaggtatacttgctatcaaattctaacattctcatttaaaacatggcataccatttgtcttctacattttcatatgtaaagtgaggtgatttctaccttatagaactattgtgaggattaactgaactaatctttgtagagcacctggtcccatttattttttttttttgctcaccccaccccccaactttctagctagataacttatacattcactctgtttttcattccttcttgaatctcctgtggccagacttgacccctgtcactctacagcttactcgtcaaggtcagtcctcatctgacttgacctactaagagtctgacaagtagtcacactatgctccttgatacagctttcttcacctaccttcttggatgtcattcttttggttctcctcctaccccattgggctgctttttcccagtctccattcttgggtattctcattttcccatgtctgtcctctgacttcttattgtctctgtttctgttttctctggttggaccttctctagtttctggcttcaaatactatctaaatgctcatgtctttcaaatttgtaactctagtctagacctctcctctgaattccagttttataaatcttctacttaaatattagaggtctaataaacttctcaaacttatgttctacaacaaactccacattttctcctgcagcctctaaatatgtacctcctatagattttcccatttcagtaagtgggaacttcattattctgattgtccaaaccaaaaacacttggagacttgctacattccaccctttgtctttcattctacatccaacctatcaacaaatcctgttgcctcttccttggaaatatatccacgcttgagcagcatcattgtcaccacttggtgttatacactctcatttctcacctggagtattgtatttctcatctggagtagtgtctgtccaacgatgtcccccatcagtctgttctccatgtagcaatttcgtttttgtttgttttaagattgggtcttactttcgccttggctggaatgcactggtgatcatagctcgctgtagcctttaattcctgggctcaagtgatcctcctgccttagcttctccagtagctaggactacaggcacacaaccacacttgactaatttttttttttttttaacttttactagagatggggtctccctttgctgcccagtctagtcttgaactcctggcctgaagtaatccttctgtgccagcctcccaaagtgttgggattataggcatgagccaccatgtctggcccagatgttaattttaaagtgtacattagagcacatcgttcttctgcatgttcagcataaaatccaatgtccttaatgtagtctatattaccctacatgggctacttgtgcctgatccctctactcttatgtcttatccctctcctgctttctcactagcaccagccacatcttaccgttccttgaacacaccaagtatgcatttgccacaggaccttgatgcttactgttccctttgcccagaaacccttggaaccagctatgtgttaaaattcagatatttactgattttagagagctaaaatggggtatatataatatattacataacactcacagctggtttgtggtagcatttcataattaaataatatttctgaatgaaacattaagaatgcccatgctaagagggatgagtaaagactcaactctcattgtcagttcagctgcagaatgaggtcagctcaagatttgctgccaaatgacttaagaaaaaaatgtttttggagctttggggatttcagaattgcagatgagagattctagacccgtacctacacagcatgctcccttattttgttccaatctttgttcaacgattatttattgggtagtcaaggaagatctctgtctaaaaggcttctctgtgtggaacaagactggcatgtggaaggtttccaattaacgatattgaaagagtgaagctcaaatcatttttcactcaaatacatactatttagaagacagtggccagtttaagaataatcattattggaaacaaagtactatttgattagggatagttaacacaaacacttattagtattagggatatgtgaaatacttaatggatgagtcatgtgctgacataaaacccattatccattttagttcctggtagcctaactggttgaactctgttttattgatctattattgatttggcctgtaacttcaagttacattttaatgtaatttcatccttttctgatcaccttgtgtcttcaagcatttttaagcagttgatagatagttgaaagatattatcactatttcaatctaaaagatattatcactattttaatctacttaaaatttttactacattcattttaagtatgacttatggaacgaatcgaaaatacaagatagtgaaaaacttgtgaggatcacctgaaattttagcattcactttccttacatagaggaacttagtctctctaaagaattatgagtaataaagtatcataatgatatttgtcttagttttggttaagtgtactccacaggagaaagttaggcatgagcaggaattattgtagtcccacattctcaaacagttctccagtaagaaagattttatgtgtttccagaaatcattttcctcctcttcagagctttgggaccataattgtatttaaattgctaatctgttttaaggaatcataataaattgtttaacatttatattcaatcaactttgtaatttgtataaatttttcagggtgacatttgaacaatttttaagaaaatgggaaatacagaagtattcttagttttaatatattttaaaaagatgacatgtgatctactgactgaaatccttcaatcatttttgtttttctccccaagattagatagaatggatgtgattttatttttaatttgcattatggagagtacttttggggggttttatgaaaaagacttcatttattttgttagtggtacttcagttgcataagaaaatgttcttttaaatatagtggtcatttgtgtgcagccttcaagttagcaaacatgcctttgagtagtcactatttttgaaggtctttatatctgattgcaatggcttatattcaatagtcctcctactaaatgaaataaaaatggatgcctcttctgccacagaggcacaggtggacatgttggtagcaagccccatgcggtgtgacacatggcacagcccaacatgggggcaaagagcatgcggcttgagctaggagtcactttatggctactttagtgtagatttgtgtttttctgtggaacagccattattgaagacatttatatagtatgatgtttgtttttcattaaatgctgattgtgatttcttaaaaatagttaagacttgattagcagaacctatttagaagccagagttcccctgcttcacctcttgctatctatataaatgatatttttgactctgtcctttataatgttggcaccctgtgcatattagatgtaatcagggctgaaaggaaacttgaatccatctggaagcaataaacttttctaaaagactgcacagtgttatttaatcctgtgacttcttactgtgagtgaaattaaggtttgatgcagttgtgtcacatcgtattgatatcaaatttatctttctaaaaaaaaactgacagtattacagcacagaggagaagatggcttgctgtaatcctgtaagctattttacattgattacatgctacataatgtacctaagtatataaaatacttgatctagaatgtttatgttttctccaaaattttctcatcaggtaatactttctcaacttcacctttagttttggcttcttatcatagtactaactatgcggtagtaattgtgttatgatgaaaggcatggagaagaaattataattttaaaactattataaagtggagacacacttgtataattaccatctatgtagactgccaaggtataaacatttagcttattttagtatcagactctttgaatcaatttaaggctttttcaataaaattggcttcctctaatttstactccaaaatggttaaaattttgttttacttcaaatacgttgtagggtatcatatttcatgtgactaggagcctaaactatatcagctgactggcataatttgtgaattatatgtgtgtttattaaaatttaaagtttttattaagacttacaattttattaagacttaatttttttccttacattttgagtaagtccaactgaaaataacttagagacttaggaaatttgactacattttataagtaatttccttgtaatttttctttcttgtggaaacaattcttactgatttacttaactcttttttcaatggcaaaaatgaaaaccaaatatatttgtcaactatattcttttaattgtggaaatgaaaggttcatatcccccatttgcctagcatattaaaaataaacatgacctttgtcttgaatgttgttaacttggattttaaaaatcaaaccaattataagctatattaaaattgcttatcaccttccctttgtcttcagtaagtctgggcctaaaaatactcatcatatgaataaataaagttttacaaatactttttagaacatcttgaattatatgtgtgtttgaagcttacttttggatgttcggtcaacaaggcttctgacagtttctttttatcttccctctattccctgccactgtgcaccccaaagtgatccctgaccacagtggtcccattgctggcatcaggaaggtagactgaggagttcaggtatcctagaggctgttaggtgaatctcttctacctctttcctggtcctaggaccactggacacttcaagtaaaaataacaattactttaatctctcaggtaaagtttcttctcccttccagcaacacagatctgcctgtgccgagttcaaatactctgaactttcaacagttgttctgaatacttttttgtcatcttatgatcaaatattgagagcattgaggggataactgaatgggcatggtataaaagtcagacttttagtgtttctaagtagcagaaccctttggacaatttagagggctgtgcgatatcctcaccgtgactgctgggaagtaatgggatctgacctgcagaggtactaccttggctgacaataatgacaaaagtgagagcaaagtacatatgactatccttgaggtcctcaggaaaaaaagagtattagtgagttgaactgtatgtaagggtctttaccaataaggaagcccatgcccagacataatccttacaccctggcaatagaaaccatcattgtggtttacatctcatcctgttcctacagtccagcaagttcaggccacaaaaggtttaagcactttttcctttgttctcatagcaacagttgcccatggaggttcagttacactaatattaacattttaatatacacaaagaagtgcctcgaatgtagtaggtattcaaacttgttaaatgaaagaagtaaactttcagacttaccttgaactactacagttttattctttctctaacctctcccactactaccatcttaaaaccaccatttaattagtattttataacaagttattaaaggctttcaaagacctttgaaccttcaccctctggtaagttaataacttctgatatgcgattaaatgtcaactgagtagtagtgggccctaagagctcagagggactgagaaatgaaggttattgtttagaagagtggctcaatgtgcttcgacagttggttaatatttgaaaagactagagtcaagaaagccttccatgtgctaggaaatgaaggagcaaaggtccagaggtggaaatgtatacagtgtgattaagggattttctgattgatagtaaatacagtcaataaaaaacttttattggaagcctagcctgtgtttgaagcattaagctaggtgctgggatacagagattagagatgaagataatgatgaagatattgttgaagtgaattgctgagaagctggagaaagggccaattaccataatctgaggctcaggaggaattggtgcaaagatcatctggtatgatatatatgaactgtatatacaaactgatctgtgtagctgaactgataatgccaaaaaaaaaaagactaggtttttgattaagatgaatccattaaggtcatgttttctgttggtgccattcttggagacctcccccaaccctatacatttataaatgtttttcctgagggactgagatggaagtggacatataaaaggaaaggtctgggcaaatacataagtaggtagtaaaatcaaggaacaaatgatctcaacaaaattgcccttcttgaaatgaatgaaaatgatgaaagccaatcacattgcatgatgaacttggggtatagaatatgaaatatttaaaattgctttatttcatgatgtttcagatgtagtaggaacttgttgcatagatggtgtaaaaacaatctagtaataaaatcttaggtatttaatacaaggtgaagaaagatgcaatgcataaatcatgccattttaggcttaattttcataaggctatgcctgtctttataagactatataccaggagttctcaagctttttggtcttggaacccttttatactcttaaatcgttgaaaaccacaaagaccatttatttaagttataaccattgatatttgttgtattagaaattaaatagacattaaaaatatttactatttaaaaataaccaaaaagatgggcatggtggcccacacctgtaatctcaacactatgcgaggccgaggcgggtggatcacttgaggtcaggagttcgagaccagccaacatggtgaaaccctgtctctactaaaatacaaaaattagccaggtgtggtggtgggcgcctgtaatcccagctactcaggaggctgaggcacgagaatcacttgaacccagggagatggaggttgccgtgagccgagattgcgccactggactctagcctgggcaacagagtgagactctgtctcaaaaaaataaaaaaaataaaaataaaaataacagtaagttcattgcatattaacataaataacatatttgtattaaaaataactattttccaaaacaatcaaaaaagcagtaccactcttctattttaaattttttcaaatctcccttttctaaaaaaaaaaaaaaaatattgtgtaagtttaaggggtacaagtgcaattttgttgcacggatatattgcttagtggtgaagtctgagaatttagtgtatcttcacccaaataacatacgttgcacccattaaataatttttcaacacccacccccttctcactctcttgagtctcctttgtctatcattccacactctgttcctatgtacacattatttagtacccacttaaagtgagaacatgtggtatttgactttctgagttttttcaactctggcttaatagaagacagctgaaatctcagaatgcttcttcatccagtctgttgtgaatatgttgctttgattcaagtatctaaggaaaatacagttttacacagatgtgcagctgaaaaggaaacatcttttaatatgttcagataattgtggatattgtcctttgatactatagcaaaacttatcaagtgctaatttcttaaaggctggttataatttgaaatctgaaaacatatctatttaattgtagtttgctatttgaaaatttattggtctgtcttgtactttgaatggatattttgcccacgtatgattttataacatcctgtattggccttttggaaaatttggtttactattatacagtttctaaatgttgataatttttattataatatattttaaaaagtctaatgtcactgccagtctcatcagaaaattctttgagattagaaagctgttaagatcatcatcacacttacaagttttacaaaattttaattttactcaaaactttatattttatcattgacaaagctctcagttgctttgcttagtgactgactcactttgttcattttccagaaagtgtttaccaaatgctgctgcctcaataccagagtctgtattgtcagttgatctttcaagtaaaaagtggtgttctatgaaaaacagctagttcagctgcgactgaaatgatataagtgtttctcctggagcaaaccaccacttcgatttgtagcagaaatgctgtatgtatactttccattgttattactcataacatttttaaaaatatactcaagggtggagatttttttaaaaataagtgttattgcttcatcaagaacagttaaatgaaactggattttttaaactgagtttgagttaatgaagaatgcagcaattattagtaaaatttggtgctccaccttgattcatactgacactccaggagttttacccactatttcttttgtacctttagtgcaaatgttaatatggtaggaatggtaaatgacatctttagtattattataaaaatcgtttttaccctgtatactctttgagactacacattgagaattgctgatgaaggtgttttaatttatcataagcactgaaaagatttacttaattcaccaatttctcctgaatatttgtttatataaaacaagactatgtgtatacacctacctttttattaatggtagagatctaggaaaattaatttctaagaactagccaggatatttggaatgtgaataaatcatatatccagaaaaaagctttagaagattgtctatgattgaaagtcaaacagctctcatttctattatactgttctttttcaaagaatttaccaattttatgtggtatttatgattaaacatacaccatgtaatttaacatttttaatgtcacttttacatcataggtattaaagattagcatttttattgtctgtattttaaagctcaaagaataacatttaggctgggtgcggtggctcacacctgtaatcccaacactttgggaggccgaggcaggcggatcacgaggtcaggagattgagaccgtcctggctaacacagtgaaacaccgtctctactaaaaatacaaaaattagccgggcatggtggcgagcgcctgtggtcctagctacttgggaggctgaagcaagagaatggtgtgaacctgggaggcggagcttgcagtgagccaagatcgcaccactgcacttcagcctgggtgacagagtgagactctgtcttaaaaaaaaaaaaaaaaaaaaaaaaatttagatttttgactgtttcattgattcatcttagacttcacatgaaaatatctgtatatcctcaaatgcttacattcttaagaagtatctcagccatttacacatgatagaaacaactaaatggaaaaaaattgcagttggaaattcactattttttatttgatccgataacaatgtgacatttgcgattggactgtaattttctgtctttctctctgaaaataagttcaaaaatttccctctaattcttttactagataagaagcctacttcgttgtaactcttgatatatgtatgtatttaggaacttaagcttttctgctaataaatgttatgtcataattcttgaggatagtattatattgtgatgggttttcagtaaactacaggagcagccctatttgtttaaaccctagtttaacctgattattaacaattaaattgtgttttcttctaacaattaaagtgtgtttaaatttattggtcccttgcttcacagatttatctcagtatgtggtgtattcaaacagaattttgtatttttaattaggggattagataaccaattctgaagagccaaaaaaattgttagacatcacattgcttaaccatctaatataccataagtgtgtgtatacactatgttgtgggagccatctatcaggcaggcctgtttttcaggcagtattttaaaaagtggacatgtgcagaaactgtgagcacaattagcgccaagcagataaatccagctctaatcctgtttacggtctacatcagacagatgtgccaagattgatttagacaagcccgaggcttacagtaatatttttaaaagtgccattcgctgttctatttttgttaaacctttgctaaatattcttaagtcttgttggttttgctcttcttattaaccaccgtaagtaacctactttaagcaggtcccgctttgctctcatggtgacaaggtaacctgccaggagaggttatctttattccctgtaattaagttgacttttccccccaaaaaaatacaacaataggaagtgggtgctgaattaaataaatagcatgatacccagtagatgtatacttaagttccttgcaagaacagatggtccccagtatctctgtaagtaatgtgagaggacagttaatgttctgaaacaactagctataaccagtatgatactaatgaaccagtagatttcaaataataaaccacatgccgccaagcaaaattatatgtcattcataaggatttaattatcataacttgcaaaaaagtgtcaatagatgatttctatatttttatctactgatatcaaatatcaatttatgaatagagtttcacttcatattttttaccaataaaggtatgttttaacattaaggtagaattaaagttatatttaaaatacatgccccaaagtatgtggtgatttttttttaactcctcttttactatactgtctgtatgtattgggctgtatatggaaatgtagcttttacatacaattaggaaaacaattgcttttatttctagcagaaacttgtactataacagaagtggctagcatgggaatcagagtagttatcttgtagatgacaactgaagcagacataaaagatgtaatattttttcagcactcaaaaatttataagtaaaattttataaacaaaaagcagtatttttgtgattcatatggaaaataaaatgagtctgagtcattcttaaggtgataccgtaaaggtgtatagataagaagtccatttttaaatatacccaagacaacagttttttctctcagtatggtttgttttcccttttttctctttaattatgtttcccataagtatttgtatattctaagaatgtccaaaaaataaatgttttgcagtgggggttgaaaagaaagaaagacctttttagatttcagctgatcttatcagatgatctctagaaccttgaaccttcaaccttcactgaagttagctggagggcttttcacctggaaacctgagaaacctcagaagccttctgctttagctctctctcaagtctaggaagccagtggcctgcgaccccacagagccagctggtccactcctcatataagaacttcggtaacaatacaaagacatagcaaagcaccatctaatctgataactcattaaacaatatttagatggctcaagactttaaataaaaacattttaagcttgtttatagaatactaacaagttttattcccaaagactatattcagagtgagaaaacaattttccttaaaactaatattatatacatgttcatatatgttaggaactagttatatgcaaaatcaagtgactcttgtgattagaactggtcacatttattcatgtagcataaatggttaatattgccaaaatgagtaatagatcagattttctatgtgagatattgacacctgagagatttacagtgtttcactgttgtgaaaaatggagtgctgaagaacatttgtctattgttatacatttgtaaaagaattcacaaattactaatttcaaataagaactaaatatttcttctaagcctatagtttttctttttaatttcttctaagcctacagtttttctttttaatttcttcttgtaacattggcaaaaagaccattcgtgtgaaaacctcagattttgatctgtacacaaatgcaggagtagagattggaagcttgagctggaaaagcaggaaatactgctcagagccttacaaggattttcagaattttcactgttgggtcctcctggttgctgcagtctaacctcgcatctccttgaaggcagccccagtttctgatgaaatactcttcagttaatttatacatatgctgtcttgctgttttcctaaggactgcaggcagaactgtggttcacctactgttttaaatttggctagatttaaaaacagatgatctcacttatatgtggaatccaaaaaagtcaaacttatagaagcagagagtacaattgcggttgtcaagagctgggggaggggaagcaaggggatgatggttaaaggtataaaatttcagttagacagaatgaataagttctggatctattgtatagcattgtgactatggctaataatgtatacttgaaaattgctaatacctgaaaatcactaagagactacgtcttaaatgttcttacaacacaccaaaaaaaggtgtgaggtaatgaatatgttacttagcttgattttaatcatttcacattgtaaacgtgtatggtactgatcttgtacctcatttcattttccatatgaatcagaaaaatactgctttttctttataatatcttatacagcatagatacaatttttagtggtcaattatattgtaatatatacataaatatatatgattttcattggtcaattatactgtaataaaacagcaaaaaataaagttgtaattaaaaaataatttggaagaaaaaattagcaagtggttggagattgaggaagatgggaccaataagtcctccaaggagagtcatacattagttttttttaaaagtccattattaatcttataatatttaatatgtttaatttcttgacacttattaatccaattaagtatgagaacactgtggataaatctaaaaaccttaaagttgagtaaaataaaccagatacaaagaagcacatactttatggttacatttatatgaagttctagaaaaggcaaaacttagctatagtaaaaaaatcatggtcctgagggaataactagagagtggtatgagggagctttctataatagtgggaaaattctgtatctttattgggatagtggttatgtgagtgcatatacttaaaaaaactcatggaattatgcccttacaaatctgtaatttttgttggtaatttataccttaataaaaaacaaaacagatgacagggttagtgattgtttccttgaagaaggtctttacatgggtctgttgttaacgagttgtagtaaaaatcatccaaaatgcttggattcaaatcttagatctgttcctaccagatgtgtgaccacagacaagttacttacattccgtcttcagtttcttctcttttaggaaaaagcatctagtttttgttgtagagattaaattagataatacaaatgaagtacagagaacagcgtttggtgtgtaacacatgttcattattagctacccttattttttagagaatggaaatttttaaatttaaactaatcaaactattttaggataagcaagtgaaacaatctttttttcaatcgatcacagaaatattttcactgaagacaaattagacatttatataagcaaactacagtgtcattaccattcaaattttcatatgcatattcatgcttacatgcatatgaaagcattacacatatgtattctataaatatatacaaaacagtaatggaaatgtgctgtactattttgaacatctttctagtcagcccggcattttatttacttttgagacagggtctcactctgttgcccaggcttgagtgcagtagtgtgatctcagctcactggaggctggaggtcctgggctaaaggaatcctcctacctcagcctcctgagtagctgggaccacaggaaagcaccaccatgcccagcttatttggtttattttgtttgtttgtttattttttatttttttgtagagatgaggtctcactatgttgcccaggctggtctcaaactcctgggctcaagttatcctcctgcctcagcctcccaaaacactgcaatcacaggcattagccactacactgacctctacattttaatagctgagtagccttctgttatatgaatatacttttttttaacaaaaccaatactccattattgtacatttaggttgtttccaagtttcactcaaataatgcttgggtaagtaagtatttttatttattattattatttttttgagatggagtttcactctgttgcccaggctgaagtgcaatggtgtgatcttggctcactgcaacctccgcctcctgggttcaagcgattctcctgcctccacctcctgagtagctggggttacaggtgcacaccatcatgcctggctcatttttgtatttttagtagagatgggatttcagcatgttggtcaggctggtctcaaactcctgaccctgtgatccgcccacctcagcctcccaaagtgctgggattacaggccgtgagccaccacgtctggcctggataagtattattttagctaaattgtgcatatttattcccttagagtaaattcctggaagtaaattgctggatcaaaaccaggtatattttaaagaattttccttttctacattaaaaataattataattctgattacaagaaaggaaaattatggagcttcataagaaaaaattagtctcatatttcatacctcatattgcatatttaataggtaaccagtgttaaatttgttgtgtgttttccactgggatttctttttatctcctttaataaaagcaggatcagatccctcagattactttgtaacttgcttttattctactttttcatacctcttagcatgaatgtctttccagaccagaatacagagatttcacttactcatttatgagctgcagaagatgactatgatttattcaaccattctcctattgaagagcatgaatattgcttcagatacttttgttattataaatattagtgcaattaacattttaaagtcttttgatacatattcccaacttgttctccagcaattaccatttttgcattcccaccagcactggggctacttccctttagttgcaccatcatttagcattatttttgatcttgtgccaatctaaaaggcaaaaagtggtatcttgttgttttaatttgcatttctttgattactaattagattgaactttttcatttgttcattggtcaatttgcatttcttcttttgtgaaatgcctgcttgggtcttttatgtactttaccattaaagtgtttttcttgattaaatagattatgtaactgtcatatgttgcaaatatttctgtccatttggcctttgcttatgactttttatgagtctttaggacttttgaggtctttattaggtattcaataattttaatgttaaatatattgatgtctgtcttcctttgtgtcttacggcttttctatttaaggttacgtaaatttctaatatacaaatattggtgtatattatgaaatagggccctatttttctttacaaaagattagtcagttctaaatcatcctttgctatttctagcggcgcttagatgccaccattatcacatcagtgaatttttaaatgtgtaattgtttcctgatctattcatttctctattcctagatacttctattgtaatagctttaccaaatatatctgatagggtgtgtactccccctcattacttcatttatttatttatttatttagagacagagtttcagtcacccaggctggagtgcagtggcatgaacttggctcactgcaacctccgcctcctgggttcaagggattctcctgcctcaacctcttgagtagctgggattacaggtgtgtgccactacacctggcaaatttttttttttttttttttttttagtagagacagggtttcaccatggtggccaggctggtctcgaacttctgatctcaggtgatctgcccttctcggcctcccaaagtgctgggattacaggtgtgagccactgtgcctggccccctcattgcttttaaaacattttcttactgtaatatatttattccaagagaattttcaaatattttatgagattccttgtccattccttacatcaaaaaataccacggagattttgattgaagttctattataagtagttacttggggtggggggaggggggagggatagcattgggagatatacctaatgctagatgacgagttagtgggtgcagcacaccagcgtggcacatgtatacatatgtaactcagctgcacaatgtgcacatgtaccctgaaacttaaagtataataataaaagaaaataaagagaatactggcatggaaaatatgtaatcttggaacttgttgtatctccacttattcaatcctttgtctctcagtagattttgaatggctctttatcccacacgagtctagaatcattttgctaagtttattcctagatataatatgctaattgatatgggaattttttttatctccattataccttcttcttgggtgtagacatatttgtagccagcttcctcactgcatattttttattaggcctaatggcattaagtttattattttggattttacaaaaaaaattatgataacatctttaaatagttagtttcaactcctcctttccccttaaatccatcaattactgtcttttatttcactttccttatgtactgactagaatgcctagaataattgaatgctatgagtaataataggtattcttgccctgtttttggaaatccttctggatttcagtaagtgtgatgttggcttttggtttagtatctttaaatttgcaatttacaagatattttacattggaatagtcattgagttgttaagtaaagcacaaacatgttaaattcagactgaagtacaggacttcaatgaaaagttaaaagagtttatttcatcactttcattttttctttccctcagtggctgtttgtcccctccccccaccccgctccatcccccagcttccttcctttgtgctcttattgttctaggtttgactacataaaaagagactctcaatttatatgtgatacaagaccataactaatattataaaattagtctagaagaagttatttgcaacctatataataagggactaatttcaagattatttgaaggactttaaagattggtaagaaaaaaatagacaaccgtttagaataaggcaaagcatgtgtagaggcaactcttaaaaaaaaaaaagtgagctgggtgtgatgatgcacacctgtggtcccagttactagggaggctgaggcaggaggatcacttgagcccaggagttcagggctgtagtgcaccacagtcacacctgtgaataaccactccattctagactgggcaaacataagaagactctgtgtcttaaagaaaaagaaatgaaaagatattcagtttcattaattgtttgactagctgatttttggaaaatacccacaaatataaccaagcctacaagttattttaaggtgggtaagagatacatcttatctatatgcattcacctatgtgaagcggacacccagtaacacccccgtgtggaagacaagcttccttaaacttcacaggacagtatttcccatgtagtccatcatagggtgaggatttttcaggacctttggtaagcctgcttgctttcattcttgagggtagaggaagggtgcaagacttccctggtctctcccaagcattttggggaccctggccataagcctacttgctcaacaggtgcaaatgactggtaatatgctgaccagatgcaagtgtaccaccaatgatttgctgtgactgagtttggtttcctttgcatatactatccagctttttgtttctaatatattcttccttaagggaaccaggacttcttggggaatccagatgagcttgaaacactgtttttataagagaagggctgttttcaaaaacatctatagttcgtaacaaaggagttagattgaagggactctcactgttcagtctgtgacaagcatgagtgttaaaatggagacaagaattttagttaattgtaatgttgaatttgtaaaaggctataacttcataatatgatcaaggggaacaagcaatctaaaatgtgttaaagtagcattttcaaagtgcggtccagggactctcagggttggtgaggtcacaactgtttttataatattgctaagaatgtatatcactctccttctctccaaggatacggtggagttttccagaagctatgggatatgtggcgatagccttgccctaatggagtgtgtgctttgtgctttgcatttttgtcctttaaaaatgcttggttttaattttgaatacaataattatagatagatataacctacataaaccaaagttatttgcggccctcagtctttaagggtgcacagtggggcctgagactaaagagtttgggaattgatgttctagagaaaagtcagtcttactgatgagggttaatcaattagtatttactgaccgggacaggacaaaccattcattttataaagacacacagagcatttcactaaaatacttttactctgattaagtggtgattttagtaatagtaatgattgtttgattttctgatacctgaaggaaaaagagcctgttgaattgatactttgagggtgttgagttttaggtcactgggtgactgtagaaatggaccaggagaagaactgaaacttgagccttctaagaaatagaagaccaaaaaatgtttagtgttaccctatcccatgaccacaataattgagaaaaaggcctttccgttccctcttccctaccctcccccttctcccctaccctctcctcccccctcccctccccctcctctcccctaccctctcctcccccctcccctccccctcgtctcccctaccctctcctctcccctaccctcccctccccctcctctcccctcccctctcctcccccctcccctccccctcctctcccctcccctccccctcctctcccctcccctccccctcctctccctccccctcttctccctccccctcctctccctaacccctcccaacctttcccctccttctctgtccccctccccctccctccctgtcttcctcccaccccccactccctgtcttcctccttgtcttccatcctcccttccttcctttccttcctgtctttcttttcctttctttcctttttcttctttccttcctgtcttccctcctctccgtctgtctccttctccttgtccccttctctctgtcttgcctttcctttccttctgtctttttctttctttctctttctttttcactcttcctttttttaatttcccttttacttgccttctctctttcattccttccatgctttcttttttttagtggtatgtatactttgtgagcaatcagactatagcttgcagaatagttgggagaggccaaaaatgcccctgagaatgcaagcaaggaacttcttagtgagcatatgaacatcctcactccaatcggaggataacattgttcatacttcaaggactaaaaagctgagagagggtctctgctttctgttacttttagcactcgagtcatttctgcatgtatttctactgattactttttctcctattttggttcatatgttttctgcttctttgcttgtctagtgattttggattagatgagtgacattgtgaattttactgtgcaggatggctgaattttttttctattcctgtaaatatttttttggcattgttctaggatgtagttaagttacctggaaaaagtgacatccttttgagaggcttgcttttaagttttgttaggtggaatcacagcagtctttagccagctcactaaggaccaatactcttctaaatacttaccataatgtcatatgaatttccatgtttttccacttcagctggtaggaacacctgtgtcatctctaagcattgtactgttaattcttctagtagttcttatctggctttgtacatctgctgatcaatactttcagctaaagtctcaaggggacctctgcaaatctacagtgttcactgttcagctttctcttctgtagtaaattgcacagtgaactctagtccccttagccttcctgaacccccagttctccttaactcagggagatcaccaggccccaccaggattcctgtatctgccctgtgacctggagattctctgcaggcaataggttggggcggtcgtagggtccactttgttttcctcctcttcggcttcactgtcctgtgttacctgatgtccaatgtctgaaaactactgtttcacgtatcttgtgtgcttttgtagttttaggtgaaaggtaaaactagtttcttattattccacattggccaaagcagaagttttggaagtctttttttaaggtctaaaacacttctactttgagagtcaattgaaatggtcttttccacaataattattttctgacctatggtttaaagataagtcatgaaaattttatgccactatttttttttaagtctgattatggttaaattcagggggctatttcctcctagattgacagagtttataatgtttcctactcacaataattgtacttctgcttcctctttgcatgtgttactttaatgggaatgtatatttccttttcgttaaggctgccttcaacaatttgtcataaagtcacttctgttagtgaattctattttttctgttactttactctatccttagtaccaaagagctccttatgtgacaccaatttattactaaaatgtcgctttgtttatgttcttggaattcttcatacattgactatcctcagatgtcgaatgttgtaggcctgtgtggcagggactctcttccatttattctatttttaatctaattcttgacaaaataaacccaatttttcttttcttcccctttccatctcacgtagggactggcataaagggcaatccataaaattacaaatgatgaatttttttggttttaactattattcatacatttaagatatggtcacaatttttatttcttactagtaattcattttattttttaacttttaggttctggggtacacgtgcaggtttgttatataggtacatttgtgtcatgggggtttgttgtacagattatttcatcacccaggtattaagcccagtacccattagttatttttcttgatcctctccctttgctcactttctaccctctggtaagccccagtgtctgttgttcctttctatgaaacacaatggttttaattggaaaatttatttttttttcaggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggtaagtactcctcatgggaaattttaatcagcccagtttccttgatatacatgattaatctagacatgttttgagtaaaaacaactttagtgatgttgagatagtttccttctgttcctagtttttgtcgtgagaaagtgttgaaatttgctaaatactttttctacattaattgagataatcatatttttccctacatcctgttaatgtggtatcttatattaattgattttcatatgtttaacatccttgcattccaggaataactccccaatggccatggtgtataatcttttaaagatgctattgaatttggtttgttaatattttgttgagtatgtttgcatcaatattcataaaacatattgttctgtagtttttctgtactgtttgtctgactttggcatcagggtaatactggcctcatagaatgagttaggaagtaactcttgaatgactattttcatgaagaagcttcaataatctgaaataaaatacttaaataatttagttcacctgagagttgtttttagaagcgtatttatttttctattaatgtcttttttgaactatataagaatgtattctccttccactcacacattgatggcaagtgtgtatttgtactctgtggcctgaaaataagatttttttgaataatcttaagaggccatgctttatactctggtaattgagaattacctatttcacagtagctttttctaaaggttaatttccagagaaaagagaacatgtttattaggatatatctcttaatgaattcagtgtatctgaaatttctaaatgacattttcatattttgcatactaaataaaattcataagtacaaatataatgcaattcataagtacaaatataatgcaatttggatttctagaagttatctagttaaaatatgatcttaggatttattttttttgtcttagatttatgaatcttgcttgtttttctgttaattcatttcttcttgtttgctgcatcagtcagatcagagtagaggcagcttgtatagttgatggcacagtttagggttagatggcacaggatagaaatgggtgctagacaaagagcagtcacagaggcatgttagaaatttccagttccagcatcattgatgaagaaaaccatgaggacccaagttgatcaaaggcagccagccaataaagctatgctcatgcgagatgagctgaagtgacattacattaaaattggaagaccctcttactaagtggctccatgcttccctgctagcccctttgggacttccaagaagacttggttatttcaagaagacaagaacccacagaggctgtagtttagtttatctctctggaaacatagagaatatgtataattaaataaaagcactttaatagtgaatcctttacagtgttatttgaaatttatgtcaagtgatttaaaaagtaaaaatgaaaattaataatttcagtggaagtaaattgattaacatgaccaggaatacataaaacttgcatggtcttgtctataaaataaggatatgtcatttaattaggagagtcaaagctcattcttgcgcttaaggtctgaggaactcttctcccatggggcttatgaagggctacactgaggcaacttcctcaatatatctcagccataaaaccaagagaaagtaagaagcagaggacatcacaacaaagctcaattcagtaaaagcaattttataggagtagagggacttgtcaaaaacaaaaacaacaacaaaaaacaatgtccaaatatttattcagcttaatgagtgatgtttttgtttgatctagggttaaaatctagacaaattacagagatgaataaactacatatcctttagtctaccatcctctgaaaatgttactttttgaaactttgattttgataagagctggaggcactcagggagtcattctctggcatggtctttgagtacagagtgattttgctgattaaaagcaaatagattgacttttaaaatcaactcatacaaacaaactgttaaaatcctctaatgagagtgaagaaacctaaccaagactgactgatacattactgctccatctctgcaccaaagtggactcagggaggcctgtaggagatgccaactccttatcctactccccacaaagacagttcttggctatcttcatcagacacaaatgaatggttgaggctccaaagctctctaccaattcttgtgttacactggcacttttaaaaaattttgtttattttttatttttaaatggagtctcactctgtcaccctggctggagtacagtggcgtgatcttggctcactgcaccctttgcctcccgggtttgagcaattctccctgcctcagcctcccgagtagctgggattacaggcacccgccactacgcctggctaatttttgtattacttagtagagatggggtttcgccatgttggccaggctggtcttgaactcctgagctcaggcaatctgcccaccttggcctcccaaagtgctgggattacaggtgttagccaccgcacctggctggcacttctcttaaaactaatatctcaagaagttttttctttaagaatcttctttcaattgcaggtccatgtagttctggtattcattaaagtgcctatcccaggggttttggtatgttgtgtttcaattttcatgtttcaatttttttgatttatgcattaattttgttttttcagaattcaggtgcaggttgtttagtttccatgtatttgtgtcgttttgagaattcctcttgttcttcatttctaattttatttcattgtgacctcagaagacacttgcattgattttgattttttttatcttattgagatgtgacttacgactatgtggtcaattttagagaatgttccatgtacagatgtgaaaaatgtatattttgtgttgttgggtggaatattctgcagatgtctgtcaggtccatttggtcaagagtctgatttaagtccagtgtatacctttgttagttttctgccatggtgatctgtctggtgctgtgagtggggtgttgaagtcccccactattattgtatagctttttttccccataggtctagtagtatttgttttatgaacctgggtgctccaacattgagtgcatatttatttaggatagttaaatcttctggttgaattgaaccctttatataatgccctcctttgtctctttttgatgttgttggtttaatgtctgtttcttctcatacaagtatagcaacatctgttcttttttaattttctatttgcatgctagatctttctccatcccttcactttgagcccatggttgtcattacatgtgagatgggtctcttgaattcagcagaaggttaggtcatttaaaaaatctaatttgccactttatgtcctttaagtggagcatttaggccatttatgttctaagttaatattgatatttgaggttttgttcctatacatttgatatttgtgtattgttaagtagttgctttctagtttgaattgtgtaattgctctataagatctctgagccttgtacttttgtgtgcttatatggtagcaagtattgttcttttgtttccatgtttagaactccttggagtatttcttgtatggcaggtgtggtggtaacaaattcccttagtgttttcttgcctgggaaagactttatttctccttcatttatgaagcttaatttggcagattatgaaattcttggctggcattttcttttttctttaaggaggctaaaagtaggcccctgatctcttcttgcttgtaaggtttctgctgagaagtcctctattagtctgattggatttcctttataggtaatttggcccttttctctagatgcctttcatattttttctttggtgttgaccttgcatagtctgatggactatattccttggggatggtcatcttgtatcttgcaggtgttttctgaatttcttgtatctggatgttaacctctctggcaagattagggaaattttcctgaattattgcctcaaatatgttttccaatttgcttacttcttcctcttctccatcaagaatgccagtaagtcataggtttggttgctttacataatcccatatttatcaaaggctttgttcatttttcagattctttatgtttgtctaactgggttaatttgaaaaggtggtcttcaagctctgaaatcttgtcttctgcttggtgtagtctgttgttaaaacttccaagtgttgttttgttttgttttgttttgttttgagatggagtctcactctgttgcctaggctggagtgcagtggcatgatcttgactcactgcaacctctgcctcctgggttcaagcgattctcctgcctcaccttctggagtagctgggattacgggcgagtgccaccacccccgactaatttttgtattttttagtagagacaaggttttgccatgttggctgagctggtctcgaactcctgaactcaggtgatttacccatcttggcctcccaaagtgctgtgattacaggtgtgagccaccatgcctggcctgcttccaagtgtattttgatgttccctttagtgaatttttcaattccaaaagttctatttggttttatcttaatatggctatctcatgtttcatatcctgcattgtgtttctggtttatttgaaatggattttaaatttctcttggctctcactgagtttccttgcaatacatattttgtttttttagtctgtcatttcaaagttttcaacttggttaggatccattgctatagagctagtgcaattctttggaggtatgaagacactctttttgtagtgttggagttcttgggcagattccttcttatctgagggagctgttgattcttatttttgaatttcctattggttgggcgggacttaaactttttttttttttccccttgagggtatgactatggtgtatgttgtgtgtgatcattcaactttgtttctgggtgctttcagggggccaaggctctttatggattccttgggcgtggtagctttcttaaatgctgcttattgtagcaatgtattggatttgtgagctgacactctatctcatgtggggctgagggtgcagaagtctcaggaagcttattttgtggagtagtgctaagcctttctggtagtgggctttttatttgatagtacagttcaggctgcaatccagtagatggcacttaaaaaataagaaccagcttgccctcagttaggctgatgtccagtagaagcacctgtcctgacaggggagtgacaggaagagattctgttggtgtgtgccgaggcctttggggtcgctggttggggggagatagggggaggtgcactagctcctcatgcaggaatgtgatctgcttttctatcataccccatcagagggctcatgaccttcagttcataaagattttttccttgggttcccagccatagtctgtctgtaggttatgcatatgcccctctgaaggcaaccaccaaaatggtcttggggcagagcctcttcccccagtctagggcagacaactccatgacttgtatgtcctccattgctgggacactgctgctctgtgtagggatggggagttgggccccaccctttatgtaagcctaagtggcattctcactttcagcaggggtggagccatcttgaaaaccatgaaaaactctttcttcgagtacctgtgctggcccccagtgggaagaaccactgctgcgtcttcaacagcgtgtggggtgggagggtattgccacagatgaccccctctccatatccgttccttgacatggtgttgccccctttagcgattggcactgtgcccacctttcctttgtcccaaaggggttttggcaagttgtgtccctctcccttataggtggcctacactaggggggttagatctctagaggttccatagctccctgggaacttgctggccccctgggcttttcaaagtcagaacaggttatgaggtatgtttgctggggatctggtgctacagagactcaagggtagagaatccctgggcagagcagaggcccaccactggtgcacaagcaatatggtgaccaccatctcagtttgtgtctgaggggagtatgggaacccctgcaggagctggccacccagttctctatccctgggaaattcctaaattaccaccaataacattgccctgggtcacaagggtggggccttgaattctttgggggttgatctctgccagactctagctacttttcctttctgcaccccagcttcttcccatgggcactccaaaaggtcctggctctctttccccagttttccattagaaacttgtccatttgacagtaactttgatcttctttctaagaagagctggcatccaaggtctgtggtcagctatgttggaaaaaagaaggagaaaaaaactagtttgtattaaattctgaaagactagtggcactggttaagtctttaaaggattgttaacaaaagaaaatctttttaaaccaaactcctaattttatcagaattgtaactgaaaatataaatgtatgaaaacataggtattatgtaaaatttgctcaataaaagaataggaaaaactactatttatcttggactgatagcatgttagtttgagatttgaaccctttctactctagtaagtagtggtgggaaaaattcactgtaggagtctgcagacataacaaactatcattagactgccaagacctccacataataaagcaagcagagaatgtcaaataagtatgtgaaaaatgatcaaaaaagagaaattgaaaatataaatagggtgctattaaaaaaggatagcatttatgttatgacatatgtacacatgaatatcactttttagaatttcatccttcttaggacttattcctgagtccgaggattgagaggttctgataaaataagtctcagtgggttccaggcatgggctttctttaaaagtctctccagggattctaatgtgttgccaggaccaagtaccatggacagccaagatctcatcagcacagtttgattgaatgaacttatgtagaaccctgaatgccacacttaaccaaagaaacctttccagggattaattataggtgacagaacatgctatattcttattaaatattattaaaagttaagcaatacccattcctgattcatgtaaaattctcacttattttccaagagttttactgtatgactggtttatgggatgcttggaaaaggttgacagacatggcaaaggttcctgcagtgtttctctttgtccatcaacagccctagctcataacctctaccctttcagctaaaagcaattagctcttcagaagtgattcattctatttatacttgggataagtaacatcaggcagtcttccctagggcttctcacgggccctggtggcatttttattctaagagagggttatatttttacatgtaattggtcataattatactaaaaacaagtaattggtgtcttatacaagaaaattatatttctgctttagtcattgacagagtatcctgagaataagagttaagaagtatattcattgtcatcttatttctgatatatttcaaattcttttgctaggaagaagcccttttgactgtgctttgtgtaacaaaacttcttcggagaaacaatttagataaactttgtcagatcttatgtgattatattcaaaatgctaattgaagattctctaaacattttcagtaaaatgttgaattgttttcatgctgttaaataagttaacatgtcttcctttactaaagtcattattataaaaatgtaaatcctaatgataatagctgatgtttattaagcatttagtaggttccattttttgatagcaacttttatgaattatctcattaaatcttcataataatagcatcaagaactacaaatatgttttcatgtaagaagggaaataaaattatgagttttgctgtgaggtttgaagaatgaaaacaatgcatgacttagaaaatagtataattaagtgaattttattatcattatcatctcttagtttataaatgaaaaaactaaggcttacataatgtaaaaatcagttaacaaggttaaacaaccggtagatggtagaggaggagctgggaataaatctgtacatgtctgaatctggagcaggaacccttaactgatgtgtcattctagcaggtcatcagttactctacaatacctattaagtatactttatttactgtgtttagatttatagtagatttagactctactgtaaaaacaaggacttcatacacctgctagaaagtatccatatcatcttgtttgaaagttgtcccgctctagtgttcttttctaatcatgatgattcagaactccaaactcttgaagcagggcaacccgtagggtcagcattcataatttctcaatacttaaaaaagtttcctcatgactgttgctattattgagatttctcaaatgtcttggcctgaattgggtgtgcactatgaaaaaaaaaatggcagacatttctttttgttaaaggaattttaaaaacacatataaacacactgatttgtgacagattaccaggctttatgtttagcagggtttcctaagcaaaacacaaattctgtaaatctacagaattagataaaacattgactcaatccttagatgagagtataatggattatcacttaataacttctgtcactgaaaataaatgatgtaaaaagtaataaagttctactctcacagtatgaataaataggaaatacataatactttaaattaggcaacaaatcattaagcccccagcattcattagactatcattaatgataataaaattgtgtggtatttatacagatattatatgtaactccaggaattttgttataattgtgtatgaatatatttgttgtttgaggcaggtagatggatatttgcagcagctatgtgctgaagcattctggtaatagttttcaaatcaaccatttttttctccttgtcgatcatctttaaagcaaaagcaccgttttttactatattttttgaaaaaaatacattaggtgtaaaattatatattttgaagaagttcactttctgtttttactagtttcacacctttgttattttttcagtggaaggagcagagataggcaaaggcgaagcctgtgtgtgtggtcaggttcctgggcccttcatagcatctgatgccaagctgtgttctcttttgtgtcattgccttcccacttgctaattacgtgacagagctagggacttccctctgtctagaatgccccccatctcttgtttgcctagtgaaatctggtttgaagttcaaggtctgatacaaaccaggtgatcctctgcaaaactaactgtacctgagcaaaccaggcacttactcttttatatgttcctggcactgctgatactctgatagaaaacatcatcacttaatgctaactgtgggctcacaaaggggatacttctactgtaagaagactgtaactcttcttagcacagagattagtaagtacttgaaacagagtttcacatataataagtgttcaataaattttattttttatttctaacacttggcacactgcatagctcagtaaatgttggtgaagtgaactgagtattctccttatctattatgtggtaggcattattctagttgcttctgttataaaccaactcatttaatccttatcacagcacttttattgtggtcaatattttttaatcctcacagatggctaaggaatcagcactctgagagattggttgacttgctttgggtaaggtgcttataaagtggtagaacaagattcctatccaggccttctgattcaaaaatacattctttttttttttttttttagtagtgttttctggaaaggcagggtataactgactatgctgtgtatttgggactaagtatattattgtcaagtatattaaaaatgtcgcaacactggaaaggagtccatcaatgggctatgcaggttgagggatttgtagatgagaaactgataaatttggttagcaaggaaagccatcaagctgtgaaccctttatattggcaaaagagagggtcctttgaaatctaagggaacagaactttcctgttctccaagtttggagcagaataggtaagctctaggcagtctaatgcccaacttttaccagtggtgttttagttttttttttttttccaaaaggaaatgatggaattctttatatacttctgaattgtctatcttttcaaaaataaaaattttcattttgcagtacatacagaatcaaaagactttcaagtcctaactccacaaatgtttattttgaagctctttaaactgtttaccacggatattagtaaatctgtcagaaatgaggtgacttacttatccttgtcccaccagatatgtgggaaggatgatcacgctagatagcatggatgggtcctctatttatctctttttacttgaatggaaaacacatcattcagattaatcaattagtcattgtgactgatagaatttttatatggataatctgggtttggtccctagctttaccacttacttggggtctttatgtcttctatggtctcctatctgtaaagggaagttgataatgccaatctagctaggttactgagatgcttaaatgtgtaatgtatgcaaagcagcaggtactcaataaagggtaactcttactattattgtatagctctccaggtatgtattgagcttctatagaatccatagccccaaactctttagccctttgagaccaagattaagcattgtctttccagaggagagggtgagagagattgccattatactaatagaattcatcattatcaccgtcatcatcatcatcatgatttcttggtgtgtcatggaatgtactgtgtttcacattaccaacagatgttaattttcacaacatccctgagacaagaaactatgattacattttacagataaggtcatgcagctataaagttgtgaaattgggattcaaactcaggcagtctgtccccacagtccatgttcttaacccaccatgctctcctgacacttgaaaagttaggaggcgtactccatagcctgtaatgttgctgcagagagaatctaattttaaatccagtgaagcatattagttgctgtctttgatatgccattcagattgtgctatccttatgatgcctaccttggttgtatatgtaactgggcgtcaaatatataaatactcaaaaagtgataggtgccaataaaatattttatagttaatacttatgtaatctgtgttctctgtgtttgagggctggttctaaaatactgctctatatttgacttctggttaaaacaataaactttgctcatattagttatatagttgataccattctcatgttgctaacatgtctgtaagtaacagttgaaattgatctggcaattttagagctgtcagacccaggagatgagagaaacatttaaaatgtttataacattaaatcagctgagtcaagagagagaaagagaaagatgattcagatttcttgtactggtggatgtaagtgcttggaactgaaataaaggagaaggtgtagggagggagaaagataaagaagtcttccctttatacaagttgaaattgagttttctttgagatatagaggtgaagacattttaagaaacttcttaaaactctctaatgtggcttttcaacctgtttccatcaatttggcacatctcacttttcggcacaacagaatattctaggtttatctcacaccttccttgccccagcccaggaatcagccatttctctaagaaactcttgtttattttggtggggaacagtattgggaaaccaacatctgggagctaaatatactcctagtggttaggaggtcataccttgtagactcttgtagctgacggagttaggacatatttattagaaatcataagtttatattgatcttgctaggatctatccaatcctacaagattcttccctgtgtctctcctttgtatttgtgtatcctttcttccatattaagaactgtggctcccaacaacaaggcatgtgcccatttgcccaatcgtatgatgtataaaaactactttgagaaaagtggcagccaaaccactaagaaaaataaacttgctgaaatgagttcaagatttattggcagctctttttttggcccctagactgaaagtatatatttcaagtattgtgttcaaaaattatttgggttagctttttccacctttcataatagtaatattatttacttgaaatacagttggctttgtttctatattcagtttttttctctctatcttcattaatttcattatatatatttaatatgtaggacattaacatgtttccaaaagaagaaaacactccttcctgtatcatttccacctcatctctcttaccccttataggtaaccaattgcactggtttctagtttatcttacttatattcctatttgaaaagttacctcatatatgtatgttttttaaatttttatacttttttacacagaaagtaacgttcagtatgtactttgccactttccttttaaacttaacagcgtatactggaaatcactccatatcgtgtcacagagagcttccttatattttttaatagctgtataagacttcattgtgttgtctgtaccatattttattcacttccccatgtgtggacattttgactgtttctagtatctgcaattactaataatgctgcagtaaactttgtgcatatcgtaccttggtaaatttctagacatagatttctgggttaaaggttaagcacatgtgtagttttgttagatattgataaattcctttccatggggtttatatcatttttaaaatatttaccagcaacgtataacagcgtccattacttcaaagcctcaccaacagattgtatgttttaagtacttttatgttttagaatttttccaatgcgataggtaaacaatggtatatcaatatagttttaatacattaaagttcagcatcttttcaagttcggctagtctcagggctattcttaatatcttgtgaattatcttcatattattttcccatattccataatacttttggttttttttcctcctcaattctgacaagttctttatatttcaggaatattagccattttatttgatatgttacaaatatttttctcccaatatataacttttctcttataacgatttttttttcatgaaaagtttttaattaaaaccttttatgggcccaggtgcagtggctcacacctgtaattccagcactttggaaggctgaggtgggcagctcatttaaggccaggagttccagaccagcctgaccaacacagtgaaaccctgtctctactaaaaatagaagaacattagctgggcttggtggcacatgcttgtgatcccagctactcaggaggctgaggcatgagaatcacttgaacccagcaggtggaggttgcagtgagtcaagatcgtgccactgcactccagagtgggcaacagagtgagactctgtctcaaaattaaataaatatataaacaaaaccattatgggccaggtgcagtggctcattcctgtaatctcagcactatgggaggtcaaggtggttgaatcatttgcgccaaggaactggacagaccagcctgggcaacatgggaaaaacctctctctaccaaaaaagaaaaaaaaaaaaattagctgggtgtggtagcatgcaccagtagtcccagttactcgggctggtcacatgagcctggggaggtcaaggctgcagtgagcagtgattgtgccattgcactccagcctaggcaacagagtgagaccatttctctaaatacatacatacatacataccttttgtggagttaaatttacacactttttctttattggctctggcttttgcattgtagtaagactttctttacactcaacttatagataaattcacccatgttttcttctagtacttgcatagttgaattttagatctctagtccatttggagtttattttttgtatggtagaaggtattgatcctattttttcccaaatagttgttacccagttgtcccaaaacaagttattgaaaagtccatctttgtcccagatagactggaacaaaatgaattaaagacttaaatatgaagatttttacttgtgtatcctttcttcctagaaagaaaacataggcgtaaagcttcatgacgttgaatacttcatgccattggtctggcaataatattactattatgaaaggtggaaaaagctaacccaagtaacttttgaacacagtacttgaaatatatactttcagtctaggggccaaaaaaagagctgccaataaatcttgaactcatttcagcaagtttacttttcttagtggtttggctgccacttttctgaaagtagtttttatacatcatacaattgggcaaatgggcagatgccttgttgttgggagccacagttcttaatatggtagaaaggatacaccaatagaaatatttatatttaagtctggcaatcatttttaagatgtgaacttgaacaggcaacaaaagcaaaaataggtacgttggattacatcaaacccaaaagctcttcacagcaaagggaacagtcagttgagtgaagagacaacctatggaatgggagaaaatatttctaagccacacatctgacagagggttaatatccaaggtatataaagaactgcaacaactcaatagcaagaaaacaaataacatgaataaaaaatgagcaaaggatctgaatagacatttctcgaaagaagacataccaatggacaacatgaaaaaatactcagcatcactaacaatcagggaaatgcaaattaaaaccacagtgagatatcgcctcacacttgttagaatggctgttatcagaaagataaaagataagtattggtggggtgtggagaaaaaggaactctagcccactgttagtgacagtgtaaattagtatagctgtgatggaaaagagaatggaggttcctcaaacagtttaaagtagaactaccatatgatccagcaattccacgactgggaatatatccaaaggaaatcagtatattgaagagaactgtattttagtgattattgcagcattgttcccaatagccaagataagggatcaatctgagtatctatcaatggacaagtgataaagaaaatatggtgtgtatacacaatgggataccattcagcctttgaagagaaggaaatcctgtcatttgccacaacgtggttgaacctggaggacattagctgagtgtaataagccagccaccaaaagaaaaataccacatgatctttcctatatgtggaattttaaaagttgaactcaaggaagtagaatagaatggtagtgaccaggggtatgcgataggctgagggatcaaggagatgttggtcacgggatacaggatttcagttagataggaggaagaagttcaagaggtctattgtataccatggtgagtatagttaattataaagtatacttgaaaattgttaagagtagattttctgttcataccacaaaatgataagtatgtgagataatgcatatgtaaattggctcaatttagccatttcacaatgtatatatatttcaaaacaacatgatgtacatgataaatatacagtttatttttaattaaaaattttaaactctctaattggtcttcaacatatagtacacaagtcttttcacgactctttataatggaacatatgttcttggaatgctaaaaattattttttttggaggccctgcaaataactaaaaatttatcttaaaagccacacctaattacttacatatgatccagaaaggatactttgaaaaagctttttaattgataaaatcattaaggtaaaacatattcataaaagtgttctctaataattttataattttctagttcatgaaggattaaatatacaactatcatttgaattggattttttatgaggttaattgtatttaaatgctaattattttaactaattttgtggttgacttctatgtagagtagggaaaaagaatttcctaaagccagttacgtatatctctttttagtctggatttttaattaggaaaagtgatatagttaaataggtctactctatagcatcttctaaaatgagtaaaaattcattatatcaggataaaaaatgataaagatatatggatgacacatttggctgaatttttcttcttcgctgttctcttgctctctatttaaatagtcttagctcttttatcatttaaattctgaagtattgaggtgattattccggcagcaggtgattctgctaattactgttcagtcagttttagctattagaaacagagatatgtttacattgctgggctgcatgtaaatttagaagttacatggctttgtttttactttgacttacggcattaaaattattttcatctgtgtatgtaaagatctgcatctataagcttttgtggataataaggtgaaattgatgcattttaatataaattgccaatataaaatatctctaactcagacctctactggaaagttgtcaaatcttatgtaggaaaggcttttaccatcactgttacacattaactgggcatagtttaatattaatagctcctgagacttgtggttaactgaggtttctatttcctgtgtttgggttttatctttgcaacaacttggttgcttttctgtgtaaaatagtggtgaatatacacaagagtatgacaaggttctgggctcttaactttgatgaacaccatgccatttccatcatgctgcactcaaaacagcacagatgtgagtctgggagtggcgtccctgccgctctcatgagcctttgtttggagaacaccctgattaacccccacccttcacggttcattgactcactgatagatcaagtttaaactagtatatattagcacatttgttaccaacagaggaacagttggccattctgttttacattgctggttcattgcaaactggcgtgctaaaaaggtctgtactctagagtatgaattgggaagttaccaaaggactgagaaccaagtcagttgcatattaatgttgaattatacctatattttaatcttggattgtctacttgggggatgcttacactgttgtcaagttatgaataagtgataattaccactttgaaattcatctttttttttcaaggagtttaggggatttaggtgtctcaatatagctttcatattaaacagtttgtcataattggatgagagcagagcaaggtcatgactacctgatgccttgtgttggagcattttaaaaatgttttccagagagttatttgtacctaatgactttacataagtccttacattatactttatttctaggtcacctaaaaatgttaattgtttagtcaagagggttaggatgtgtgtctgttttctcatgaaaaaaattaagctgttccctttttatcaattttcttgcaatctaaaggcttttttttcttaccttcctaacctagtgactaaggtcatcttattgttacagttcctttcatgggagataggtttactgcatcatttggcagtttcatagggtgaattttgtcttggcttcatctttccttactggttgtcatcccctgggccacctgcttttttgcattttcctttctcttgtgagatgatgaagctctgtgccccgatggggatgagagacagcactctgagttcaagtctaggataaggcaatgggcttgcttttcaaaacaaactagtgtcatacgggctgctgctttcaggtccactgtctgattttatcactgatgacttgtttctggaaggcaaactgatttaagttctgagcaaaagggtcggtgtttattttcaatgctactattaatttagagttttaatttagaaaagattttttaccagttctcaaatatgatttttctattgactttaagtttgtagatataaggagtagacatgagatagagactgaattgcttttttgtttttaaaacttggcagtaataaggggttgcttgttttttcatgctaaatattttttctaagggatctagatacctatcagaaaacttaactttgataactctggttctttattaagtatttttgtcttattttaggaattaatagaaatagttgtaattttagacttcctttataaaataccaatttaaagagaagctttttgcttaaatgattgttttgcagtgttgtgcttttgttttctttaatgcagttgaaatcgcagctttataacttattttttaatttggggtttttaaaagaatattagttatttatttatatttattgggcacctactgtgtgccagacactattctaggaactagtaaacatagcagagagcagaatcatgaagttcttgacctcaaggagcttaaatcctagtggtagagggggaattcaaaaaaatcaaataaatgtatttctattatgtcaagtgatggtatgtactaccaggcaatcagatgaaaatatttcctcttctatacacagtgggcaaggaaggcttcattgactgtggagttttagaagaaagctgaaagtaatggggaaagagagccatatcgatatatgaaggaaaacatggtccaagcagaggaaacgaaaagtgcaaagaattgagcaagaaagtcatgttcaagtggagtcagcaggggaaagagtaggtcacaaatgcggctgagggtgggtcatgaagggccttacaagctttgtatgagtttttacttttattctgaaaaaaacaaaaacaaaaacaaaaaaaaccggggagctatttggggattttaatagaaaagtaacataatttccttttaaaatggatatgtggccactaagtggagagagtggtgtatatatgagtggatggaataattgatacaggcaagcaggagacaggttaaatgaaaaatggattaatccaggcaaaagatggtgacttaaattaagctgggagtgggagagatggtgagacatgcttagactttggattcatttttccagatagaactggctgacagagacatgtcatttaccaacatagacatggcagattttttttttcttttctgagacaaggtcttgctctgttgtccaggctggagtgcaatggtgtgaccatagctcatggaagcctcagactcttgatatcaagtgatcctcccacctcaacctccctagtagttgagattacaggcatatgccactgtatccagccaactttttttttttctgtagagacaatatctctctgtgttgcctagggtagcctttaactcctggcctcaagcattcctcctacctcagcctctcaaagtgctgggattataggagtgagccaccatgcctggccaatatggcggttattaagaggataagtcaaagattacatgaatattctgttatgaaaagtgtcaaacatatagaaaatataaacagtattccagtgggcacccatatttttatcaccttgattctacagatcttaacatttttctgtatctgcttcaaacattttattctgccaatgtgttctaaagtaaattgttgatattgtgatagttctctccaaaatgctgcagtgtgtagctctaaaaatagatatttttcagataaccaaatatcattaacctgccaaatcaatgaatgataattgcttattaacatttaatacttggtccatagtcaaattctccatattttccataatgtcttttatagttaacttttaccaactagtgtctgatcaagaatcattcatttaactaattacatttaaactgtaacattacaacatgttttttcgtatgttttattctctctgacattgacttatggaagagactagattatttgtcctgtagacattttatcatacataagagttactaggagagctctgattactagtccccactctcagaaattttgattcagttgctctttccagtgagctgctggtgatgctggactttcattctgaagaccatactttgagcactactgctgtaccactatccgatggcttctttgtgatatcgtttaacttgttgttctgttgcctgtatttcctctaaactgaattttcaatctaaaggcttactgagattcatgtttgatactttgggcaagaatacttcataagttctagtgcttaatgttaggtagcacttaattctgactatttcactattcatgaggctaagctaaggaggtgacagcctgatccttctattgtaatgtttcatgtgaaactactagataatttgttgagttggggggtgggtagggaagagatatctagttttcaataaatatttcacctaatggttttaacacacattgatcatccttgcctgaactaattatttaattagggatggcaacatggagactttctaattcaatctttttttttttttctaaatgaatggccttgtttttatttttaaatggatgttacttcgcaactggggttatttgattacccagaaatatagcgcatattaaaaaggtaggataaatgcttagttaactaattaagcaatttttaattaccagttttcacagtaaggcactaaagtttctgacttgagcaaagataaagtggaaagataaagtggtcgtttagtgagatgggcaagactgtggataggtagactaggtttggtgggaaagtcagaatatcagttttgaatatgttaagtttgagatgtctattagaaacatatgttgacgaggccaggtgcaatggctcatgcctgtaatctcagtactttaggaggctgaggtgggcggatcacctgaagtcaggagttcaagacgagcctggccaacatgtgaaaccctgtgtttactaaaaatacaaaaattagctgggcttggtggcatgcacctgtaatcccagtaatcccagctacttgggaggctgaggcgggagaatcacttgaacccagggggcggaggttggagtgagccaagatcccgccagccactgcacttcagcctgggtgacagagcgagactccatctcaaaaaaaaaaaacatatatatatatatatatatgttgacaatatttcagttgaataaaataaaatattctagctattttaggtagaaaggcattttataccgatactactactaaagggtaagaagatatgactgtagtacattaaatatgctgatggcctacaactgttgctgtgttgctttttcctcttcaccacacatatgcagcctcatgaaacattttccatgaccagcacactgaaggaaataaaaggaacctagtttagagatggttctgcatgatacaacaaaaatgagctgctaaagcattacaatcccactcaagagtattcccccatcaaatagtggggctggtattttaatcagttgatactaattgtcaaggtgtgatggccaagggattgatgtttatcagtgtatggacagtggttcagagtttggtgaattagtcgagttgaaagagaaagattggtgacaaagatgtatgaggtggaaagtatactttcacagaataagaacagaaaatgagatttatgtttttttgtaaacgttcaacaaagaaaattcattcagaggaggaaataggtaggcaagatgccctattctacagatgttagtcagcatcactgcaaagcaacctcagggcttatgcagtggacacttaaaatagcactggtgcagggatgggagaaataaatggatttaataagcactgctgcttaccaaggttgattgaattgccactattgccaagtgttctacctgcaaacagatcaaccttgagccctggatatggcaccatgtcccagagcaaccagccagccacctggtggcaggttgattgcattggatttgctccattatggaaggtcagtggtttgtcactgctgcgatgaatgcttactgtacgtttggatttgcattccctgcccaccatgtttctgtcagcaataacatggccttattaaagccttattcaataatatgacatcctatataatattgcttttgatcaggagactcattcacatcaaaataagtgaggcaattggctgtcaactacaggattcactggtcttaccatgttcctgttgtagcatattgtattctacctggaagatgaaaccttgtgacattaaagtagtttttagttccataaacataatacaggggtctatgaatcaagaagtggaggtagaagtgttgtcttttacttcacatctaatcacatgttcaaaatattttttcatcttgcctctgcaactttgaactttgctgacacactgaggttttagtgtgaggaaacaatactttcacatgggaacatgatagtcgttcaattgaactggacatttagaataacctggccacattactgaactgtataactgaaacaacaaatgaaaaaaatgaagatgctacgctggcaaagatgattaattttgattattgggagaaatagtattgctactgttaggaggaagactatatgtctagaaactaggaggaaacctgggttgcctccttgtagcagggtaaaatgagtgagtaccttgtctaagaaagggaacatgaccaaactgaacccagaagacataggaaatctaaacagatcaattaacaccaaagaaacgggcattttttggtacttctaaaaaagtaccagactgatattttcacagagatgttcgttatacccttaaggaacaggaacagaaaacttctatactatttaaactattttagaggatagaaaaggaaagaaaactccagattttatttatagaacttgcatgaaattgataccaaattctgacaatgcaagttcaaaaaggaaaactagagatcagtgttacttatgtcaaacagctcttaatagaatagatggatatggttatcaacatgataaatatgtttatcacattttaaagcctacatggagaaacatttgaggttttcttattctagaactgacaggaatgtcctttattatgagcactattagtcaaatttttctggtggaactaatgtaagtagactgctgaagaaaatgaatggtatgaacattggaaaggggaaattaaatgattattatttacagataaaataattgttaagctggaaaatccaagtgaataaagggaaggcctacaattaagcagttaaggaaagggctaggtatagaaatcaatagttttgatatatgcaggctatagccagttaggagatcagttaggggaaaaacacgttgacagcagcaacgaaaagctgataaacctagaattgttcaccacttatcttaaaatgtttaacatggtactgagggacacaggagattatttatgtggaaaaacataccatgtttctatacagaaaaattgaacatcacaaaagtattatttgatcttaagataatttatatttaatgcaatctcagtgaaataccaggagaatgtttttaagctagacaaacttatttcaaagatcatatgtaaaaataagcaaaaatagatgtgaaaaattctttaaagtaatgagagaccagtcttattgactattaagtcattataaaactataatgtttaaaagatggtactgacatatgaatagatcagtggatctcagatgggcagtgcagaaagagatccaaacacatacaaaaatttagtacctctaaaggtggcatttaaaatctgtggggaaagatggattttccaatgaataatgttgggataggtagatagccatctggaaaaaatgaaagtcaaatcccaactttttaccttttatcaaaatgaacttcagatacaattgaaaatataaaattgagaccataaaagtattagaagaaaaatgcagtttttaagtctcaaaaggggactcttaaatatcatacaaagcccagaggccataaaagagatgattgataaattcaaatataggtccgtgtaagcgaaaactttcagtatggagaaaacataagttattaaggcaaatgacacactaggaaaagcatttgtaactcataacaagcctagttttcttactgtgtaaagtactgccataattgacaaagaaaatatgaagaattggcaagtgacatacatagaaagttcatggaaaaaataactcttaaacatttacaaaattttacaacctctcatgaaaagagaaatggaaattgaaattagagtcacatacagtatttcacttttcatttgtcaaagatcaaaaagtttgaacatactgtgggtttatgtttataaggatgtaagaaaacaggcaatctaaattccttgtagagtgtaaattggtagtaataagagaaaaatttactgaatactttgtgccaggtgcttttctaagcactttacatttaattatctcaattaacttatccagaaagtaccattatttctgtattacacgtgaggaatttgaagaaaagttagacaagtaattcaaagtcacacagttaataaatgacagagtgaagatttgagaccatttcctttttctcaagtgtccacttttggtcgcaactctgctgtttctgtagtgagtgatttaacactatatgataaaaccttaagagtacgtactctttgatccagtgattctacttccagaagtttgtccattttgcatcaaatagatggagaatagcattcattgcattgttatttgcagtaaaggaagattggaaacaacctgaacatttatcctcaaggactcatccatacaaaagaattgaagtaaattcatccagatgaatatgaggcagctttagatagagtgagatggcatcctatgtagtgatatggagtcatctttaaaatacagtaaaaggaaaaagcaagatacagaatagcatgtagggaagctgctgtctatgtgaaaagctgtagaatatacgtgcatttttgtatatgcatagaatattcctagacaaggacaaacatggtggttcatacctgtaatcctagcactttgggagactgaggcaggtgattcacttgactccaagttcaggatgagcctggccaacatggcaaaaccccatctctagaaaaaatataaaaattagctgggtctggtggtgtatgcctgtggtcccagctacttgggaggctgaggcaagaggattgcttgagcctgggaggcaaaggttgtagtgagccaagatcatgccactgcactccagcttgggtgacagagcaagacaccattcatctctctatctcttttctctctctctctttctctgtctacacacatacacatacccccccacacacatatatatacacacatatatgtgtgtgtgtatatatatgtgtgtatatatatacgtgtgtgtatatatatgcgtgtatatagatacatttctagaaggattctcaaagtgatatcagtgattgttgtgcaagaaggaaactagatatcagtgaatgcgctaaataaggtgattttgaattctgtagcatgtgtatgatttacctatagagaaagcagtctagcatgagcgtgggtttctcaaatatagaatgtttgcagtgaggtcacttggtgaaaagtatagccatgtcagacagatgtaggttcagattccaggacttccaggactgctgaaagggaaaggggctttggatctccttcagctccaggcagcattgctcctttcccagctttgacattagctggagggaagacaagttcttagagctctatgtgcttgggacaagaccccttccccctactgccttactcgccaaccataactgctgcaaacaattcttacctcttccaccccatgtcactgcctaaaacccttcatcacctggcctcccatgcctctaagtctctgtacatcccctagcctgatactgtccccaaccctcctcaactccagacaccattttactctaccctctggaattgtccattattagcaaaatctcctttattttcaacctcctttctaagtatttcccccacattcttgttgtaatagagacacagctttcccaggactgtatagctttccttgcagtcctctaaagtggtaactggtttctctgccatacatttcataccactggtcctggagatattgtcaatatcttaatgtcttccttccatctcacttaaattttgagaccataattcctttttcctctcttaaaagttctcagtgttgaagctcaatccattagatacctctagctggcactactagttgcagtcctgtgcagactactgagtcattttctttactccctgaagacttaaactctatcttactctcactctctctgacattactcctattaaaatgttatgtttctttagctattctttcagtttttggtctcctctccttcaacgaggatgatttctagaatgttggttctcaaaatgtggcccctttgcagacatcgtcagcacctgggaacctgttataaatatgaatctgcagaccacaccccagactactaagcccaaaattctgggggctggagcccagaatctatgttttaagaagcacgtcaggtaattctgatgaatatgccagttccttagatcttgttattgtcattactgacaactttctctgagaccacaatttgaatctaccaatttttcactagtactcacccatcttaagtccttactttccccttaccagccagacatttgaatattccttgactcttctctttcacatactatatccaaagagtcaacaaatgctgtcagctataccttcaaaatacatgtagaatctaacttttaacctccactgcagtcacttcagtccaagcacaaccatttcccacctggagtattgcaactgttcttgtttggtggcccttggccctactttatctactttccgcaaagcagccagagtgtttctttcaacacctaaggttatatggcttcattgattgaaattcaccgtgcttcacctctttctctacaaaagccaaagtccttgtaaatgcctgtaaggctcgagggtgatctgaccttccctggcctgtcgtgtttcggtaaaagtaagctgagtctttcatagttaaaggacagcaatattgtcctgcatgatattttaaaaacccaatcaagaatcacacattgcatttaattttcatgcctttagtctccattaaaagtgtgccctttgtattaataattggagtgatgagggacagagtttaagaatatataaatattttgtccccaactgactgtcactggatggctttggcacccattggtgattcttacctgaatcagtaattattgtgatgactgaaaatagtgatttttctcactgtataattcttctatatttattaattaccttaatattatcctatagaacagaatgttcccttctcatcttttgtttgtttagtgtcagtattactcatgaagttgggtgtttagaaaattcaatgttgtataatactgttattattcaatattgtattttctcagtttgagtcttccatctgcgtcctttcatgtaaatagtataaagatcagtaatagaggaacatagagtaaagtgtgagcagagaagccttactctgagacaaacttcagagaggtgaactctgttgctgattaagaaaggcttcactgaggaagtgttgtttgaagtgagctttgaaaagtcataaaattttgacaaaagtggggatggggtggagcttaaaggaaaaactgtctgaacaaaggaaggcccggcagactaggaatttggcaataatacagtggttttggaccttgatgaggaagttgaaatggaacataaaaaccctctgcatttagctccatttatttgctcaggcagctctcactgcctaaaattttcacccctgctgttttgctcaggggtgggatgaggggtaatgagggaggaaattttagggggtgaaaacagcacaagccaaaaaccctgctcagatactcccttctcttgaagccttttccagatccctaataagaattaaccaccctctctcacacactctgttgtactttgtccttctctgttaaccagcctctgtgttttgtgctgtctgtatttgtggatacatcttcctcctttaaagcacgaatcatatcttaatcccttggcccttcttcccagtacttagcacaagtgctcaatacatgtttctttaacgcgtgtaacagaggaaggcgaggagagtgagtgggattgggagcaggaggattctgaatgtcattttaaggggtttgggctcgctcttcaggcagcaatgagccatagccgcctttgaactgtgcagcactgaccagagctgtgatgccaaaggatgcagtggaaggggaggacagccagcatgcctgggcatggtccccaagtcagaggacatcagtgggagaagggagaaggcatggaagcaagtggctaccatcttatgaatctgagcactcattcaaaggtggcaaggaaaaaggaaggcattgagcacggttttgaggtttccagcctgggtgattggaggctgatgcaggcttcttaccaaaaagggccctaggcagtttcaccaggaatgtttaaggagtttatcatgaccctatctcttcctcgtctaaaactctccctaaaatcaaaacagtatgtcctgttgaaatactttattgtatcaaatataatgagaagtaaaatattctctctacttgatgtatgaaacactgacttcttgtagtggacaattttcacttgtctttttagtaatggtttttattaaaaatagatgttaataactgcttgtttaatctttaaacgtggccctctgagagcagcttaccgtaaaagaaacggttgtcagctttctttttgctcctcagtccctcctgccccttcctaacaacagaaaatttgctttgcacctgctccaactgggttcgaagagataagcatcttgcaagcccagaaaattgtagtatcaaatctcagccccaactgtgaggcagcactatcattgaatccctgctgagaggcgttgctttcccaattcccaaaagagttctttctcccctggccccttttcaggcttgaactctgaccgaaaccctctttttaactcccagcatgcactgcacttggtactgacactgacccatccctgcttcctctgttctgcactggactcatcagtaggtcaggcgttggtagccctggggtcactggggtgcccaattccaataatgagcacatttagctaaggagaggaaatgtacccttctatttgttacagtccattgctttttttccagaaacaaatgctaaaagaacatttgatatattgtggtttggtaaatacacatagcactgcctaatattcacaaagttgcctcttttttttgcatcttccttcataaattaaatatattgttctaactcatgatttattttaagagggatatacctatttcacagctaggaaaatgttttcaaataaagttatattcagaatactcttgcaagaatttcaaataaaaatagcaaatactatttaaatgcatataacattctaacagacttgtgtgtcattttaaagggaaagaaaaaaaatgatgacaaggactttacaactttgtctttaaaatttcttcttaggctttccaaacagaccgaagtcattaaaaatactccttaacccccaaagtcacaaaaaagaagctacccaggtttattatgagaaggttgaacctctgttgaagcttgcaggaataaaaactgatgtaacaagtaagtaattttcagaatataatttcaccatctacaaaaacatacaaaagcaaaataatctgaatttgtccttaatgcaaacttgggaaactacttgtaatatctatagcatttttacgtcttcataacctactgcagccagctcgagggttataatttaattatttttgttatttttattagaatattaatattttctctttagaattttttcagatattttttcagacttaaacaattgttagatataattacaaaggaagctgtatacttgtttacatcttcatggagatgtttgctacttacacgttaattttgcagttaggcaagaaattgattttttgctcacttatatagttgatgtctttccatggaattcttccttgggttgttttcgttctgactctgacccctggtggttaggtcaaaactaagcactgaactgctggttttattaatagatgaatttagagatgctagaagcttaaatttgttgtctaaactaagaaatgtacttaggtttgtgccaaggaaaatagaaacttgttaatgctaaacttaatagatgattagtaatatcctttttgatttttttaatttggtagtcacatttctttgtttctttgagacttattttcgtatggtggggaactgagtagaagagtcgatgctatggagaatcgcaaccttcctagctttatttctatgtggcttcgctaacagtggaaatttgcaataaattttaattgatgaaaagtattataaaataagcctactcaggggacaagcccagagtgcaattggaacttcctagtcccagttatagattcctagggaagggattcacagtgatgtggctttactcagctgtaaacaaaggagataagtttcaagatgttaataatatcattgaaacctacacctagtgatctgatggattgaggtagaagaaagttcaaaaaaaaaaaaaaagcaagttttgtaggaaggtcagcccccatgaaatgtgcctataactatagaggttcgagagaaactaccatgaaaaactcaagaggaatttttgaattaaaataaagttatagtgaagaagttaacctttatgtttgtgaccttcggcttatttagaggtgatttacaagtaaaagagaaaattcagatttatgttttctttctactgaagatttccaaagattggctgaaggaaaagtttgagatttgtattagggtgagacaattaaaagttgaataaacatattggcatactcaatgactattttgttcattgcttttacatgtgaatactacaaagcagcttaacatggatattgctatatagcattcacttcaggaatctcattgtatgcttgctctgtgttcaacatagtgcaggatgcgagatgaataagctatcatacttggatgactttctacattattagagattcaaaaaaatgcttaaaaccattataactggggtatacataaaagaactttgatgtctcagaggtgatattttgatcggaagattcaagaaaagcatttgaactaggcagtttttaagaggcagacaaaaaatgagggaaggaagtcaggctaacaggcatgtactgtaaaagttgggagggggggcggagagagagagtgtgtgtatgtgagagagtccatgtgtgttacacccatacatctggagagtttgtgccataactttgctctactttcctcagtttttacattatctgaaatcttactctatcatcataaaatagctgccagtgaatttcatcctttcttattaatatccagtgggatggggagaggtgtgcatatgtgtgcaagagagacccaacatgctttaatcctgaagatgaattaaaatttccttttttaagtttgggcacagatactgtattagcgcagtcaatctggaataatcatttatttaaccatcaagactcttcccaggggctgaggacagatccccttttcctgatgactgaaatgcctcagctgaatctggattctgttagggagaagaaagggcaaaatgacttctaggaaggctctcaacaatgtatactacaggaggtataattccaggttatggatggatccttaagctgcactcagcagtttactcatcgtgtattgatccacagttggtgtaaatttttttttatcatactgttgcaatctggtttggcaaagatgactccaccagcagaattaaaattaaaaaggaagagagaaaaagagattggagacaagaaaactgatatacaaggcctgaactaaggcagaggaaatcatctaaatgtgctttccttcttaattgtattggagacaaaactattatgttctaggatttttttctctaaatttgtaaatattactaagtaccatatttaaacataaaacaatagaatattccgtaaagcaaatttagaatttacttacatttgtgcagaatggctaattattagctgcctaacactcctcctacaggcaaatttataaaattacatcatttgcttataaaaccattttagtatgcatattggctcaatatttatgaaaaatatttcttgaataaacctgtgaatatttgaaaagttttagtcttcctgcctatcttacagtgttatttttgtagttgaaataatatatttgaaactttgtatattatactacagaaaggtggtcataatactgttagtttcagtttcaaaaattatgtcatagtaagatcgaattcgtactttatttgaaagtatatggaagagtaaagcagaaagaggacatatcttctgcatgtccagtgggacattgttttaatgtatccttgtgtgaatgggtgagtccaaatggaattggaattacaaaataaaccctatatgatgagttaattaggaaatagtgctatataaatatgaagtataatatgaagaattacagctagatatatacactataaggtactgtaattttttcataaatttattttaaaaatggatcttaccacattaataaaaacacacttctttcattttgggttgtgctgaaatcctaactacttctgaatatagatcagcatcttttgaaatatttgtgctaaagttgcatccccactctgctaccaccaccaaggtagtatcttatctaatagcatcagaaaaacttccgggagaacctggaaagaattattttttcctaattacctattcgtacacaaatcaaagaagagtatgaacgataagcccatgctggcatatgatatcatttctcttgcttctgaaacaaagcaagttttagagattgtaccattaaaggtgtgacagatattttgaggatcagagatccataggataattcatagtacaatagagtgaaaaagttaaggcagcagagaaatcagactgaaaagaactttcgaggccatatggttcaatttttctccttgtgggtggagcacaggtgtgtggcactcaactttggcttggccacctacactagaggcagagtacgttgttactggacaatactgtttgacattcttatgaatgttcagagttactgtacctttgggcagattagaaaaggcacctcctctgtgctgacttacaaaaaggtgccctttcttccagactaattcatcctttgcttataaaaccatttcagtatgcatattggctcaatatttatgaaaaaaatatttcatactttcaaaatattcatatttcaaaaatattcagcccaaggtcactagattcagcctaaagtcatttgttagattgcaaatccgtcattcccgttagccaagtacctttgtgctaggcataaactgtacaaaatgagaacttgtcagctgacattcgcctctttgtaatttttatgtactagagttaatgttatctcttgtagtaatatgaaataaatgtgccccatctattgtataggagtcattgagatatttgaagagagatatcctgtctgcccctcatctcttgttcacgataggtacttccatcgccttcagttactttttgcattaacagagctgctagaccttatcatggtcattatcattatcatactcaaagacatttatctgaaggaaaccttgatctctgccagctcagggctcttgggagtgcctagtcaccagataattttacctcctgggcagagttgtcaagaaagtggtgtttgttatcattttccccttctttctcctaaaatcacgcttctaacatggctgttaacaagcctcttcatagtgtttctctggttgtttatggctctacttgaagccttccatttcttggaaatgcctcttgcctttctaaatctcacccagcagaaagctaggccatctaatgaaactgtgtcacaaaagattccagtagcctgaggcatcactccttccaattttacctgcattttaatacaaaatctgaaaagtaaatgttcatgcatcatatctagctagagagaaagataattctgtgtaaaagattctttttgttacctcttaaataattgtgggtgtatatggccagtcctgttcccagcattcagatgtgagttaggaagttggaactttatacctggggacgatgaagactcactaatggggtatatacaaaaaagtgatatgattaaatatgtatctgaaaatggttattctggctagagtgggggagaggtttgagggagacaagataaaaggctattgtagtacaggtggagtatcccttatctgaaaggcttgggaccagaactgttacagatttaggatgtttttagcttttggaatatttgcattatacttaaccacttcagcatctctctaatttgaaaatcatggacacaggaaggggaatatcacactctggggacagttgtggggtggtgggaggggggagggatagcatcgggagatatacctaatgctagatgacgagttagtgggtgcagcgcaccagcatggcacatgtatacatatgtaactaacctgcacaatgtgcacatgtaccctaaaacttaaaagtataataaaaaaaaattaaaaaaaaaaaaaaagaaaatactccaatgagcatttactttgaacgccatgtcattgctccaaaatttttagatgttgaagcgttttggattttagatattctggttacagatacttaacttgtctacacatgaaagatatttagtgatcagatcaatcagctaatttagggaattagctgggagaaatggaggaatgctatggcataatttaaagacagaaacaactggccttggccatggagtggttctggagagtggaggaaagggacactctagaaagaagtcattttcctgtcttggggtagatgatggaacacaaaaagaacaatatatttgagagagaatatatttgaaggtatacataatggattctgttttgagcttactaactttaaagtacctacaggacaggaaagaaaatgacatttcagtatcatatcccacactagaattttatcaccaaaccaagaaatgtttccttatgtccaaatcaaatctcacctgattttatttcaggtgattttctcatcaacattgaatatcaaccttaagactttcttgtcttcctgaggaagttgcatttgcaccaaagaggggagggggaaattcccagcagtgagaattgtgttcaaagacctgtaaactgtgaaggcttcacatctcctatttagaaagagcacaggttggcaatctcataggaaaaggcaaatagatgaaagaagaggctgggttacattttttgaaattacatttatctagcaatcctttctttgtttgtttgtagggggatgatttgaatctggctgtcactgattccagggcccacaatagcctgtctaaatacatatttggtcctttctactatatttaaatagtaatccagatcactctttatccttttgcctaacattgttttgtataaccacctattacttcatattataattcattatttcattagcatatattgtctatctccagaatgcaaattcctgaggccaaagactaattcattttgttcattttgctaatatattttatagatgtagatagtcaggttcttttcattttgtttctttgttctagatctttgattttattggacttttgcaatgttacttaaaaaattgctattttcaggcaggttgcattagtgtataatcaaattccacccacaatatcaaaaaaagactattacaaattaaaaaaataaaaatagcattcaataataacacagttctaaagctcattattggatctgaaaaactttaccaatgtaagctttggtataaaagtaaggcttggtgaactgattcttagcataaatattttttcatgatattcttatttttaatgtgtatatgtaagatgttttattttgcattttaaggttgtaagtacttgctgtagttataaatgaatgatcagcacacatcttctttgataacctttcaactttattaatattaatgtttcatatgtagttttattatggctttcttctgattggaatttaatatagagaggttttattcatgtgagtgttaatggcattttgaataagctatgggagaattacaatgtaacactgctggatacagaatgattcttttagacaccaagactaataatttttaacaatatcgaaaaacattgtaggaaaagcttgaaccatgctggcaccagggacagacaagcatgaaagattaatgtaatcttgcatataatgacacacattcttacacaaaaaatccatctgcaatgtcatgtcagtcagcagaaatctttgatgggtggatacagctgggctgtctcttctggcagagctgccctggaaaatgctaaatgtggttgtgatgcttggtgccatctgcagtgtgcccgtttatcctgtcttcactggcatttacgatactgcatagggcatcagtgactgtggagacagcgatacagagtgacagattcatttcctcggagggtctgagctctggtgggcctgtgtgccaccctccttcttgggtctgggtctcttataattggtgttggctttactttgtattttcacatccaactcttcctctttttagtctaacagttccagtacacattcttctggtttgtaaatcttacactaaccttttgactaatttattcatgtaaggttgccaaaccgatttaagattgactgttcaatgccagctaatatgccttatttccaaaatactgctcctcctaagcctctgatttaaaggacatgtgtcttatttagggaatactaaacaggcaccaggacaaattgggtaaccactatgcgtgggatattcccaaatgactttatgtagttgaaacaaatatatgaccttctcttacataaagctataaaacatcaggccagtaacacttagtcctcttgcccatgattaaaatataaatattcaagaataaatgctgttttatgacttgaccatatgtttatcatattattttgccagaacaagttaaaaagtgtgatcattgtttaaaactgtcactttgtgtatgtgtgtgtgtttttttaatagtaatggaatatgaagggcacgctctgtcactgcttaaggaatgtgaactccagggatttgatgggtaggttatattattaatcaatatatgttatatcatttatgtattaaatgccttcactagttttagctacatatttggaacctaacatttaaaaatatttgtagtgtatgtactttggctctatcttgttcatatctatgtaataataattaatgataatatgacatggtcatctatctctcaggatctggcataggaaagcaaaaagaggaatctaattattaaaatactgggaaatgacagtgtactactctatacttactaatgtgcatacatttgcatctataattatttgcttttaccatatatctagagaagcactaatggaagatgttatactggtcacatggcataactatatgatgatcttcttttgcaaattaattgataggtttaatagctacccattggttaacttgtctgtgatagattgagggaagatattttataaatacaagtaaataaatacattatttccagaaacaataagaaataattttaattatctcataatgtagtgactacaatttaggtatgttattcacagtgggcatcggaaaccattgttcgcaatacattggagtgtacagagattgttcactggcatgcaaacgttagaaccaaggcaagtgatataaatttcattgccattttttaaaattaggtgaaccaatttgctaaagtgttggactgatgtgtaagactaaaacatattatattcctttagggaagttctttttacgtgagtagatatttgagaatttaaaaagttgacaagtgtgtgaattatttgtgttacatggtgatgggcagggggcaaagacccataaggtcaggaaagggagttaggtctgtactttcaccaaagtgaaaggcattaaccttcccaaagactgatttgaatgtgctggggagggaagtgatgcaatcaaaatggagtattggcagggctgtttttcagaaatgcttatttatttatttattttttggatgaggagaaaacaatagctgttgagaaagaaaatgtggtaagtaaaacatgatttttccaaaaggaatctaattgagggaagtaaatctagatagcaatattatataaacattgggaatcaaaaatatggggtaggagattacttcagaactttatacttagaggtagacaaaaacattaataggcttcatttagaaaattgtcttacaagtatacaatttaagaaaagtccttgtgggaatcatgcataccaactacctatttgaatatgctgcatagtccctcactagacctcatgagtacatgaaggtagctgcattgcaaatgagtacctgcttcaaaacttgattaaagaatgagaataaagatatcacagatattaaacttgttcttacacagcagcattacagaatgttctgctgaatgcagtatctatcaatatgttttactggtatttgtactgggtaaagggatgaaaagaactttgcagaatgaagaaagacgattgctgaagtgtagtacaataatatttttctctttacctgaacatatttaatccttatttatttttcatggcaggtgttgttatttttcagtgtagagctaaaagatgtatagatttttcagttattatattttataaaccaaatagtttggcctaaccattatatgaattgagttatgtaagtgtttctaaactctatggcatgctgatttatttcagacttacaataatttcaaatttctactgaaagtcatcttccgtgttctaagactctttaaatcaggggtccccaactccgagactgcagatgaatatcagtcagtggccttttaggaactgggaggcacagtaggaggtgagtggcaggagagggatcatttccgcctgagctccacctcctgtcaggtcagcagcagcattagattctcacaggagtgcgaaccctattgtgaactgggcacgcgagggatataactggtcatgcgagggatctaggttgcgtgctcttgatgagaatctaatgcttgatgatctgaggtggaacagtttcatcctgaaaccatccgtctcccaccccaccctgcagtccatggaaaaattatcttcccacaaaaaagtccttggtaccaaaaaggttggggaccactttaaatagcttatttatttttgtggggtcagttttcccagtagaagctgatatggtagttggagtaattatcttaataaactggcaattttaagtcactgtacttagaattacatagagagatatatgaggagaataatagaaacatagtttcttcaggtacttcaaaggaacaattctcttgcaagtaaaattgtttgaaaatggaatattctacattggtgagttttctattcctgaacctgttctaaagagtggctaaaggaaaattttgggggaaatttatagaaaaggtgcagagatgagagaaggttaaccccaaaatgctatggcattttgatgagagacagactcaaatttctttaagaactttggcctgaagcacctccgtctgacactagtggaactattaatagggagtgattaggaaatcacctaacagtttggtttctagatacaggctgaagaagttaagagccaagaaagattctatgtatagtatttagtaaagcaaaacaatttggtaagtaatgtttaagaaatgctatttcctaagattttggagttgtatttattttttttaatgaattacatatgtttctatgagacatcttgtgacatttctaaacccaacagaaacagtgtatcagcacttatgacagctagttctccactgcagtgtgtcctaggaaacactctaagatccactgttaaaccttatgagagcttcagattctatattgctccctattttactgggcatgagtaggaagttttaggaaggaaaataaaagaatatcagctgcatagacttgaagcagtaacacttgcatttataagtgtgagtatagttttaaaaatctatagattttatgcaattgtaaatatatgaattcctcgctattaatatttgtttcagaatttttaaaaaaattgttgagttacttttcttttgttcatttcaccattaattagacccataatgttgtagacattatttggattatattgacattttatcagattgaacatatctgtattacttagtaaggtaaaaagcaaaaacaaaaacaaacttttccagaaagaaaaaaaactgtgaatcaaaactacaacaatatattgaacatttcatagatgatgggttcatagataagtataaaaacattcattaaaaaaatctttatcactctttgaaaaaggatatattatcacccagtgtttcttttctagacagaataattctgtttggagccatggcaaggagtttacttattttaaaaacaagatttgtcacatgcaaaggattagttactctaaggtttatgttttagagtgacacaagtgtgattaactcactataaatgattgaatactttgctttttgcctttcttgtatatttagactcttgtgatatttttgtaagaagctgttgatgaaaaaaaccaaactgtaaaatatttaaagaggtttattttgagccaaatatgagtgctcatggcctatgataaccccaggggggtcctgagaacatgtgcccacagtagttgggttacaacttggttttatacattttggggatacagaagttatagccaaagacataaatcgataaatgtagggtattcattggtttggcccagagaggcgggatatcatggagctggtgggaaggggagctcacagatgaattcaatgattttctgattgtcagttggttgataagctttgctgaaagattagaagtcagcagaaagaaatgcttgagttaagataaatggggtggtgtaggctgggtgcagtggcttagcagtggctcacacctgtaatcccagctctttagaaggctgaagaggggagatcacctgaggtcaggagtttgagatcagcctggccaacatggcaaaaccccatctctagtaaaaatgcaaaaattagccgggtgtgatggtgtgtgcctgtagtctcagctacttgggaggctgaagcaggagaatcacttgaacccaggagggagaggttgcagtgagctgagatcacaccattgttctccagcctgggcaacagagcgagactctgtctcaaaaataaaataaaataaaataaaaaattataaaaataaagataaatgaagttgtggaagcacaggttcttgttatgtagatgaagcctccagatatcaggcttcagagagaatagatggtcaatatctcttatcagaccttaaaaggtatcaaactcttagttaaatctctcctggatcaggaaaagacctggaaagggaaggagattctctatagaatgcaaatttctcctgcaaatgatagctttgcagggccatttcaaaatatgtcaacaaaatacattttgggataaaatactttgatttcctctagggcctgctatttgttatttaatgctataccagagtcaggttggagttggggatcttattgctaccaagtctgttttgtcagtcttatgatctattttttttttttttttgagataaattctcaccctgtcacccaggctggagtgcagtggtgcaatctcagctcagtgcaacctctgtctcccaggttcaagcaattctcctgccccagcctcctgagtagctgggattacaggcatgcaccaccatgctcagctaattttttgtttctttaatagagatggggtttcaccatgttggccaggatgatcttgaactcctgacctcgtgatccacccttggcctcccaaagtgctggaattgcatgcatgagcctggccaatgatttacatcttaatgccagtgctggccatttgcgcctaaactccaaaagacaagagggtataaggaggcatatccaacctcccttcctgttatgacctgaatagtttttcagattttctttgtgaccttcatggccaaaaggggaggatccattcagttagttggcgacttagaattttatttttgttttacaaaacttatttcctaggttgagtcactttacctgaacatgatcttaatgattgaatagttgttaacataaataaatacatattttttctaactcacttaatttcacactggttctactggtaaactgtttttcaaaataataagattctcataaggctatttttattaggtttcatatatagaaaaggtatctaatatattgaataatattgtagcttctaagaccaaaatgtcttatttcaaatccctgttctattacttactagtggtacaatcttgaaaaagttactttatctttctatgttttagtttcctaatctgcaaattgaaggtaatattacctattgcatacagttatttctccacttaaatgagttaatacatggagagtgcttaggaaaatgtctgatatatatatatagtaattattcactaaatatttctttattgttataattgtcatttgtattagtttcaaaagatttaacacagaatgtattatgacaaaatttcagatgtttcagaacatgctcatagggaggccacctctaataactctagcaatatgttaacatatgcatgacgctataattgtatgcaacattctaggagttaagtgttcgcatcctatgtatgtaagggtcaagttatttggtgctaaattagatttttttgggtatgactccacatagtctttttggtcacacccatatgtcagcatttagacagccatggattgagggttacgtttaagttcacagattagaaatctcatagagatttttgaaatcaggtaagtttcaagtcaaaccttggtttttttcattcataaagatgggactgtggcctattttgcagacttctgaggatttaatagaaattagtaaacacattacctgatatatagtttgtccttagtaaacatcattccttttctctgaataggtggtcatattgcgaacctctggaatcagtttagacataagaataaaacacacctaatcaaacatgacctgggtcatatcttgagtcttctaaccagagtagccttggattgcccaggctatgtggagctagtgggatgaggaagatggggactagagggaatagatggccgagagaaagatggtgggaactgactggaaagacactttcagcctttggtcaccaccctccagagcttcctaaacttagagaaccagtaactactgctgactgtggcccatagacagttttgtttgaaatagtgtttttaaatatattgaatgctagttgcttagtatttacaaattaggagactcagccttaaatcagaatctctggcttctgtagaaaaaccagatctgggtccattaggcctcacacgtgatgtgagtgggccacagcaaagaagtggctgcgcctttagattgagcctactcttccattcctgctgggcccttgtagcccttgagttgtgacacctgctttcactgaggcaaaatccactttccattgggttaactggtgacattttgatacgtaagaatattttgcttcttttgaacataaatgattatgaaatgaatttctggtacttctgtgttattttaatggattctgcccccatagtctacttgatataaagtcttaaaaaatatactagtagtactatctaggatcaaaggctaatagtattacatctagaagcaccgtatagcaataatgtcaaggagatgaaattcaggtcaggtttgtaattactacattcatatagtaatgataattagcagtttcttaaagcttcatattttatatgatttttattgctatctgtcttttcagagctttattgagaattagcaggattttatgactttggttggtgttagttaaatgaattgcagatgacagtattattaacaagaaatgagaatgatatgcttttggatgttaacagagcaaaacgctggtcagatgtgaattaacatgttcaaaagttttcatatctcttaacacacttaaagctattttgtctatggggaattatctagttattatatttgtgaagtaaacttacctgtgttgtgtttgtgttgtcttacccattgacacatattaacatgtttaaaggtacatgtgagcagttatgcacatagactacaaattagtaaactattttgaagtctagatttcatgacttattaccaatcattctgaagttttgccttctttgcttgatttgtatttttctagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggcaagggagtggctacagattcattaaactgacccttctccctcttttcctttcttacttgctaatctagacagcacaacacagaattaatgaacagactttgaaagatccagacttctggcatccccactagcaaatgtgagacttttgacaagtcatttaatctctttgagccttatttttctaatctatagaatagggatcacagatatattattcactttattacaaggttattgtagtactaacgtttggtttagtaaagggtttaatatatagttaaaccatcagtatatggaatggttattattctcccttcgcataaaaaatctgttgattacacagtaccaggtaagaagtttcaaaacagggccactccagtctagctgcttacaattccatatgaggtgaatatggtaacttgcataattgatgtataaccagataaccttgagaatgccaaaattacttgtgactggaagggaggataaggtttggaagggtgagattcttaagggcaaggctttttaatctttctactcactgccatttttcagcatctagaatagactatgccacagtgatgctcagtgaagcctattaagtgaatgcatgtaaagaagactttatatagtaaatgacacttggattaggtcttaaaatgggttggagctggcctgaaaaggtgagaatgagttattttcttggctgcaaaagtaataaagcaaaggcaaaacccaggagtgtttgaggaatagtgaaaaggccattcagtggaagataatggtatcaaaataggcccaaccatggaggctcctacatgccacagtaaggtctctgaattgtatttgataagcagtagggaataatgggatgtttcagagcaagggggcaacctgattggagcttgttccaggaggattcattttgcctcaccgtgtggaatgattagaggttgggagcaggagaaagtagaggtcagagacacggagaaccgttagagcaacactgtgatccagaaaagagggaaacatcattcaaaagctgattgtattacacaatcactcatccctatttaacgaacggtgctgggaaaactggctagccatatgcagaaagctgaaacaggatcccttccttacaccttacacaaaaattaattcaagatggattaaagacttaaacattagacttaaaaccataaaaaccctagaagaaaacctaggcaataccattcaggacataggcatgggcaaggacttcgtgtctaaaacaccaaaagcaatggcaacaaaagccaaaattgacaaatgggatctaattaaactcaagagcttctgcacagcaaaagaaactaccatcagagtgaacaggcaacctacagaaagggagaaaatttttgcaatctactcatctaacaaagggctaatatcctgaatctacaaagaactcaaaagaatttacaagaaaaaaacaaccccatcaacaagtgggcgaaggatatgaacagacacttctcaaaagaagacatttatgcagccaaaagacacatgaaaaaatgctcatcatcactggccatcagagaaatgcaaatcaaaaccacaatgagatatcatctcaccccaggtagaatggtgatcattaaaaagtcaggaaacaacaggtgctggagaggatgtggagaaataggaacacttttacactattggtgggactgtaaactagttcaaccattgtggaagacagtgtggcaattcctcagggatctagaactagaaataccatttgatccagccatcccattactgggtatatacccaaaggaatataaatcatactgctataaaggcacatacacacatatgtttattgtggcactactcacaatagcaaagacttggaaccaacctaaatgtccaacaatgatagactggattaagaaaatgtggcatatatacaccatggaatactatgcagccataaaaaatgatgagttcatatcctttgtagggacatggatgaagctggaaaccatcattctcagcaaaccatcacaaggacaaaaaacgaaacaccgcatgttctcactcataggtgggaaatgaacaatgagaacacttggacacaggaaggggaacatcacacactggggcctgttgtggggtgggggaaggtggggagggataacattaggagaaatacctaatgtaaatgacgagttaatgggtgcagcacaccaacatggcacatgtatacatatgtaacaaacctgcacattgtgcacatgtaccctagaatttaaagtattatatatatatataatatacagccttatgaacatatatatatataaaggaaaattaggcaaaatagcattacttgaggtactcaatagcctggcagagcagacattaagggtaagagagactggacttgaatttcagtttggtacttgactttgggtgggtaattagcctttattagtcttgattacacatttaaaaggtttaataaggccgggtgcagtggcttatacctgtaatcccagcactttgggaggccgaggtagtggatcacctgaggtcaggagttgaagaccagcctggccaacatggtgaaaccctatctctactaaaaatacaaaaatgagctgggcatggtggtgtgcgcctgtgatcccagctactggggaagctggggcagaagaataacttgaacctgggaggcagaggttgcagtgagctgagattgtgccactgtactccagcctgggcgacagagcgaggctgtctcaaaaaaaaaaaaaaaaaaaagtttaataatgtccatccccatagggccattacaagaatcaacttttaaaaagtcacacattatcactaaaaaagcaaaatatttttccctatgattatagaaaataatgcacattgttgaaaaaaattcatattttgataaccctattcatttagtatggattttagaatacttagtattgttgataagttgacagagcataagatattcaaatgcccttttagagtgtaaagtctttcagaaagtcagaatttaaaaggagagagatattcagatataatctgataattctagagtatataggaaaacctaaaatggtttctaagtagaagacaccaagatgattttgactcaaagagaaaaatgatgcattttgggccatcttttcatggcattttatttcttgacctttttgctttactttagtagttctgactataatggtggaaactttccaacatttccttccatgcaaagtggatgtgcttaggacacttcattagtacttaaattcctgaggtcattcattgactgccatacatcagaaatagaaagatgggtgtccctacaggtatgcctttgacataaatttggtggttggctataaaaactggtggttattcttatgttttagtatgtaattcagattttataaagaaatagcatttagttttatcactattataattttgaagagtatttctgatttggggagcattttatgtattctttggatatttgtagtaatgccattttaacctgtcttgtttagaagacacagtatgctgccaaaattctggtcattgcataggagttctagcattctaattccatctaataggaggggaaagtcatgtgtggggtatatttaatatgatgactgtatgcctagtcagggcttttgatagagaatgggaactagaactaggcaggaagttttcaagctgaacatgaggagacagtgtgcctttgaagccatttgcctcctggagagagacacccagagggagagtgtttagtaaattaatccactgagccaacagactaagctgctgaattatggtcagactcaaatggatcagatgtggagaagcctgtatttgaactgctggccattaggaatggtgtttgttgctatgggaactggtgctaaggaactatactgagagactctgattaaaagggggagggggaatggagaaaaaagcctgagaggacataaaaataaaaaagcaatccagttgttgtaaaacaaggctcaagccacatactgatggctgtgaaccatatattcctatagagtttgcataaataaattcatgctttccaattaatttgaggagaataaaatattgccgagggactgttaatttctatgatatttcaggcaaagaaccaaagtgtaggtgccgttttcatgagaattttagatatgcttgactaggaagtcattacatcacatttatctgtttggatgtgggagacattaacagccttatgaatattcatggtatctggttaattaagttaattgttctgcagaagtgcttgcacttccaaggacattttttttttttttttttttttgcctccatagtttctccctggtatttcatcagtaattctttacatgaactgctacttctgtccttacttttttgtatttggaacattttagcagctctcaggaggaagtggtaggcaaagtttctggtagtgttaagaaaaataactttcaggctaattaaaatgtttaccttgaggtagaacatttatagcttttgtgagaacattaaaattacgccattgttatttatgtgagcagcatgttcttttggcatgtagacatcttttcaaatagagtacagtttcctgaaacaaaatgtaatccatctttcagattatcccaacaaaatatagaacaagctatcgttttgcaattttacatatactttctcataaactttccttttttcttcagagtgtcaaaaaccacatttaaagactaagatacagattaatgagtagtcaatgactaaaataattttctgacttctagtcatgtctgttatcactgccaacttctacagaattagagaaaagttgcaaagcctgagaagacataaacaatttttaaagccatctctagcattctaaaaaaattttgtacttgggcatacccaccgtacttcaaactcacagggaataaatggtctttattttcttaagtcatgatatgtgtcattctctattgcacatgacattacattatgttttttaatagcctttctagaggaatgcttttacggtctactcataattaaccatggtaatggaggaaatgtgtttcatggagtactgtaatccatcgataatcctaaatatctgactctaattatgtggcctcctccaaaatctttaccacaaatctgattgggaagcacaatggattgacttgtttcttccttttctcctgatccattccagatttattagcaattagatggtcaaagggcaggctgtagagggccacaagatcattggaaagaccttgataaagatccactgagtaacaggtttctacactacttgttctcaaaacttagggtccatagactcaccttgtgaacttgctaaaacagagatacctgggtcctccctcctccaaacacattctgagtccatgagttggaggtagaacccaggaatgtacgtttttaacaagctcccaggtaatgatgctgcttggaccatgcattccagaggagtttctcaccaagtcactgtgcatacaaaccacctggggatctaataaattgcagactctgaatcagtgtgtctggaatggggcctgagaggcaacattttaaaaataatatattttttacttccattaatactgctattactgttttaatacctattatccttatttttaaatggacaaaaattgtatgtatttattgtgtacaatgtgatgttttgaaacatgtatacattgtgaaatggctaaataaagataaacatgcataaaattgacataatgatcacatactgattttacattgagaacacttaaaatctcccttagaaatttccaagtatataatgcattgttactaactattgttttagcctgttctcatgctgcaataaggaaatacccaagactgggtaatttataaaggaaagaggtttaattgacttgcagttcagcatggctggggaggcctcaggaaacttacaaccatggtggaaggcaaaggagaagcaaggcacattcttcacaaggtggcaggaaggagaaatgctgagtgaagtggggaagagtcccttataaaaccatcagatctcatgagaactcactcactatcacaagaacagcatgggggaaaccacccccgtgattcaattactcctacctggtctctcccttgacatgtggggattatggggattaaaattcaagatgagatttcggtagggacacaaagcctaaccgtatcaactgtagtcactaggttgtataacagatctcttgaatttattccttttacctgaaattttatatcctggaccagtatctccccagtccttcccacccattagccccagtaaccactattttactcttcgcttttatgagtttaagtttttcagattctacataaaagtaagtatttgcctttctgtgcctgtcttatttcacctagcataatgtcctccaggtttatccacgtgttgtaaatgacaggacctctttaatgccaaatagtattccattgtgtatataaacaggctgattgtccctaatctgaagacttaaaatccaaaatgctacaaaattagaaatgtttgagtgccagcatgatgccacaactggaaaattccacacctcatgtgacaggtagcagtcaaagtgcagtcaaacctttgtttcatatagaaaaatattttaaatattatataaaattatcttcaggctatgtgtataagatgtataaaacttttatgtttagacttgggtcccaccccccagatatctcattacaccaacagtgtaaaagtattcccatttctccacagccttaccagcatctattgtttattgactttttaataatcgccattctgactggtgtgagtgtggttttgatttgcatttctctgatgatcagtgatatttagctttttttttatatgtttgttggccacataaatgtcttcttttgagaagtgtctgttcgtatcctttgcccactttttgatggaatttttttttcttataaatatgtttaagttccttgtagattctggatgttagacctttgtcagatgggtacattgcaaaaattttctcccattctgtaggttgcctgttcactctgatgatggtttattttgctgtgcagggattgttttcttgatttctttttcagatagttgtaagtgtacagaaatgctactgatttttgtgtgttgattttgtgtcctgcaacttaactgagtttgtttattagctctgacaattcattcatggagcctttagggtttcctaaataaataagatcatgcctacaaacaaaggcaatttagcttccgtatttatgatttgcaagccttttatttctttctcttgcctaattgctctggctagaacttccagtactattttaatgacagtggtgagaatgggtattattgtcttcttgaggaacaagacattgtttctcaactcatgagagtaattttaataagcactcaagtattgtcattcctgtttgacagtaggccgtattttgagtaacaagggtcacagcataacttgccttttggtgaatcagttggaaccagtttgccatttagttaaaataaacttttctttgcactggtattactagaagtaattgtgcttatttataattaataataattaaatatgcttattcttagttacctaaaaaattatgatattaatgacctcttggttgataatggctaagctgcctcagcttctccaatttagcaacccaagtacatatcagttcaaagtaacacaaattgaagcaattatgtatgatcacataggaatgcttctgattaacaaaatccagaggactggtctttgccttcataaccggaacacaccacatgcatggtttcacagctcttggctattattggacttacttattatattctttaattcaagaaaaattgtagcttcattcattctgttcttaataattttaaattctctttagcctcctgggaatgggaagggctagctggtatagtcccctgtatctcagatttcagttacacataaacattaaaggggcctgacttagggcgctctttgcctctgtggactggtggggaaaatccaggtgtgtcttaaattctaataatcatgaaaatcagaaatcataatgtttcaaatacaaatcttcatacatgggaaatacaattgaattaaacattttcttcaatgtaggagacatttgtcagataacagaggggattctcatttggctaagagcttacctctaagattcattaaatgtgtttagagcatattttttgtagtttgtagttattttatttttctgagttattatttggattattttctcttttatttatgtatgcatttgtcactgctccccagaggcacctcattttggcattgaagctaaaaacccattcattaaggttgggatggagtgggctttgatatagctagcatttgggaggtagaaaatagacattcgtgatcaaaaaagctgtaagcggttactataaactatttttaaatttctaagtattttaaatattgaacaaatgtgtagacatttgatgtgcatctatactgtgaataagaacttaaacttctaatattcacattaactttcctgattttataaattctcgtttatttttcatctgaacattgaagaatgacatctacataaagtaaaagcaaatgttagtttgaacacattctaccctaatagtgcatgttttaaaattgctttggcaggatctaccaatgtattggcacattctcttcatggagttcctcatgtgataactgcaacattgcacattataatgggtaagaattcttccaaagcagttcatattttataaggaaatgttgatttatataaggaaggccatcttatttccatcagactttaagaaaaggcaggttctttgtctcttagagtagagaaatgtttgactaaaaaaccaaaaggcaatgctttactatgtggattgcctgtcttttcaaaatacttgctttgtaaagagcagtaaatgaagttttattgtaatctgtacagaaaaaaaatattgtagtgtgctcaaaattataattttataaccagatgaagaacattaatgaatactccttaagtatatccaacactgatgtaggactgtaccaagactctaggactaggattatgttattaatgaaaaaacataaccagaaaaaaatttcagccagtagatgtctatagatattttattatccctattggtaaaaagcatataagctcaggtatatgtaacactaaactactgttaaatctgtgtttaccttgcctatctactttaacttcgtttctttgaccatgttttataggaaatagcaataagctgaaaaatttagtactctgtgtttcttcactagtacctgaacaagttaaaaatggtaattattgtagttataggtaaagggaactgaagagaaagtgaggatgttcatggtctacagtacctttagatattctcctataagccaataaatatgctctcttatgtttgctgttttgatacaagtcctactgtactcactgattaatatttaatgtaatattcaagggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaagtaagtctttttcttaaaccaaaaattgtatcccaggttcaatgactgttaataacaaatttcattacattttagggcagaagactgtgaaatatcatttttaccatttaacagctctgatgatgtgcaagaaaggtaggtaaaaactcaatgtaatacagataacctgtatctttaaagcataaaacattctgacaaacaattgatcagacttaggatctttggttatttttctaacatagtagtaaagaatatagaatcacagactcttacaggtcctagtaagcaaacaactactcactcagcctttttctctttttccttccttctttcctcccttccttccccctgtctctccctccctccttccgttctctttttcccttcccttcccctttctttcctttcctttgtttttttccctttctttccttttccctttcccttttcttttgagtgcctactatatgccaggcactttgaatacaacaatgcaccaaaaaatgaacaaaacacacagttttgtccctcgtgataattttggtctagtgtgtaatacaaatattaaagccatattaaagaagggttatagtctttaaagaaatagtacattattattccttataatactagtttacctttaaatgaatcaacacattatgttggcagcaacaaaattgtacgtttttacttactatctaattgaagaaagtatttaacatatataatgatgagttctctaattttctcatatttaatagatttgtgtgtgtctgtgtgtctgtgcgcgcgttatctgttttatgtctttgttttgttttctttcttttaggagggcacagggatctcccaaatctggtgagtcgaaaagtatctccttgagaactgtgccaggttctgttgacattttgttctggtgagggaaaataaccaatcactttcattacctttagactgtaatgatcaatggcaaatgatccagggtcagttcttgaatgtcagcattatggcaattccttgcctgtgttcagtggcacctagaggcttggcacctaataccaggttagtaagcatttttattgaattgttgatacatttcttatagaccattttttttccagggtatccaattaactgttggttagctagaaacttaacaggtagtttatctttgtatattagagattctaagggatttgtcatcacagtaggttgagaacaactgttgaactggaataattatcagataatcattgactatttaacgtcactgaggctaaaataatatttcctaagttttattgatagaattttatgcctactttacttgatttattcatttagttgtggagaacattatattaaatactgatatttcttgtgaatgtctttgctttccaactttaatgcaaacataaatatccttagcatgaaaatcacacatatgtatatttgatactgtattagtctgttttcatgctgctgataaagacatacccgagactgggtaatttacaaaagaaagaggtttaatggacttacagttccacgttgctggggaggctccacaatcatggtggaagatgaaagtcacatctcacatggcggcagacaagagagcttgtgcagggaaactcctatttttaaaaccattagatctcatgagacttattcattaccatgagagcagcacaggaaagacccacccccatgattcagttatctcccaccaggtctctcccacaacacatgggaattatgagagctacaagatgagatttgagtgggaacacaaagccaaaccatatcagatacttttagtcaaaagaaacatttcagttctatttaatgtgaatagtagtgcatatcaatctcctgcccacattttcaattgaataaaatatgagacatcttatatatatctttttatccatgggatatagacattccttctcttgcacattcttcttaatcagctgtccattatggggctgaaaatatttctttcctgaatccaatcctgtagagtgtaggagaaaggatcgtgagtgttgtgaaatataggcaataaacggggaaatattcaaagttagagaagaaaaaagagaaactgcaaacttcgatattgaaaacccagatggcaaggtcctcattaattacatctagtgctaaaacttcaaaggagtattttgaaccttgtgtgatttagaaattgagcctggtggttttccccgacaccttcagaaatcctagatagctgtgtgctttcataatgtagtttccctgactaaacttgaagacgtggctagctgaccaaggagctatgtttggcaggacttgagacaatgtttatctaaccctgtttgtttaaggaccttcttgggagggtagacctgctcttctgggaacaatcgattcatagctccttcaaagccactccataaatgttctgcttgactagaattccactgttgactctgcaggcttaatcagtattaatgaatttttcagagaaggatgactaattagagatttcttctgtggtttataatcacaacatgccatctttgcaaagaccttttgatcaagactcatttgaccggagatttttcagagatgtagcttctgatgattcaggatgattgaacaggagatttcactttcttctttttcccccaccatgataaataataatttatgttagaatatctcagtgcaaattgccagtaggaactaatattcttatattctaagtattctaagattaaatgtgttcatatatgtgagacatttaaagcagtgccagccatgtaagttgtgtttctatttcaagtaaatattgcaaagcaggcataggatagtgcttttaatgtttataaattatgcaattaaagatgcacagtaacactaccatgaacgttttggtgctgtttatttttaattgggaagaagaagcatgatggaaagcatactgagcacctggagtattggtgctgatgaccattttttctctgtgtgcctttgaacaaatcacttaaacttggagttgtcttttccctctacatgaaatgagcgaatgatgagataatctctaaggtcccttacagctctgacttgagctttcataagatactaagagctctttttttattttgttgttattcttaaattaacttcatgtttgcactgaaatcaagctagaagtcatttgtatgtatttctgcaaactgcattctatagcttgatgcatttgtgagtggctgttttggcactaaatcacacctctgaattttcactctcttatattggatggaacagttatgcaagattaaaatgttcagtcatttaactgaacatgtgtggcagcatttgttcactccatttcatccatccaaaggccactttgatttatttcatttcctatgtcacttagaccttctgtctataaataaatatttaaatcacactttagattttagaaaatgttgagctatttgttacacaacttgtgcatattaactcttctataatacatcttttaacaacatagtttcacatttagaatttctaattacattgtattttaaattatgtcttgatatgtgagtaggacgcttgatggtttgctttgtaaaatgctctaatgtaagagcttattgagaaggaagccagtgatttaataaaactcatttgaaagcctgcatcatttaaaaaatagcaagatacggtttatgaattttaggtaaacgtaacatggtgatttatctatcttgtccaatactttcagtaaacagtatacttgttataaggaacagtatgtcataatttttggtataatctcttagtaaatttcttgatgtctaatagaaatatttaatttcagattaaataatggaagtatggctcttataattgcccgaaacacttctcggccagaatttataaaacacctgaaaagatatgccagtgtaaaaaatcaggtatagtaaattctttttgttacttatttgcaaagctattaatcatgtagaaaaagatgctgcaagaattgacatcgaatcctgcctcataagaaggttttattttcttctgaatatattaatcttctttttcccaatctatttcatccaaattttgaaaagcatccgccaggattaatatagattggccttttttgaatgatgaattagtggttatgtatctgtaaccacaaagataaaataggaaatgtagtgttatattgcaatgtgaaataaattaaggataaaattccatactcaggctgttcttcagaatgaaaagaagtgaaatttgagagtttagccttcttgatattatggcagcagactttctaaagttatgatctttagatcttcctgacatttgtttgcatatctgcattgattgaaatagatctgtagatatgtatttaaaaatatgacagttttatacaaatattcattcaaaatgagaatatgtgaagatatacatttccacttaagtgatttgctttaaagagaaacagtaactattacaagccatattattttggcagctgttttgacctgattattaggaaaatgatccttgaactatgtgaatttctgaaattgtgagtctttgaagtacataggtatggttgtaaaaccctatagtttcacactttttctttttctttctttttttttttttttttgagttagagccttgctgtgtcacccaggctggagtgcagtggcgtgatgtctgctcactgcaacctccacctcccacgttcaagcgattctcctgcctcagcctcccgagtaggtgggattacaggctcacacctccatgcccagctaatttttatatttttggtagagacagggtttcaccatgttggtcaggctggtctcgaaactcctgacctcgtgatgtgtccacctcggcctcccaaagtgctgggattacaggcgtgagccaccacgtccggcccacacattcttaaaggtataaaatggtgcttggatagagttgggagataacagacgggaggaggaggagagtaaacccagccaatgactggcagctgaaccttgcttatgtaccttagccatagcaagtctctccatttttgcctcattatattttaaaactttcttaggccatcttcatgaagtttgatctgtcagtaacattatttgatcctcatgtattgaacaactaactgggctgcttaggaacttaaatcataaaaaattacagtcccactttctttatatgtcaaagtagatcagcaggtataatgtaggttgtgagcctacataacagttttatgtatgtgtttgggtggaatatggagatttattgattttcaaaggaatatatgccctttcacattttaataaatttctaaacattaaaaccaatttttaaaaaacccaaagcactatatattcattgctgtttttaagtcagaaaatagaaacaagaaaatgattttaaagcactcaaaattccatgttcctcaagattagtgtcattaccttggtagaattttttccgaatccttttttattaaataaatgagaagtaaagtaagtattaacctcattcatgtacctctatttgagaacttaaatagtattaacctattaatgtacccctgagaagttctgtatttattttggggaggtgtatgttgcacaaattgtttatggaaggtctcttttgaaattgcctatggggcaagtctctcaggcaatttttgtaaacattcttcttcttcatttttttaaatcaatatacctttcttctgattttaaaagcaatggttaccttacacataaagacagacatacagaaaataataaaaatctgtatcgataggaagacgttttctaagagataatattatgcaggatttatcatattttctcatgtactctacgaggcatatcttgcttttgacacaagaaacagttgcctgtgtgtgattcactggccttaactctgatttatttatcaactttcaaaaattaaaatccatgctattttttttttttttgcaaagaattctaaaatattttgcatagtgtatatagtaagaaagattgattcccagggtgactgctttcaagcaatgttaatttgatttgttaattatccacacaggtgtgtttatttaggctctttccttcatggtgacattaaaaatgtgaatttatataaattttgtaagattatgaaaatcagatctatgtaaaaatcatgtctactgcataattcatagcagtgctggtattcaggaaggaaaatgtggcaattcagtttaaggagagtaacatctgcttctctgaaccatttttaccaggttgaataagcgaatgttactgtataacactgtaaaatagattgaaaccaccatgtgcggagtggctcctgttccttccccatctctgtgtaaaattagatagaggctgaacactacccttcaaagtccttgcagctccatcctattgctttgccccccttctcactgtccacacttttctctttcattgtgaccatttttggtagggagtttaaaaccttaaatgtgagtgcttcccccaggatttctttgcagccctctcatcttctcaggatgccgtctcctggatggcctcattgcccctcacttttgaactgtctgaacatcatgcactcccaagggttctgtcatctcgtcttatctgcaggacctctgtcttcttgtatgctgaagaggttctgaaattcaccggcatctggaggccaacatgtctacagccgaccttatcttttcccctaaagttgttccttctgcgttgctctgtgcgggtcaatggcaccactttctacccatccaggttaccctgaactgttccttcttcctcattcctcactaccagtcccctaacttgttctgttggtctcctcttaaatgtttctaaaatttctccctcaccttaattcaaactttaatcctttcttgcttacagtagcctccttttggccttcaggttctctggtcttgtcttccatacctctttttagagaaacttttttctaagacacacattggatttctctcctgcttaattcttcagtgcctttctcttgttgtcagaataatatggaatatcctcagtctggaacacgtggcctttgtatccaggtccctgcctgtgttgcaaccccacctcttattaccaccctccaccacattcccagtgttttggcattttattcgttggctaaggttgccataacaaataccacagaaaagatggcttaaacaaacagaaatgtatttctttcatggttctggaggctagagctgcaagacaatgtcagcaggtttggtttgtcctgagtcttctctctctggctggcacatggctgctttctcacagcacccacaagtgagtggtctttcctctgttcatccccgatgccttttcctatgtccaaatttcctcttcttataaggacaccagtcgtattggatgagggcctaaagacatcattttagcttaatcgtctctttaaagatcttatctccaaatatagttatgttctgaggtatacagagcgaggatttcaatacaggaatttgagggccaaggggcatgatgttgagcacctaggagtcacactgaattctgtgtagttgcttgaccatggtttgcctctagttttgtaaatgcttcctctctccagactttcttctccaggctaaatcttatatgttctttaaggctcaattcaaatgggaagctttcccaacatccatagcctgtttgcctcctcttgtttcctctgttgaactccacacttgcaccatcatggcactcccctgtatcaaaattgtaactgtttacttctcctccccgtgccccaaacataccctcacacaggatactaagctcttggctcccgaaagtcccacttaacagcgtctgtggcttcacagttaaagcatttgaaggatggctagatcttcattttgtgaggagtgcacatgacaactgctgatttaagataatagacttactggtggtggctgtcaattcttgacattccttggcttacagctgcatccctccagtctctgactctgccatccttggcattcttctctcataaggacatcagtcatattggattaggtcccgccctaatgacttcatcttaagttgattctacctgcaaagaccctatttctaaacaggggacattcacaggtaccaggggttaggacttgaacatagttggggtggtggagggaaatataatttagatcataacaggcagttgtgtgttttaaatgaattatcaactaacatgaatgattatgtagataattctacaaggatgaggcatgtagccaaggctttatacccgaggtaggaggtctaacgcagttactgtcaaacagttttgcttggggccctctaattctgtacctcagtcacaacagctgatgccatcatatcatctactgtttaactgtgtttacagtataaactggaaagttggctggaccttggtatctacatatgtaaaatatgggtgttggggaaaatattagttttctgtcaacttttaaaactgtttcattgaggtttacatgtggaaaaggggaaaaactatgtagatgatgtttaattaggaatgtatctcatgtcatttttctgaaaactgaaatgagtagttatacatttctgctcaagttatttggctatattttcttaattatgtcagaaaatacatagtgctttttcagtatagtttccttaggcaaacaagaaaaaacgcaagttgaagtttaccttgcaccattctatagtggtaagtaaacagtgatcttgcagcttgtgtccattgttaaagtgggaatggggcaggcaaacaccttttaaaatccatatttgattggctttctcttttaaaagaagacatacatcccattttatcttcagaagtttagacttgcgttcttccaaattaaattccaagtgtgaaacttgtactagtttgctttatgtcagctaaactaattgacaagttgataatggattatatgtcttctgtatctacaggccagtattaaagattatctttaattgaaaaatctacagtatcactattttatgtaacttctcacagatatgtactatttgtcataaaacaagatttctaggtgctagatctaaaagaacccaaaaggctttggataagagattccttcttccaaaaaaacttggagatccctgttcatagtctcaaagctattaaaatgtcagcatacatgctgatatttacttgtgagagagggctcagtgaactttgattcgcgttagtagctagagataaaccaagtataatgattatttgtatttatttttagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattaggtaagtctatttatttcaccgcttattgtcaaccagtaaacataaatctaatattacaacgaaagctctcttctctgaactatcaaagcaggcagttggttagtttttaaaaaatcagtaaatcagggaagcataaagagacatgcacaaatttcaataaataaaaagcaactttacatttattcaactgttatgtagacccaaggcattttctttggttatgcgtgtctacattggctttctaatttattgttgtgcataaactacagataatgtctacaacttccattttggatttttaaaaatggatcaagatcttaaatcttttagtggagccatctgaatagtaaagtgttagatttttatccttccatcttagtttcctctcactcataattactgtaacatgttttgttcagtaatttgcttttattaggcctttacagagcattcaacttcccttgggaacaattttacatagcaactggtataaacaggtttaggaacctgcaaacgcattcttggtaggcattgtgacactcagtggttagaagaagcatgcaggggtgcccactagacatgggtgttctagaggcataactgactgttttacagaggtaatggagagcattggacaatcaaggaagtcagttaaggaggttttagagcaattattgttgttgatgatttatcaatcagaccttctcagttttctagattacagctctgttgggaatgctgtgtttgttatcaatttgtatttggcattggcattgtgtaccatacttattaggtgtatgtgaaaaacaacaaaataagttgatgaaataatgtattttctttacagattgcatccaagacttatcagtctttatggaggaagcatggaagaaatgattccaaagtaacatgtaattgtttctaaaagaaatgtacaaactagaattttaatataaagaaatgtggccatgctttaaacctgtggtccccaccctttttgggaccagtttcatggaagacaatttttccgtggatgggggaatggtttcaggatgaactgttccacctcagatcatcaggcattagattctcttgaggaacatggcactctagatccctcacataccagttcaccatatggttcgcacttctatgagaatctaatgctgctgctgatctgacagggggaggaactcagtaatgctccattgctctaacctcctgctgtgtggccaaacggatatcctaatagaaattgatgttactaacaattagcctctagggctttaaaagtcaagatgaaatatcaattcaaattctgtttttagatatcaattcaaattcttttttttacaatgtgtttattggacacacaaaaaaactttgcaaccatcataatacatcaatatttaacctagataattctgaaataatttggattctttcatttttcaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttcttaaagtggtagggttttaaaattcatgatacaagtaacaaagtaagttgataacaaatactattttgaactgggcaaaatctagcccaatatgtaattgtgttccccttgtatctgagaggcctgtgttggacaaccatagtactctgctttcactgtgctcagataacctgaaatatatagttgtttctgagtagttctgagtaggaaagaaccaaatgtaaatttccttagagaccatcctggagaagacagttctaaatcggggcttgatttttcatctatgatcctagatgttctcctgaaagaatgactagcctttttataacgatacaaagttttttaaaaatacataaatgtcataaagtttattcctgtgtatacacactctgggttcaggaggttttgtgcttacatttcactactcaaatgccttcgcaaatctcagaacattcctcaccatcactgcaggcctgtgaacagataactttcatcaattaggatggctggctagtggcagggacttcatataaagaaatctttcccagaattgtttttccacattgccttctaatttgatcactccctataacagatgttcaaaattcggccacagctctcttatgaaggcagagtcagataaaatgatattctgcaattatctagatcataagcataaaataaatattacaaaaatgattgtatttaaagaaattttttaaaatccagaaagtcatttaaaatagaacctcatatagtatgaacaaactataaaaatattttacatttca

SEQ ID NO: 16 - DNA, 145347 bp, Homo sapiens
  mutation 53701: a/g SNP in forward strand
attgctatttgggcaacaatatggctccttcagaactggtcgagaatttctgtggtctttgcttgaccttcaagttgggagtttcaaatcagaggctttgaagtctggaggagttcgcagccattaatccttccggggttgtgctaaaggcgtttctagaaagagatcggaaagacccgttcagcacaggcccattgcatcttctctttgaaaacgcttgtctgaatcaagtatcttatacagacccgagactgaggggagcaagagcgcaggtccggctgtggcgaggtgtccaccaccgtacttgtggtcaatgcctggactagagagccgaggccgtccagggcgggctggccagggaaccagaagcgtccctggactggctgagtgagggtgccctttccagcaacccagtggccatggttaaaaggcagaatacaaccgtcaaagaagtccccagctcccacataagagagcgcaaaggccaatggaaccaaggcctcctcgcgagaactagctcgctttgaggacaagatcctggggatggaggtggggactgacgtagtgagagggtctggaggaacagtcgtagctgaaggtcaggacatgaagaattgcacgtatggtagggatagaatggcaggtacaacttttctgtactgaaggaactgggagaggacgatccggttagggaggttggggaactaatctcaacgctgcgtttacagatgaagccgcttttatatggcgtatatgtttgcttagaggggccgacggagattaggagaagccatcctttggcgccaatgatcaaagcgtctgccaaggagaagaagccaagggatgggcctttcagagagggcaaggagtcatgctgctctggatgccagtgtcaggacaagaaatcgaaaggagcgaggactcttcactgcgtgcctcagtctccccgcttctgcctctttcacctctgtcctacttccggcgcgaaagcaggccactcgctctgatctagacctagttaacattagcttttcccttccttccctcaaatcccctcccccctctatccccgtcccttctgccgcctgaaagggttaatctctcctgcgggtaaaaacaggtccgcggagtctctaactggcgacagatgggccactttcttctggccacaaaggggccggaatggagcgctccgcggcatacaaatgggcaggtcacgtggttccaggctcttggctggaccgggaagaccatatggcgcatgccggggaggaaggaggaggggcgggggtaggggtggagggtgaggggagcggttgtcggaggagggcgggagacgagcaaggcgtggggagaagtggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaaggtaattacagttctttcatttttttgccccagaatagaagcaataactgaagactgatgaacctacatattctgtatgtgtgcgtttgcgagagtgtgtatgtgtattgagaccagcatccccctccataattgcccataagtactcacacataatgagtcgtgtcactcaagtaccccctgcaggctttctaatttaaattttaaaaatttgggtttcttttgtggatagcataggagcttcttggattttttaaaagaatgcacggtaactatgattatctgctagtgctgattttaaagtcccaaaagcaataatgacttcactttctcacttcttacagtaagaaaaaaaaatctatgttatcaatatatattttgtgtgcatgtattttacgcacattgggagtgtcaagctgtgttttcagtgaatgaaagggacatggataccttgagtattcacaccatggaaaataaatcaggttcagagatagtttagttgagaggggggaaagtggagaaagggagagggactcactcctgctacctgttaccgctccagaggcggccaagtccccagcagccactactggagccagaaattcagttgttttactaaaggctttttattttccttactagaagcggcaacttcgcggttgccaatcgctgaccattataattactcaatcttttaaagggaggtttgaggcgaactttgaaaagccccaataaagagcgggcggccctttcaatgggctgtttattagagaggagccttccgcacctgatccccggcgcgtgggagagcgctctgcgccgcgcccccagccctcgccctgcagctagcgcttttgtacaaggtggaaatttagcggtgggccagagatggaaggcaagaaaagaaaggcgagggaggggtggaagaccctgtccacttttgttgccaaatgttacattgatggtgaaacaatttggtggaaactatttttcctcctttctgcatttgcttttcagtatcccgtcgatgtaatcttcttaaaaatcgctgccagtattagtaaattacgcaatggctgttcaacttaaatcgctaagtatctggaagccaggacagaaatggaagtagaatgtgtgattttacagcttttttttttttttatggagttgtgagtaactttgaacacatttggataaacatgaagtcgctgaaatgtacagtcatttccacacacattatcctgtcgggcaaccaccataaacacatttaagttaatcactaggatacaaacacatatgcgtgagtggtgtacacatatacatattcactaccctcccccagtcctgtcctcactcctacgtactagcggggcacacgcacgcgccattataaaacactgcatttaactttttctcagaggcattcattttgtaatgggcaggtacttttcgcaagcatttgtacaggtttagggagtggaagctgaaggcgtatctggcttttgaatatagcgtttttctgcttttctttctgtttgcctctcccttgttgaatgtaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaaaccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtgagagcaattgttgcatttcttcttaaagggattctgtttttatttttggggaaagtagttgcttttttgctgagttaaaaaatactaaacactatatgtagaataaaagaaaagaaaaaagtttaccttggcatatgctcttgtctgtttatcttgcacagggagtcaccagttctatgtagataatgaaaagacctaactgatatttcattatttggaatatgggactggacggcagtacaaacagtgtgtttttttctttgttttaagtggcttagcctttaggttttttatttccatttttaaaaatgattgttacatgttttcttctatttctttttttaaaaggtggattttaataattattaacaagcaagacataaacaagtatcctagcttagtttgtctatacatttaagatgtataaaacattactattttcttggtcttctgttatctgtacatttttctgaactaaacagttttatcttgcaaactagtactgtcccagaaaaatttatacacctttaggaagtaccaaagggaaatgagttaattaatttaaagaatccaagagaagtaacattttataattgttctattaacatcttgtgatgatttccatcatttttccaagaaaaagcataatggattatttgtactgaagaacacactatttgtactgtatttaggaaggtgtaattatttcctccccccaccctttggggcactattctgttgtttcatgaacacaactcactggaaaaacttatggatgattctgtctattgttaagtccacttcaaaaaaaaaaaaacagtttggcatttcttttcctctggatgtattgactgacagtcatgattcctagggaatatcattttggcacttgtgccctggctctactgtggtgctctgattactgtcattagtaactccattgtttctactctgattcgggtgccacattggatgactaccccccttcccaagcttgttcctttaatctccttctcattggtgatttaggggttccagaaagctgacctcatttagcaagctgctccagaaaaatgtgagtaatgtaatggacaggaacaattagccatactaataacattgccaatgaggctgcgtcaagctgtgacagaagcagtaaggaatacttcgacgttaaaaaaatgtttgagagcaatttaaaatatattattttaacatgttttctatcagccttcatcacatgacagaaatacttttaagttagtcccaactttatctaaaatgcagcaatctcattccaagtgaatcagagttgttattttggaatcaagctgttgctttctatatcctggattgttctcactgttcttactttaagagacataatactgatatgatacttgaatactaccagccttccagtgtaggaggtaatgaagtgagcattcagatctgatctaacctattaagtagctcaatttcacctgcaattaaaattagacatcttcatgcaaactaaaatctgttgctgtagtgaagagaagaaataaaagaatgccattttgagaattccagcttccaaaatagcaaacagggaaatctagactgtgttcttttgtaaggtagaaatgaagactaaaagttaggttttttttttttttcttcccattttgccaatacaacttcattctaaaacatagggattctttcagtcagtcaaggagtaactcacatgccaccatcttttattcaaaggcaggcacagatgttccttctgcaggggaggatttaatttatgaaaatgatattgtttatgcatgaatgaactgcatgcactctgcataacacatagcacttccatctgatcagagaaataccacagaaccagtgccaatgtcagaaacatattctacaaatttactcacttaaatgtttaatgaatatttggaaggcattttcaaaccataagaaacattttaaattatcttcttttatgaattcctacccatatttaaaagagactcttacagtttttgtaattggctaatgcttatacccagtttgtaagaaaagaacatattttactaaatgaaaaccaaccaaaaaaaaatgctggcaagtttggcttcactggaaaaaatatttcgtttagttttgctgtttaatgcttgtcatgaataatatttgggattctatctgtttcttcatcttgagccacgactattcctatcaaataagatgcttaggtatacttgtttaatgtgaaaatcctatgaatagttatttctagaaaaagctggtatgtaaaatcagggggaaatttcataaagatgaaattgggctaaatattgtaacatgcataattactattgaataggaacacttcacataacatattttactttatataaccaattgcagctatatagtatgatctatctacttttaatcattaaaacaattatatataaattaaaatgaaagattataatatcaagagtgttctactaattttaggtttataatatgttacagtaaaataccatttgaaataaattttgtgttctaatttatcttaaaatctctctgtttttacatttgaaagtccttacattcttacaaaattaatgcattttctgaaagaagctagcaattactaaaatgatatatggatcattagctaacagtttgaatcaagctgttttagttctataattatacaagaaatttaaagtgaaaatacctattaagcaattaataaaactaggtttcaaaatattggctaattttctcctaatgggaaatgtaaaatagcaaaactgcttcttaaactacacaaaaacctcctcacttctccttttctctctctctaacaccacttatttcctgaaaatcatctaaataaaatatttaattccagggtctgatgaagaataaaagagccaatgcaacatcttgtggaacaccaggactgagaactcttgttgttaccattgcaaagaggcgttctggcgtcagatgcacagtgatttgtatggtggcataatcattggctcctggccaggcattatgtttcagaggacactattgtcaagaaccattcaactagaaatctgcactgtatgcactcaaaagttgagatcatctgccttcctatgacaggaagaattctgtgctggcaattgactcatggactctcttcacatacactaaggcttggtccagtggctctgatggaattaactgtgcagccaaactagtggcattgacaagacagggccacagtctctggggacttcaggagaaattgctaattttaaaatgcagagtattatgttaatgctggattaaatcttcagatacattaaatgtggatttggccatctaagcattattatgttatttgcccagttaatttagaggtagatggatggtgacaataaccatctctacagatccacaattctaagagatggatccaattgtgaaatgatatggagagatagagtaagttcaatctagcatatatgaagtaatttggtaactgacttttcttttaacaagatcaaaagctaacctgctttacactttcatgtctaaggacagccaaccagagagatggcttcacacactagcccactgctaagtgcttttcattcactttcatatttcatcatcaaagcaccctcctgccttatttatagatggggaaacttcaggaagttgagatacctagatatttgcattcctgtcttcctttcttcattcaggtttttctttcattgccacttcctcaaagaagcttttactgattcccatttaaaatagcaactgacttcaactccaccaaaatcactgtattgcccctccctctttccagagcatttgcctatcaaatgttatcttatgtatttacttgtatagcttaattttaaactatctatctctaggtcttctgagcacctgagaaacagagacaaagttgtctcttctgtgtgttgctgttcctctggtgcttagaagacctagaggatcctcaataaatattaactttccaagggaactgaagagcactaatgtgatgctaaagcctgttgccttaaccactatgctataagtcaaatcagttgagaatggagaggaccacaaattattttcagtccagcaagtgttataaacattaattctataaaaagaaaacaattgaaactaatttcttattatattgcatggcaccaaactccccccacttcctttttgaggatcatgagttgtctgtcattgtttctttttattgatatcaattggttaaatataatctggaattggaataaaagaaaaactattataggctttttccagaccatgtatttcaatgcatattattttttcctttctgttcattattctttcagtaattgcacttgttctatttttagtgttatgtaaaattactgtagctcataatttctattttgaagggttcagtgtataaacttagcacatcaatactatctttttagtgttcgcgctcaatggtgtcagttaagagatcaccatcacttttggtgacgtcaatgaaggggtattgcaatgcttaagagaactgttaatccctttccactggtgtcactaacaattgtagtgcttgtttattcatagcaggtacgtgactaagtaatgttaacatcaaagcagaaagaggataatagagtgttctaaaaagaaaattcggtggttgggtgcagtggctcacacctgtaatcccagcacttttgagaggccaatgggggtggatagtttgagcctaggagttcaagaccagtctgggcaatatggtgaaacctcgtgtctacaaaaaatacaaaaactagtggtgcatgatggcatgcatctatagtcccagctactcgggaggctcaggtgggaggatcacctgagcctggggaggtcaaggctgcagtgagacgtgattgtaccactgtactccagcctgggtgacaaagtgagaccctgtctcaaaaaaaaaatgatttgagataacatcacttgtcattgtttgttaactgaataatctttattctagccagtgcctaaatacataataaatgatagtacaaatggatataaattataactaaacctaagtagtgatatttatcacaatatttctttactagaagaatttctttgttaatagaggcaaggctacttgtttagataccttaaaataacataagatttttggataaataaattaatgattctttgattctgactggcatattaaaaatattaagcgaagagatctttgcttcccaggttttattttttgtctaattaactactggtgcatttatattaaaacatattgtcaagggaaaacgtatatatatatatgtgtatatatggtgtgtgtgtgtgtgtgtgtgtgtgtgtgtgcacacatatgctatacttggttgagtagtatccccttcccttgcccacctctctcccaaatttatgtccatccagaacctcaaaatgtggcctcatttgaaatattgtctttccagatttaattaagatataagatgtaaattgatacaagttcatgctggattacggtgggccctaaatccaatcactgatgtcctgataagaagcagacagaacacacagacacacagcatacaggaagaatggcatgtgaaggcaaagacagagactggagtgatgtgtctacaaatcaaggggccccaaggatttggggcccacatcagaagctgggaaagagacaggaattctcagcttctccttctgaatccctaagaaggaatcaaccctgctgacaccttgattttaaacttcttgtctccagaactgtaatataatacatttctgttgtcttaagctacccagttgctggtgatttgttatggcagccctaggaaactgataggtatactaaaatctctaatgaattgatgttaaatatatataagtataggagagttcatttaaattcttctgaaaatgtcttcttaaacttttaatgatacagtatataacaaccagtatacgtagttggtatcgggtttgacatttaaacaagctgacaaaaaacagctgtttaataaacatctgaattatataaaagttttattgtttattattcatgtgaatgacttaaactgacatctacatttagtgaagtgtgaatgggcctagccaataaactatgggtaatttttttaaagtctcatctttgaactcacaaaaaattatcaaatatcagctattatgtattcttcatgtgaagaaaatgtcatatttatttgatttgtggattagcatatatattaatagagcttttgaaagaacaaatgtagcactttcccgatttcatagacactcatttaacacacaagttcatattttaaagtacataattttaaaaaaattctagtccaaatgaatttaagtgccatgacttctaaaaattctgtctctatttttgggttttataggaccttgagccagtactcttctggtgagcttaagaggctaagacttcacctttagttatatggggctttcatctgattatttgtctattttgattgctctaaatacaagttagtgtgtatttcatctgaatgtatttcattataagttttggttttatgtagatctggggatctgtcttgtttttaatcttgattggtctgtttgttttgggatagttggtactttcatttcttatgcttgctttctttttcattttgtgcccacctttagtcaggtgaacatcagtaaggaataaaattttatttttttaagccactgaaaaaatttaaaaaccacatcataactctgcctctgctgactgataaaaatgctaacttattaagacaaaatgttatgcaagaagactttattggaatagagaaacatcctttttatgtaagaaatatcaacagagacatgtgcctttcttgtgacaaatgtggtatgtgtgtggattagaggtctggaatgtggcagcatttcagtacttggaggggagaattagagtagggtagaaagatagacggggagcagaggatgattctcacccagtagaaagcagagtgaagaaagaaaggggaattgttttttgcattatattatttgaactgtggattaagtctttccataagccatccctacgcctctaagtaggttttattaacttaagctggtttgagatgggtttttggtcacacacaagaattgcctgatacaagagaggctttgattttgttgttgcttgctcatttttatacactaagatggagaaaaccctggacatagtgaagacgaaattgaggaaggtgttgggtagagtggagggtagaagacctgtaacataggtacagaattacattaaactggaaggacttatatccagatataggagtcagggtagaaagagagaatgttagcagtaagggtaacagagtagcagaagtttattcttaccaggtcctgttatgtgacagtggaggcatgttgaccttctgactaggggagttaaaggagaacactgaaggtttagaataatgtctctaaggatagaaagagaaagtttcatcaagactcatcaataatagggcagcagggcttagggccaagcaaattcagagaccatgatattatagtagtttgtagtggtcttaatccatctaatttttcagcattttctcaatggccaatacttagcagtggtagtgttttatggcatttggacaacagaagtgaaagcactggtaagagagacgttgaagtgaaacaccatggggctcagaaaagcagagttgatccatctggtacatgggcaaggatggtcctgaacaattctgcagtaagttggaagatagaaaaaatacctaacgaacttgtagatctgggtaaggagatttttggcagaatattgtaaggctaattggcttctcttaactatatgagatagggttttacaagggagagataagcgagcataatttagaagaactatagggggtcccaggcagactctctggctggaaaattattctgatagcaagaaattagccccaaagcaaagatgaaaagtagggtacttccaattaaacatgtcataagggcaagcctcaatcaagagtgtggctagaaggcacagctcacctggacaaaagtgcttctaagcatattaggagcatataccacaataacctgacttggacccaaagttgagagaggccagtctcaaaaaaatttgagggaattgcttttgcataatatgatactttatatacatatctgttacatatcatatatatcatattaaaaagaaaaaaaaccctgtttttccttccgttctttcatataacccttctgacaacaaatgtggagtttttcacacactaagcaattctttagttcttgctggacacttcctggatgtcctacaattcaactcgattctcacacaactgcccagagtcagtgcagacccgcagattaaaggcttagccccaaaagactaccccccactttagatgtcaatcacaagtctcaacttcatttacttctgaaggacgagctatacattggaggaaacccctctttctttcaataatttgctagaatggctcacaaaactctgggaaacatttacttatggttaccaatttattataaaggatataactcagaaacagccaaatggaatagattcatagggtgaaaaatgggggagaggcatggagcacaactctctcagcacctccatgtgttcaccaacccagaagctctcagaactccttcatttagggcttttatggagctttatcaagtaggaatgattcatgaaatactggcattggtgattaacttaacctccagcccctttcccctccctcaacattgggggtgaagctaaaagttccaactctgtaatcacagggtgagcttccctggcaactagtcccctgatccttagggggcttctgaaagtcacctcattatcataaactcaggtgtggttgaaagggatgttttgaataacaaaagatgcgcctttttcctttatctttctgagttgtttcaggagctagggacaaaagactaatactataacaacaacaacaaaaaattcaatttttgcttttatctcttgggaattacaaggattttaggagctctgtccagaagccagtgatgaagatcaaaatacatatttcttattatatcacaattcacacatgtacatgatatccgtaagataagtgaactacataaagtaagctcacaaagtttctgtaggagttttgtccatttacaaacagtttgtaagctaaaagtatctgtgacaagcctcagtcaatttagaagttcatttttccaatgttaaggacatgcctgtgacacagcctcagaaggtcctgatgacatgtgcccaaggtgatcaggctacagcttggctttatacatttagggagacataagacatcaatcgatacatgtaagatgaatattagctcagtccagagaagcaggactactgaaagtggaggcttgcaggtcacaggcagattcaaaggttttctgattgggaattggttgagttattatcttaagacctggaattaataaaagggaatttatcatgcagatgaagctttaggtagcaggcttcagagacattagattgtaaaggtttcttatcagacttaaaagagtctgttctaacagtctttaggtctcagtgttgatgttaatgctggtcagctgtgcctgaattccaaaagggaggagagtataatgaggcatgtctgagtcccttttcccatcatggcatgaactagtttttcaggttaactttggaatgtccttggctgagaggaggggtccattgagatggttgggtggcttggaattttatgtttggtttacaagtttaacattaaaagcctctgtacctccaatgttttatggacaaaaagaaggctgaaaaagctacttggctgtaatcatgggccatttcttgctgaaaagaagaataaaatggaggcagaaccaaaagcccagaggctagagccaagagctgctgagaatgatgaattagggaaccactctcagagagcagatctggatgtgagataggaacattttctttctcagggtctatgaaactggcaacatatgctctcctgaatttcagaattgctatggaccagtgactgtgatatgctttctatatttttcccttttgaatgggtgcatctatcttgattatcctctgtctcattattgtatgttggatttgtgtgggacgataacatgtgtttttagttcctaggttcccagaataagaggagcacactcaaagagcgacatttatgagatactggatttttcacttgatatcataattgggtgagacttgaaagaaagtgaacatattttgcaaatgggagggatgttaaccactgacaaccacacccacagggtccactgtattagcctatctgcaaagacggctgccaaaaattccttctgtccatatatacattcccttttttaatgtgactgtttcacctgccagcaactgaagggctttatttccatttccccttgtgacttgtttgactaacagcaagaagcaaaagtaatgctattccaattctagacctgggccttaagaggcatgacagcttctgcttttactctcttgaaactcaatgtcattttttaaaagctcaggctagactactcatcatgagggaccacatgaaaagagataggcccagctagtttccacccattccagccgctccagatgagatgccagacatgcaaatgaagccatcttggatatttcagccccagctgagcttccagctaaatgtaagtacattcagttgatacctcatagagcggaactactgagctgacttcatccaactcacagaatcataatgaataacaaatcattgttgctttaagtcaatacatttaaagtttttttgttatccagttgtagatgaattatacagcctggggggaaaaaggagatagcacactgttagttgcctcatcaatattcatccccaaattctttttcctttttagtaggtctcacctcccacctggaagctgaaaacacctttcccagtctctctggaagctacagcacaggcatgttgcccaattctaaacaataggacatgataggaggtctgctgggtgggatttttgaaaatatttttttttctggttaagaaaaaagaaatgcccaaggaaaacctacaaatgccccttccattcttgcttttggacattttttgggagagggtatgatgcttagcactcctgcagccatctcggggccaacaatagaatccttgttgctacctggtgatagtgaagtagaaagctacaaagctcttgatttcttttcttttttttttttttttaaattttattattatactttaagttttagggtacatgtgcacattgtgcaggttagttacatatgtatacatgtgctatgctggtgcgctgcacccactaactcgtcgtctagcattaggtatatctcctaatgctatccctcccccctccccccaccccacaacagtccccagagtgtgatgttccccttcctgtgtccatgtgatctcattgttcaattcccacctatgagtgagaatatgcagtgtttggttttttgttcttgtgatagtttactgagaatgatgatttccaatttcatccatgtccctacaagggacatgaactcatcattttttatggctgcatagtattccatgctgtatatgtgccacattttcttaatccagtctatcattgttggacatttgggttggttccaagtctttgctattgtgaatagtgccgcaataaacatacgtgtgcatgcgtctttatagcagcatgatttatagtcctttgggtatatacccagtgatgggatggctgggtcaaatggtatttctacttctagatccctgaggaatcgccacactgacttccacaatggttgaactagttcacagtccaacagtgtaaaagtgttcctatttctccacatcctctccagcacctgttgtttcctcactttttaatgattgccattctaactggtgtgagatggtatctcattgtggttttgatttgcatttctctgatggtcagtggtgatgagcattttttcatgtgttttttgactgcataaatgtcttcttttgagaagtgtctgttcatgtcctttgcccactttttgatggggttgttttttttttcttgtaaatttgtttgagttcattgtagattctggatattagccctttgtcagatgagtaggttgcaaaaattttctcccatgctcgtgggtaggaagaatcaatatcgtgaaaatggccatactgcccaaggtaatttacagattcaatgccatccccatcaagctaccaatgactttcttcacagaattggaaaaaactactttaaaattcatatggaaccaaaaaagagcccgcatcgccaagtcaatcctaagccaaaagaacaaagcttggaggcatcacactacctgacttcaaactatactacaaggcttcagtaaccaaaacagcatggtactggtaccaaaacagagatatagatcaatggaacacagcagagccctcagaaataacgccgcatatctacaactatctgatctttgacaaacctgagaaaaacaagcaatggggaaaggattccctatttaataaatggtgctgggaaaactggttagccatatgtagaaagctgaaactggatcccttccttacaccttatacaaaaatcaattcaagatggattaaagacttaaacgttagacctaaaaccataaaaaccctagaagaaaacctaggcaataccattcaggacataggcatgggcaaggacttcatgtctaaaacacgaaaagcaatggcaacaaaagacaaaattgacaaatgggatctaattaaactaaagagcttctgtacggcaaaagaaactaccatcagagtgaacaggcaacctacaaaagctcttgatttctaatgacatcatatgggatgaaccaacccaggaacagcctgactctggacctcttttaatgtcagaaataaaatcttatttgtaaaccactcttagttgttcaggttgttgacacaggcactgaagtgcctccaaatggtgatgaataatgaggcaaaagtcaaagacagcaagtctagtgtcaaattttttgatgcctatgggtaagaagttcaagaaagtgagctattttctttctttttaaaatttatttttatttttgtgggtatatagatgtatacattagtcagctattttcaatagtgagaagggatgttgccacttagtataatgcctttttcatagctatcatagaaaccatatatacatatagtatagaaaatgaggatagatttctgacttaaactgcctatttcatttgtgtgcctggttacacctaattcaagactctacaatacagcattgctagcaattactgtgagaatatttcaagctccctatttgctggaaatacatttcatttttttgttccaagtttatgaatattagaacctatctaaaaaggagcttttaaaaacttgaggaaaggaaaagggagggcctacttttcttgcctgtgttatttcttgttactgctgattgagatgctagagatcatattgggtgagatgtgtcttagaatacagctgagcaattcacttttaacagtttccatctgagtacaaaaaactggtatgtgcagaaaacttgatattctgacttggcgggattctaggatttgttctatttttttctgtaattgttgtagggacatatggccctgtaccttttgggcagcaggagccagaatagcaggaacattctgacaaaattcccactcagcatgagagggaagcagtccccttgatacactgatgatgtgcccacttagcattacaagtgtttgagaggtggacacaactaaaactcacctcactcaaaatatatattgacacggagaaagtaaatacaatttgctgttattaacctttcttctcaccattgagacatgttaaatatctgaaattaataaaggaattaaatttaaaaagtttacttatcatgcatttaacacatttattgagcatctgttatataaatgcactgtttcaggcacaagagatagagccataaataagcagattaaatcactattctcaactgaggtactaatctgatataagagaggagacagaaataagtaaacattataaatcaactacatacttttacatggtgtaaagtgcaattaagaaaatattattgaatagaggtcaattttggaatggttgggcagggaagaccttctgaggtgacaagaagttggcctgggcaccatggggagctctaccatggtgaaaagtgttccagacagagtagacagcaacagcagaggccctaaatgagaatgcacttggcttatctggagagtagaatgaaggccagtgtggtaggacacatactaataataggagaaaactgatagaaaagagggtttgagcaggtgggcaggaattggacaacatggtgtctcatatgtcataatagaagtttggattttattctacctgcagtgagaagttcttaataaaaaaaaaattctataaactggagtttgagaaagaactatgttgatgatagcataagccctcaatcacttgtcacataaactccaaacttcagcagagactcagggagatcaaagggactaccacaggattacccactggctaaaattcagatccatggcagttggtcctgactggaattagacttccttgtctgttgccctcattgcagtgggtctgaatgtctctgtcggctgtgaatttttctccctctatctgtggcactgagaaggtggcccagacttccagagtctgtctcattggcctattacttggggatttgctgcccttcttctggaagtttgggtatttgttttcagagcatacttaaaggcctcctgaaagcaatgttaacaatagcaggatatattttacagtcttctactcagacttggatttttaagaaccagggatggagactgtgtttccagatctagtcaaatcccttccaaacataaagcaacaaagtgccttttaaactaggacctgtactgtttaatgctctggaaacaaatacccaagcttcagccaaaggagggaaagctatgttcaggaagcttcctgaaagttttttgaaagcaattttcatgcattagtattttacatatatatatatatatatatacacacacacacacacacacatatatataaacatatatatatatacacatgaatcactaatgagacaattgatcttcaggaactaacgtgaaataattggggtatcttggtattattgttatagataaatgttgaagaagttcattctttcagatattaattgagcacttactgtgtactaagaactgtgatagatactggggatttaatggtgaacaagataaattctctgccatcagggggcttatattctaacaaacttaaaatttactgagtgttctctgtatttcagtattgttactaagtacactaacttagtggggaagctagacaataaacaaagaagtatgtaataagaattaatagtaagtgctgtaaagaatactaaagcaggttatggtagagagattaatggcagcgtgaagatgtccatgtttcaatccccagaacctgtgaatatgttaccttacatagcaaaagaggctttgaaaacataattaagggttatctgggcaggcccaatgtaatcataagagtccttatctaagacgggggacaaaggtcaaagacagaggaaaagagacgatttaaggatagaagcaaagaggagagatgttagactgctggctttgaagttggaaaaagtgaacatgagccaaaacaaacaaaacagaacaaaacaaaatccacaggtgacctttagaaaaggggtccccagtctctgggccatggaccagtacctgtctgtggcctgtttggaaccaggctgcccagcaggcggtgagtggtgactggtggacaagcaagttttaccacctgagccctgtctcctgtcaggtcagtggcagcatcagattctcatagcagcctgaatcctactgtgaactgcacatgcaagggatctagtttgtgctccttatgagaatctaatgcctccaaaatgctcaccccttcaaactgcccccatccgtggaaaaactgtcttccacaaaaccagtccctggtgccaaaaaggttggggactgctgctctagaagccagaaaagaggagatatattttcctctagagcctacagaaggaatatataggcctgctggcaccttgattttagtcctgtgaaactgattttggatttctgacctccagaaatgtaaaacaatgcattggttttgtttcaagtcactaaatttgtggtaattagatacagcagcagtaagaaatgaatacacaggtttacaggatggtgaattatggagggtgctcaggaatggcctctttgaggtggtggcctttaaacagaaaaatgagcaaagtgaaagaatgaaccatctggtggggagaaaagcattccagtcagagggaacagcaaaagcgaatgctctgagaagggattattcttctcaatgtgtttgaggactggcaagaaggctttgtgtgaatgagcaaggggaaaaagttagtaggtgatctcggagacatagccagggtccagattataaaggacctctcgccttgctaagcattttgactttattccaagaataatgggaagtcaatggaaggctgtgagcagggttatatgctctcgttattttttaaaggcacaatgtaactccaaaatggaaaattggctctgggctggaggtgccagcacaggggaaaccgaaagcagagagctgggttgggagagcggagactgaagttgtccagctgaggggtgcagaagtgcagactgcaatgacagcaggcagaaaggactatatgttctagacagaatggacaggatttgctggtagattggattgaaggcatgagacaaaggagacatggatgatatcaaggattttgatactacagatttgaaacattctgagagggacaggtttgtgatggaaaatcatgagtctggttttagatatgttttagaagcttattggacagccaagtagagatgtcaggtagggagctggacataatacctaaagttcaggagagtggttggagctggtgacatcatttgcagaaccctggatggtacataaagcacgggacagtgtgtggatagatcctaaagagagccctagggcactccagccctggaagaaggcagcttatcaaaggaaaaagaaagaaagaaggaaacacaatccttattacttccatcttcaggacaattcaaagccagtgtttttgacttcctggcttgagtgaagcttgaaaaatggcaacttgcccctttgcaaagctcctaaggagtagccattggcttggcctgtttgcactggctctgggtgagcttttaaaatgccagtgagctctaattgtgttgattgcctaacagctgtgaatacaagatgctgactccagaactgcaactcattctgcgaagggcaccgtccttttccctctaatgactgctgaacagagccacctgaagcctgcatggggtttagcagcagctgcacttctgctctaagaaatagctcactgcagtcagatcaaactgaagctcttccttgcttttcctcgaagcttgggtacttattgtcggagcattaaacagtaagagtcctagcttaactggtgcacagtgctttatgtttggtagggatttggttaggcctacaaaccgtctgagctaagaaccttgagaaactcctgctatagttagctctttctgtgactctgcagtgtgaccaggaatgaggacagaattaagaatttgctgcctctatgatagaactgtttaggcactagaacactggaactagatctacaaccctatgaatttaatttccttttcaactcccctactccttcttttcaatatgatgataatgatcttgtttaaaaaaaaaaaaagccttctgctttacttcccactctgctcctcttcccagggactcactttcttcttgactgcttccccattacaagtactcagctccctgttttatcaccctgcttagagcagccattatcagccttggctgaacattggaattacctgggaacttttaaaaatccggaagtctgggtctcgcctccagagattccagcttagttgtcttgagcgtggcctggacatttgggttttcaaaagttccctatgtaactttaatgtgcaaccacaattgagaatcactagcctccagactctctgtgttatcaaaattaatgagcagctgattttagaaatctcagttatcaggagaaaagggtgaacccccccagggctcttctccttttccaggtgacacttctttatggcagtgcgtgaaagtgaagccctgctgcttgtaatctccctcaagggagtgcaagatccaggcaaagacaagactgcagaggcgctaccttgggggaaagtaggaccctaaatacttacacctggaggcacttacctttaatactgaatttgtcagatgcaaatttgtctatgcaaaccagggccttatctctagcttcccctcaggggttttgggaagtgcgctactactctgaaacagggttgtaaagcgtcacctgtgctctccagggaaccctctggaaaggaggtggaaaaacagaggcttccacccttgcaactctaagtgtgttccttggccagtgggatccatcacctagtattttcttagatatgtggtatctgggggccagtcccacacctatgcaataagaatctccatttgaacaagatgcccaagcgattatatgcaagtttaagattgaggagggctggtttaactcgagggtaacgaaaagtacgaaatcgtactttacaggagaagctaggcggagggagccacttattcttcctcttgcagctgggtctttttgtggtgagtggcgaagcggcgaggctggcaggccagggtgctggactgggtcaggcgcggccccgcctccctcctgggtccctgccctgcgcgccgttgctgtggcagcgctggacgcggctagagctggggctgccgcgccctccacctccttctccaaaggcctccccggacccctggctcgggcccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgagtgcccggccccaagcgtcttcgcctccctccgcgcttcctccctctccccggcccaaggcctacacccacgagcttttgctccaccctccccttttctcgcctcccctccccgtgctcgcctcactgcccggacaggttaccgagtccccaagtcgccgcctcctccttcccaactgggaactcacgcctctcgccccatcccagaacccccagggattctttcgctacctagccttttcccgcctccgagaccttccccgggcaaacgtcacaagcagcttttgctcagagtctcagcagaaaatcttgagccccaaaggggaggtaatttacaaatgtgagaaggtcaactactcctcccctccaagttgaaaaagttttaatccattaactttgatggtacattgaaactataaacatctcacagattatgcctacacaagagttctgaatccaactctcattttgctgacttgaaaatgtaactccagagctttgggagtgtttctgggtttttttctgcccctcaccttccttgccattgtctagaattaagacttcttcaggctcggtctagaaacttttgatttttaatattgaccctagattattggatcacagttttgcgatgcttagttacgtcaagcggtttgcttaacgtttgccttttattgacttaaaattttagttacctaaaaaagttataatgctgtagtttacaacaaatacttcgagtctattttcacgtcttagtcaaatagccttatagacttaacagatattttataaagaccattttgcaagtcttataagtagactttcatatagtcttatttctaagtccaaactcgagaaatactccccattgttgaattagcttagatgtgagcggtgaaagacagatgaaatgggggaggaactacatcaaggttactctacttgcgaggagatgacttgggggagatggaatttggtattcaacctcttttagctaaatacaaatttatgaaattaaaaaaattgccttcccctgttggaaaacaagacacagtgtggtatttatgttacagaatagactcactgtcttaaagtcttgctcaaaagtctaacaaaatgaaaccaactagccagggattcagcactggttgcgattgtgaattctgcctgtgctgcatgtgccatgctcgctcgcttcacgaaaacagtctttgaccttaaagtgttttcaggtgttttaaaaaccaaggtgtagtattttcttgaaccttttaagttaaaagctagggatatagctatggaattatttgtaagtctttcaggcaattcgagttatgcaatatagaagtttataattacagtttggattagcccaaagagccagtttaacctacagtgcagctgaaatgctatagaattaaaatgagacattgtgcaatgagaggtcatacaaaccaatgttgcagtatttgtgtacaaaaaaagcaaacaatgacatgagaaaagaaatgctgttttatattgagtggtgattaaggtaaaataggtttaattagtgcacccctggcagtagagtttaaaatacatcttgacagatttgtaactttaaaggttgcaagtactgattctttgtttaattatgccctaaaaccatttggtggtcttttccttcatacaggtgtaccctttttctttgtaattaatacctggtattcaaaccactttgggcctctaaaattgggggcacagaagcctagagccttagtaagtacttctgtttatggaagaaaccaagagatgttttatttaggtaaaatatagccaggcgtggtgtgtccctgtaatcccagctacttgggaggctgaggcaggtgaattgcttgaacctgggagttggaggttgctgtgagcggagatcacaccactgcactccagcctgggcaacaagagtgaatctccatctcaaaaagcacaacaaacaaacaaaaacaaacactgggaaataagaaggagatattaagagatgatatatttaaatgttagaaatgctctgttgttgaataagcttagatgtgagtggtaaaagattaaatggaagagggagctacatcaaagttactgtacttgggaggacatgatatggtaggatgtggtggggggagagcatgtccattgctggttggcaagtgactggctgcctcagaaaaggatgagggtgggtaggggagatcactggagattattagaacatacgtatgttttcaagattgcttagtttttaaacctcatagtactttgttttcactgatgaaataaaatactatgtgatctttttctaattttccatcttgagtaataagcaaagacattaatgtattttatgaaggctctgactgccaaaattgggacaaattgatggtcttgttggcagggtaaatgagcataaccgtagtaattgtagttctttttattgggttcagggatgacctggaataatggatgtgttattacccttccctgtagaagtgaggctttcgaaaagaggctataagtcaatttgggaggcacaaagtatcagcgctttttggggattttttttttttttaagtagagaaatattttaaatgtgtgatataaagttatgcatgtgcttcttaagcacattaactcaaccagatccaacagctggtctaataactttttaattgtttaaaaaaatttaattgacacattgtaattgtatatatttatgagatactatttgatgttttgatatttacgttgtacaattatccaatcaaagtagttagttatccttcacctcacactttcattatttccttgtgggttagaacattcaaaagactctcttctagttattttgtaatatatagtattttactgttaaccatagtcaccatactatgcaacaaaacaccagaatttattcttcctacctagttgtaactttgtgtcttttgactaacctctctccatccttccttctcccctccccttcccagtctctggtaactattctaatctctgccttatctatatcaaccttttataatagaaaaagattctacatgtgagtgacatgtggtatttgtctttctgtgtctgggttacttctcttaacacgatgtcctccaggcttagcattcacaattgacaggactttattttttaatggctgactagtattccattatgtttctgtatcacattttctttattcatccattgttgtacgcttaggttgattccatatcttggccattgtgaatagtgctgcagtaaatatgggattgcagatctcttcaacatactcattttatttcctttggatgcatacctggtagtgggattgctggatcatatgatacttctatttttaattgttttaggaacttccatgctgttttccatattgactgtactagtttacaatcataccaccggtgtgtaagtgttcccttttctccatatctgtgtcagtacttattttcttttgtctttttggcaatagccattctaactggagtgaggtgtatctaattgtggttttgatttgcatttccctgatgattagtgatgtcaagtatcttttaaatgcacctgttgatcatttatatgtcttcttttgagacctatcaattaaagtcgtttgcccatttaaaaaatcaagttggccaggcacagtggctcacgcctgtaatcccagcactttgggaggccgaggcgggcagatcacgaggtcagaagatcgagaccatcctagccaacatgatgaaaccccgtctgtactaaaaatacaaaaattagccgggtgtggtggcacatgcctgtagtcacagctacttgggaggctgaggcaggagaattgcttgaacccaggaggtggagattgcagtgagccgagatagtgccactgcactccagcctggtaacagagtgagacttcatctcaaaaaaaaaaaaaagtcattattattttatctgttgaattaattttcttatatattttggattttatccctttgtcgcatgtatagattgcaaatatttttctcccattctgcagctgttttcactttgttaatagttttcttcaaggtgcaaagttttttagtttgatgtaatcttattttgtctatgcttttgaggtcttattttaaaaatccttgctcaggtcagtgtcgagaataatttcccttttttcttgtaatttcatagttttcaagttttacattttaaatctttaatctatttttatttttgtatatggtgagagggaggggtttaatctcattcttctgcatgtgaatatctgattttcctagtaccatttgttgaagagactgtctttttcccagtgcatgttcttgacatcttaaaaattcagttggctgttgtaggtgcaaaaatttatttctgggctttccattttatttcatgggtctgtctggttttatgctagtaccatgctgtgttgatatagttttatcgtatatttcgaagtcaggtagtatgatacttccagttttgttctttttgctcagggttgctttggctatttggggttttttttgtggttctgcatgaattttcagattgtaacatttctgtaaagaatggtgttggtattctgatagcaattgcattaaatccatagatcactttgggtagtatggccattttaacaatataattatttcaatccatgaacatgtactatcttcccatttattgatgtgggaagataatttctttcatcaaagttttatacttttcagtgtagagattctttcacttccttggttgtttatttctaggtatctttttttttaaaaaagtactataaatggaattgttttcttgatttttcacatagtacaatattagtgtatagaaatgctactgatttttatatgttgattttgtgtcttgcaactttactgaattctaacagttcttttgtggagcattttgggttttctatctataagatcatatcttctgcaaacagggacagtttgacatgcttctttctaatttggatgctcgttacttctttctcttgcccagtttatctggctagaactttcagtagtatgttgaatagaaattgtgtaagtggccatcctttccttgttattgatcttagaattgatctcgttattggtcttttcccattcagtatgatgttagctgtggatttgtcatatgtggcctttgtgttgaagtacaaactttccatacctaatttgttgggtttttaatcatgaaattatgccacattttgtcaaaggcttttaatgcatctattaaaatgatcatacagtttttgtctttgttaatgtgtatcacatttactgctttgtgtatgttaaaccattcttgcatgcctctgatcccagtgatgaatcgcacttgaatgtagcaagttatctttctaatgtgctgttggatttggtttgctaatatcttgagaatttttgcacctatgttcatcagggatattgtactatagtttcctgtgttgtattgttatctgattttggaattagggtgatgcttgactcatgaaatgagtttggaagtattccctttgcttcagttttctgaaatattttgagaggaattgatattggtttgttaaatgtttggttgagttcagcagtgaagccattcgtttctgggcctttctttgatgaaagactttattactgattcaatttcctcacttattattggtctggtcagattttatgtcttcctaacttaatcttgataggttgtatgtgtcggggacttcgttttttctatgttatcaaatttgatgaaacttgttgaaaaccaactctaaattttgttcatcttttgaaattatttttagtctctatttcatttatttctcctctgagttgaattacttccttacttctaccaactttgggattagtttgttctgttcttttttttctttctttctttttttttgagatggagtttcgctcttgttgcccaggctggagtgcaatggtgtgatctcggctcaccgcaacctctgcctcctgggttcaagcaattctactgcctcagccttcctgagtagctgggattataggcatgtgccaccacacctagctaattttgtatttttagtagagacggggtttctccatgttggtcaggctggtctcgaactcccgacctcaggtgttctgcctgccgtggcctcccaaagtgctgggattacaggcatgagccacaatgcctggccgattagtttgttcttaattttgtagtgccttgaggttcatcattaggctgtttgtcagaaatctgttgtcttttttgatatgggcatttaatactataaacttacctcttaaaactgcttgtgctatgtttcgtaggttttgttatggtatattttcattctcacttgtctcaagaaaaattttaatttcctttttaatttcttcactgacccattggttgtttaggagcattttgtctccatgatttgtgaagttgtcagtttttctcattgttgatttctagtttatttcttttctttctccttccttctttccttccttccttccttccttccttccttccttccttccttccttccttcctccctccctccctccctccctccctccctcccttctgtattgctttgtctcccaggcccaagtgcagaggcacgatcttggcttactgcaatctctgcctcctgggctcaagcaatcctctcacctcagcctcccaagtagctgggactacaggtgtgtgtcactgtgcctacaggtgtgtgtcactgtgcctggttaaatttgttttttgtttttgtttgttttgttttgtatgtttagtagagatggctttcgccgttttgccatgttgcccaggctgttctcaaattgctgggctcaagcaacctgcccaccttggcttcccaaagtgctgggattacagccatgagccactgcacctggcctgatttctagtattataacgctgtggtcagtaaagatacttgatattatcttaatcttttaaaatttgttaagacttgttttgtggcctaacatgtgatctctcctcaagaatgttccatgtgcatttgagaagaatgtgtatctgcagctgttggacggaatgttctgtaagtgtctgctaggtgcatttggtctatggttcagcttaagtccaatatttcttgatctctctgtgtgtgtttgtgtatgtatgtctagataatttattcattattgaaagtgggctgttaaagtctcttactattattgtattggagtttatctctttaggttgaatatttgctgtatgtatctgggtacttaggtattaggtacatgtatgtttataattgttatatcctgttgttgaattgatccctttatcatattatgaccttctttgtctctttttacagtttttgacttaaagtctattttgtctgatatgagtattgctactcctgctcacttttggattctgattgcatggaatatctttttccatttcttcactttcagtctgtctttaacggtgaggtaagcctcttttaggcagcatgtagctgagttttttttccagtcctgcagctactttatatcttttcattagataatttatttacattcaaggtttttattgataagaacttatttctcccattttgttacttgttttctggttgtcttgtagattctcagttcttctttctctcttgtttacctctgtggtttggtcattttctgtggtcctaagctttgttttccttctatctcttgtttatgtatctgttgtaattgctttctttgtgggtaccatggggctaacataaaaagtcttgtagttataataaactattttaagctgatagcaagttaactttggtcacataaaaatactctagacttttttcctccgccatccctaatttatatttttgttgcctttatttctttagtatgtgttccctagccattgtagctgttgttgtttttgaccagttgtactttaaaccttcatctagaggatcgacaggtttacatagtaacatgatatcactggggaattctgagttggatttatacatttacctctattggtgaggtttatattctcacatgtgttcatgatagttatcattttttcatttacagctgtagcactcctgtaaacattgcttgtaaggctggtgtaggagtgaattccctcagcttttgtttgtctgggaaggcctttattctcctccaggatagttttgctggatatagtatcttttgtccttggccgagactcgtttttttttgttcttttagcatcttgaataaattatccctttctctcctggcatacatcagtaatttaatgttactgatgagaaatctactgatagtctaattaggattcccttacatgtaacttgatgcttttctcttgcagattttagaattctctgtcttcaacttttgacagtttgactataatgtgccacagagagaatctttttgggtttaatctaattgggaatctttgtggttccttcatctggatgtctatatctcccccaatatttgggaagtttttagctattatttcattaaataggttttctgtgcctttcttcaacttttctccatctgccagttctataatgcaaaaatttctttgcttagttttttttaaactttgggttatttcacaaaacctattttcagattttgaaattctttcttctgcttgatctggtctattcttgaagctctcgattgtgtcttttattcactgcattcttcagatttctgtgttttaaatgatagatcttgttttaatttctcattttataactttcctgatttcattgggttgtttgtattctcttgtagcctgctgaatttttttaagatcattatttttaattttgtttcaggcattttataaacacccttttctttggggtctgttactagagactcactgtgttcctttggcagtgtcgtgtgtccttgctttttcatgtttcttgtgacatctgcacatctagtggaatagtcacattttccagttgtatgcagtagctttcacagggagagacttttcctgtagatgggtcctagagtgttggttgggtatggtacattggctttggtttggggtggattcagtaccatggtctctgtgtagtttcgtcagctgtaatcttcacagcaatgtctgatttcctcagtggcctaggctgcaggagtttttgatggtggtatagttttgctagggacaggcatgtcatgctagttgtcaggctggacacttgcaggctcggagggctgacaagctgtcttttgggctccccagggaagagaaagtatgattttccagcttttcttctatgtttatttaaaactttgttgtctggctcacagtgttctttatctaaagtctagccagtggtggtggtcatattgcaatcattattacagcttcagactttctagaccttttccattttagtgaccttcagccttcattcgcttccattcatgaccacagaatagatgtagtcatctctattgaaggcaaacccatcccatctcttcagcttcatctagaaatttgtttcatctgttacactttctttctttggtttttagccttcattctctaccagctctttcacttaagcagagatatgttcaagactctcccattctaacagttccctgccttgatcctacaagcttttctctttagctgctaccttgctttttatttttatttttttctcacttgctctgataatctcctagaaaaattggcttactctgaccatctccattagttcacctcttaattattcttcaaccatctgagacctggctttgttctttctctactgaaactcttcaggcagagattagcagaagtcttctaattgctcaatgaagtggaaattttcagtccttattttctgtatttctccttcatttgactttgacttaactctcttggtttttgtaataccaccagcacctagtttatcagtctctcatgggaacttcattctatctgcctgccaaatggtggagtcccaaggactgtggtctgatctgctgttcctcattacatgctttctggtcagtattgcacactgtggttctcatctaccatcatctacctccagaagtgccatatatttagtaagtttacaagaaaagcaactttccttgctccgtagactaactctgatcttttgttccctatcatggttatggaactcactaattattcagcatcagctgtcagaatgtttaactttgctatttaggtttgtgtaagttatgggacaataactaggataactagaattagcttgtagcttatgtgggttagataatacaattgcatatgtaagtagtgaatattttggcttaataagtgaaggagtatttaggaagctatctggaatgttatctaagtcaggattctgaaggtaactctagcctcactgtcccttactcactatttctaaacacccaccaatcctgcctactttatttacttggtatttctccaatctgccatccttctctgtccgaccaatcactaccctagctcaggccttcaaagtctctcacttgacctactccttcacctcctttgaacctgtgcacaaatgttagcttcttagtaaggctttctctggtcacctgtataaaattcccatctgctacatacttcctggttccctgtattgccttatattcctcagtggcatttatctccttgtatactatataatttctgatctctgtcctttctattaccaccccacttcaagatggcaaggatttgtctgttatattagtgactgtcctaataggaaaaaaaatggcacatttatattagagtaacttgagaagaatttttaaaagtcagtatttataaagctgtagatatagagatagtgaagtactcttgggactagtaatcattgggcaggtgataccatttttaagcccaaaagggcatagtgaaagagcaggtgcctgaacctggattcagagagactatgtagaggaggccactaggcaggagctgtggcctttgcctcagcttggctgattacctcactaatcctcactaatcctaaattacccaagttccttcttttctggcccatttcacagtccaaagccaactttaagccagagggcaaggggagcacttgatgcagtccatgcagtatggcctcccagtgaacagggcaggtggaggatagaaactaaatctagatggaggagagggaagatattcagaatatgttttttctttactgtcagcaccttgaagagtgcctggcatatagataatatttattgaatgaatgaatttgttactggtttactggcctcatgaactttagttttgcctattctattataacttggtgactacattcctatatacttgataccaactcctcattaactacaaaggcagtattcccctctccccctttttaaacatcaaaactcttttttaaaaaaaattcttaaatgaatcgccagtatataacacataaaagtatgggtgccttgattggagtggtgggtaaatgatcctgagtctgtctgtttgggttccctctttgcctagcaggaatgtgactgtcttgtttaaagcccactgaagtagaaaacaggatgagagacacactcttcaacatggcataagatttccatgcttggctcctgcctatctctgcatcctcatttctcagtagtttcctcatattttaccatcctgtaattgaaagaattacaaaactagttctctacacaagctttcttgctgttccagctgctgggaattagcttcctttgtgcttttttttatttgaatgattcatgtttacattcattaaaattaatgaagattcattacagttgttttctctttaggcataattggatctcctatactgagacattgaatgcaactttgattgtttttttcccccattatatgttaagctccttgaggttcttttcaactttgcgttattccaggatttctatcgtaagagttaaggttcatccacttctctgatgtgaggttcatggcaggaaggttccatgttgctcagctgcagagtagaaaatactgagcagggcttaaatagattaggatgctgccattataatataaactgtgtttacgaaagagcatcatcaattcagaaaatatctttttcattgactacagtggtgcctgatgatctttctattacaatcttaaattatggtcattttaattatagaatcatacatgggtttatttatgttaaaataaggtaattatcaagctagctgtgacctatgagaaaaatcctgaagaaatgatgaagggatcaggtgactgtttttgaagtcaagtgtgaaaggtcagaccactctgggtcatgggaccctgccaaggcagagcaggtcaagtgctgtgcccagtggggccaacccccagtatggtgccagggactgggtgtgagaagtcaaaaattaagaatacacctcagaaaggggacatggacagatgccacagacttatttgcgtatttcatgatttagcccttagcttgtgctgatactggatcagatattttcagagttcagtattttcaaaagcatcgctgatcacctgttggcattgttttacatctcaaccaaggaaaaacttttgggacatctgtttaacaaggggtaagcttttatttgaaatgttcgattaaagcagaagagtcaggcatttttttgtgcctccccaaagaaagatttgtttactgtcctgtgtgaataaatataatgtcattatttcccgtaaaggaaaagctgatggggagagtaagtaatgggtaagattaggcaatgttaagctcatatattagtatgtttaagagtgatcaatttagggatctctgtgacagagatgccaaatgctcacagtgctatctcatgttggaaacatgtgtctcctccacttttcctcagtcctctgaaatgacggccctttagggattgacagatactatacagatttctgtgctgatatgtgatttgtctaaaacaaaagtttcacaaaacaattcttaccattgccatttaagagtcactctgatatgctctgtttccattgcaaacaaatgctcattatgatttgtgaaattaacttcacaatttcctaatggataacaccttgaagtatgaaaagcactacaggatcttttatagcttccctcctccagctctctataatctgctcccatctgtggtgtaggaaagatttcagcagtggccgctgaaggccctaagatcttgtctcaacagatagcaaggtgcataacagactttggacaggttgtttaacatgtctgagttactgtttattcactggcaaaatgaagggcttatattatattgtctctaagtactatcagttctgaccacctatgaactttcattttaaagaaaatacctatttctatggcctttaggcattagggaattttgtcaaattaaataaatctcagtaaggtttgatggtcaatggggcccactgtctggtgtgtgtggaggggtgttgtattttacatcaggaacttcagagccctcatgaatttctaattagaggaaccacctgggaaatataagtcaaagccctttgctcgccttactcagctttagggcacagtgactagaggtgggcaatcgctttggtgtaggtattgtcattggaaaggaagaaaccattttctggaggaaaagaattggttgaggctagctttaagcagctatttcatgatggacaaaaggactagctcatccattcttcattcgtttctctgtatcctctatcaaatttctgagtaaagattttatacaatgcttgattagcattcaaatagtatgtttcaaagattttaaaaaaaataaaactaggcctttgaatcataattatggcttataactctatttttcatatacttactatctcaagttacaaatttcatgttatgtttttttcaaaagagtattcctgccacaactcagagctcagctgaattagagcagtgactagaaaatctgagaaggctgagcttcaaaataaggtctggaaagtgtttcttattgttacaagagagtcaaaatgattttcttgagctttaagtttatgtaagtatttacttgacacttagcagtttaaaagataatgtgcaaaaatatgaaaatgagaaaaaacaatttcaaaacaagagttggtgattacgtgagacttagtagagcaaagtatattctaagtattaatctgtctaagctgtttgggaacagatgtacgtgaaatggataccgggtgttctgttgtgtacaccccaagtgagacatctgttggtagactgtgtggtcagaaataatggaagcaggggttaaaccccaatatgacctattactcatgtgaattattgaaggactaattactcagtaaaacatgatgctttgattcatcagtctacacgttaagaaaaaagcctctttagaaaaaaatttagttctgtttctaagctgtcaaatttgaggaaatttttaagatgtatgcaaagactcaaatttccatagtaactgcaaatactatctgcttataaagttttaaaatgttttgacaggtctactaatttatcataaaaatagcctcaaaagttttagctttttgttagggtaggttgggtctcacagaaaacaaatgtagagtgaattttctaaagcagggctgtccagttagacttcctgaaatgatgggagtgcactatatctgaagtgttcaatacagttaccaccagctacatgtggctattgaacagaaacatggctagtgtgactgagaaactgaatttttaattatatttaatttttattaatttgaattcaataactgcatgtagcaagtggcaactgcattgtacaacacagctctgacacatggagagttgaaaatgtttgtttactttcttcccaagttttcattttagtctttgtttctacatagaaaggaagatatagcttttgaaaaatgaacctgaatgtagaactgatatggttatgcaatttgagctgcctatttaaagataaagcaactgagtttagagatttcaaagtggcagagtcctttaacatatttcgtgggctggccacggtagctcatacctgtaatcctagtactttgggaggctgagatgggaggattgcttgagcccaggagttcgaggccagcctgggcaacatagcaagaccccatctcagggaaaaaaatatgtgtatatatatgtatatatatatatatatatatatatatatatatatatatatatgcatacacatatatacatatatacacacatatattaacatattttgtgtgtacaaaaaatatttttattatgtgtagattagttggttactagtaaagttgaagtcttgtctatagaaatcattgtatttttcatggtcattgtgatacattgtttgaactgaaatttggcaaattcaatctgtttcttactacaagaatagtacatagatttgaaatggtaactctcttagtctgtgtactctgaccctgtgaacgtctggagactaatgttattcctaaatatgctatgtccacatggcagcatctgaaggcaaacactttttaaaactgatctacttttgtggacccttcctctctctctttcctgcatcccggatggggccctctggggctggaactggcacagaactattcccctaggagtgggttcattgaagccaagggacacacaaattgagaatcagatagactggaccaaggtcattaaaccagagagggcaatccagatggggttgtccaaagtaggaagttctgaagtgaattgcagaaatccaaacatggcaaagctaaaggaatagagaaccagggcaatggatatagagaacagagcaattgggtatgcaggaagatgctattgcctagactggatgtttttgtaccctctgtaatttgagaaaatggaccgtccttgttgaaatggtcagggatgtagtagataaattcattgcagttgtgtaatctcagcactagaatactgatcataaccatatcacttgttatcccacctagcctgccacttgattgggttattagattacatttcagacattgacaagtctacaagcatcattaaaatcctaaacacagacttctgaccgtattcctacccaagttttagaagcactatgccaatgacgggggtagtatatgctgagcaggtgagttttgattgtgtgtgtctacatgtgtacgtgggtgtggtgagcaacaggaaggaactctcagccatgactctaaatgctcttgtgttggccaaaattggtataagctaggaggagaaacacaaaggagagagaggcatgaagttgaaggacattaaaccatttgcaaacttttggcatgcaaaccagaatatgaggaaacttagtgtaatgggtgactgaattcagaggtagacaggcaatcaggaaggtataggcaccaaaaatagttaccattggtgagcgtttttgtttttgtcattggcatggtgttatgaacttatgttaagcctaagggtaagtctaaaataatgtaccagctggcatcagggaattcccatgtacattcctagattttcattagaaacagtgttctggaaactaccactgctgctacacagcagtgcccagtgcttgactgaaaatagtgaacacttagatttgtttactctgccaggttctgtgctaagtatcttatcttgtttaaccttagcaaagaaactatgtagtctagatagaatttttatccctagggcccagaggtgttaaataacttgcccaaggtcataccagtaatttcagttgctggggttcaaagctaggcagtctgactccagagcctgcactgtccccatttggttatgttgcttccccagttaagcaagcaagagtctatctgacatctgagttggtggtagtaaagcatcatggtctgaaccaaaataataaaaacctttgaaacaacattatctgacttctttcaggcttttaagacagttccatcatcaacagcttattccatttctctggccacttccagtttctgaacaaatgaagaaaatgggagtgataaattggagtttttaacaagtttttttaaatctaattttttttatggaaaccaccaaacatacccaaatgtaggaataattatgtaataagtcctcatgttcaaccctaagaggggtgaagctctatgtgacccattactgagtttaaacagttttcaatttatggccagtcttatttcatctatactctacccacatcccttcttcccctggaatgattgaagtaattcctaggcatcatataatttcatctgtaagcatctcagcatgtatctctaggagataaagattttctaaaaaatcatattactactcttcaaatttaaaataatctttatagttttacatatccagttagtgtccagattttcctgatattttctctattttttaaatatgtcaaccttgaaatgaggtccatattatagctgatggctatgccttttaaattttctcatccacagattcttcttccttttttttcctttcaatttatgttttgaacaaactagtttggcctatagtttctcatgggcaagaataaccttcagactgggatggccatcactctgatacccgtaaaggggatgaggcaggttggggaagggagagcctcagaccatgatcagatgtcacaagatttttgcttacctagggtgaggacttgggaaaaagattgcccattaggagtcctgccttgggcaaaagtggccaaacttcagctgtgctgtcacaggctgtgggctgccttggaaatgtaggacctcaactcctctgaagttgaggtggagcttgagggtacgaatccctggtggccattataatgactacactcattgggatggcatggcaagttcatcctcaaagatggatcctagcatccaccatgaccaatgaggtttttttattgttatgatcactataaactcaaggatttaaacctattaaatgtttttcaattcacagcaatgattatttttactgatcttcaaattgtcacattttggatttttagaccaatgggagccccttcatcttgacttctgagttcttttgacattcactcagctgtctgatagcttccctgctttctggaatggcaagatattccaggttcatcttgaacatttcatgcttgagatatggaatcaagctcatcatcagagggtcctggttccttttactggatagtggtattagagacctcaatttgagaactaagcaacatcattgctaaaacttcccctatgtgtaccttgttacttaggtttttcaaagaacagagctagaaaatatgttgggtttttttgttttgtttttaaagaaaaaatgtatcataggattatgctgatacttccaattcaagtgcaggcctaagcttttcacattgtctcttttctcctacccttaaagtcctgattcctaactataacaacatcattactcatttgctttatcctgcattatgtagacacaatagagtaacaacaccaatgctgccaatcaaaagtataattactgaaacccacttaagatagtcctgcaatttttttttttgttcatagagtgtacactactagggaggtgtagtcaaattactatgttttaaagacacttggaataattcatatctgtgaagttatacccccaacttatttgttttttgtattattgtttcattttgcttttgatgtttaggcatttcttttttaaaaatcaattttataattacgtgaaatacttatatggttccaaaatcaaatctactaaacaaactatattctaggaagtatagcttttatgtttcccttctatgcttttccttccttcctgtaggtaggaaagcttatttgttcctcaaagctctgggttgttcttttattttatataaataaacatgtgcatatattcttttcattacccccacagtacccaccgtcttaaacacatgtacaatatatgtgtttttctaccttgatttctttcttacttagcaatatgcccagaagttcactctgtagcgctttacatcagcatcaaaatccattatgtactatcgtttattgacctctctgttggagaaatttggattgtttctagtcatttttgttatcgcaaatagtggtttaataaaaaactttactttccgttttttgtttttcaatgtgcttttaggatagatgcctagaagtgagattgttgagtcaaagaataaatgtgttaataattttgctcaatattaccaaattctttcaaaagggttgtgcaattttgctttttaaaatcattattgtataagggcatgtatttcctgaaaatttctccagaagagtttattgccaaactttaaaaaaacagcctgatacataataaatgatatctcagcatagtttaaatttgcatttttcttgttaaatcattcatgtttttactgtagtcctcctaacatttagggagcaccaattatggggtctctagaaggttccaggattctgtaatcaatttgacatgatttctgtcttcagatattcacaatcttcaggaagatatattgacaaaagaataactacatgatctattttgtgtgcaacttagtacttacagagcattataaatgcacatggaaaaataggtaaaggagaaaatcattctctgttgggcgggctgagggggaagtcaggaaaagctacagagaggttcgagggtaaactttaatgtgggccttgaagtatgatttggagttagcaagacagacaaaggagcaaggaaaccattctagaaaaagaaaattttgaaaaatctccagaaaaggatgctttggcctatttggaaaataacattgtcttatttatgggggagatgacagtgctttgtttttagtcagtagtttatacaggactttgaatagcatgcaaggaagttggcgtctcaacctgaaaattgaggaaggtgtgacaaaggctgggcattaggtgagatcaagtatttctgtttttttttttggtaaattaggtagcaggatagattataaatgggctccacactgaggagcccagtgtgatggctgatccagcagatcagggggcagtggctgcaaagctgggagaatggcaaggtaagcctggatgcaagggatattgtcaaagacaaaatttgggggatgtgaggcttaaaagggaaataaataatggtgatggtgagatttctagcttgggcagtgggatagatagtagacgctgcgcaaattcgtttttaaatcagcagaatgagaagcatcttatttgaaatatattctaccaaatcttagcatcaaatgtgctagtgactagcaaaatatgtaaacagaagggaagtagcttgaaaagtacacaaactggagaaattgctcctgaaggactgtaagttgaacccttttaagcctaagatctgtatttcctatgagccctaggctctttccttgtgtatcctgtttcttattagagtagaggctacttaaaaataatcatagtttaaagcgctctattttcagaaaacattattcattagatgttagtaaataatgtaatctttatacattcataatatttctgcattattggagtgtaaaaagtcagtgaaatagtcatttgtaaagatgtcagtttttatctgtggaaaatagctgttcataccattttaagcttaaaagttcttcatttacttcttaaaatatccatgttggtattattttgtctaatacaagtaattaatatttaccccaaattaagcttttaagtttactaaatgttacaaacataattcaaagcactgtttagtgtccatctgtgcaggaaaaataagatcaatacaattgagcagctgttagcatgtattggtttccttatattttaagtatgttttcatgttttgaaggtgtaaagggatgacagtatgttttgttgtggttttcatcatacagataaaaacttattacagttgaaatcttggtgaacataatacattttaaaatttccattcctcacccatttatctagatatttagacacagtaaaataaataacatggatacatttttgtcatgtgatttatgttttttaaaaagtagaaataaatttctctaaaagttatttttattttttaaatttagcatttttcatatttgaggaaaaaacaatatgtcttggtaccctagcttctgaactaataacacacctgtcattttacaggttattttaatgtttttcattgggatcaaacctactctggaaatatctcatgggtgagctttatttttatgaaatgttcttggcacttgaagacctttgtaggtacatgccagactcatcttacatccagttcttctgcatggaaaatatgtgcattgaaattctaagtgccttttcaaatttgaccttcttagagaataatatgagtcccaacaattaggaaaactatggaatgccttttggcctttacttttcaaagattttcagtcagtaatgtttaattagcattcattgtgtacattgtccttttttgtgtgatatggctagttccaaaggaatattctagaagatctcagccttctgctattgaaggtgataatacactactaagttatgtgttgctttacattaaaataatgttgcagcagttacttattgcttaactagcgggtataggacatcaggttgaaataactgattttgaagtgaagagttcttgtttatatcttaaactaaccaagtatgttcattaactttgagaataacaatgatctttttcattattcttgagtagactggataaatcagaaaacccatgttagaggtccctgtaaaaacttcagtcttatttggtaagtccctttataagagtttcaataaaatcaggtaaatttaaactctgaaaattctacgtactgtctatcatgttcaatttactgttaaccagtactatgcactggaaaaaatttttttcaccttaatgagaccactggtcattactgctgctactgatgctcttttgtctgcacatactgttgcaacataatgtgttgtgcatttgatacggatattatcatattgccataaggagctgctattattttagacaccaactgattccatgatagtgtcagatttctttaacatatgcttatgtttttgtacaaatgaccccaagaaacatctgctagttttgtggtggtatctactgtttcttttttagaatttgacctgtcagtcactttttaacgtgaatctacaatatttgagttgtattcctttctcgtttttatgctattgatattaacaaaattgagtcagttttatggcataattcagagagaaaccgaagctgtctatggatgttattttaaaaatacctttttcatgatgattgtgcctttaaatttttgtcattgattgacactttaaaattgaaaagtgcccttttaatggatcctttaggttccaaaatcttaagttgaaaatttctgtctattggtcctgaaagtactctctgaatttgataagtatgtagtagttgtggtgtatccttggtcagtttatatcctgtgctaattgctaatcttacttagtttctttgatgcgtgtgtgaagacaggcaaagaaaaaggaagtggaatttctacaaaactgtgaaatctttactttatggagactagagaaatttctaagtaaaagaagacactcattctattgtagttaggatcccttcttttacttgcttttcatgatcttgactgaaaagcaacaattgagatttccattgcccgacgctttctcttctgcttttctttttgtttctcttgcatttttaaagacagctatttattcaaaaacaatatgaacttttatttattggacttaaacctggaacatcaacaaaacaaagaacaaacaaaactacctttccaaatttattttattagaggatgctatcaatacaattttgtattatgttcacacttgataccaaacctaaacccaagaaagtgtgtcctgtgttacagcctatccctctgtttaagataataactagaacaatttacttttattttctactcatctgctttctgtgtatcagctgttgtcctccctcagcctcgaagcatgtcatcatttccatctccgtgctcattcagtcatccttgctgctcttagtcccctttttgtcccttgggtgacttatgtcattaggacaaccttctgtccccacttggctgaaactgagctgaggcccttgccagttgcattaggtgtggcacctttcatggctcagtttgggcctctgtgatatctgtgtgccttctactccaaactccattctgccagaggtggcagggtgactggaagctttagtttcagtgacaaaacccaagcgtggctatgctgagtgtctaagtagctttcatttaggcctgaaataggagagtcaggcgcctctgtgtcccctgagaaagagagatttccctcagctctctgggcccagcactcaaccatttaagtcagctggttagtataatttccctaaattgtggtttagtttccctatgagtaggactggagtaggaccaagtaaggaaagtccctagtgacctttctgcctcctgaggagcaggccatttactttgagttgtagcttcccatctgtctgtccccactaccctatccaaggccctggaggagccacaggatgagggaggagattcatggaaaagcgccttcaggtactgggtatgtctggagtaacatttaaagtttaaaagactctttaacaattttcctctgatacttactactgcctatacttgtttggttttagtacagtaagttttgcctatcgtgggggtgaagaaaatagaaatattcccattaactttgtatggtgcttggtatgacaccctgaacaggtgcacccgtaattgtttacttgatgttctttttaataagtcaattatatcatcggaaattgaagaatagcaaagttaatttgtttaatcattctatgggaactcttgcatgctcgttcactagaggaacattgcgtttctcccttaaaggacaaggctttgttttgtttttaataagacacactctttataattaaaacaaaatcccagtgttaagggatttctgttttaaataattggatttctttcctttgttcctctaatccctctatatgagaaaaaaatctaatggtgtcttaggataaatatttttagattaaaaagttctcttaaccactgaaatttaataatacttctcaaagtttatggatgatatagaatgtaatgtaaggttgagaattttagatttggcaaaggcaaagatacaaaaactagtgaaaaacaacaaactggaaacacttttaaaatactgatgtatttatctttgcaataaattattcagaaatataaataaactcactatttacatagttttatttaaatttgtcctcaaaatactaaatttagtactatatattttcttctttcagataaatgctttcctgaaaatggtattttaatatctacagatggtttagtttaacaatggttggggtaaaaatgacatagggaaaagcaaaatgtgacagcccagcttggttacctttagagaaactcagaataaactctattcccatttccttctctttcccctttccatactcgagagcccttttctgagactcttaagtcatgtttgggccttggagaggataaatagcagggtgggtggtaaaaggggagagtgctttgcttgaggcaaagttttcctccatatgggaccttcctcaagccctcccttcaaaccctttaaatgagagcatgagctcctaggacagaggtcatgtggaaagcagcattagcatgaaggggggtgctgtggaggggtgtaaggtgcaaaaagcagcattagcatgggggaaggtggggtggaggggtgtaaagggaatgagatgtgaagtggttaaagggccatttttctagttggcctctgggctttgatgaaccttttccagtgtgcctgtttctccacttagccctgggctaatcttgactcttaactttccaggtgtgtatctatgctgatttctcctgggtttggaagctctgagaagctctggttctagttcaatcacaagacttttaaagaaccagaaaaataaaacaattttttaaaaagtaatgaagaaaagacttttaaagaaccagtgaaaacctgggagtaaaaatatagaagacttgagaaatttcatctttacctttcaagtgggcagcatgagaaattcttgtaaatggtgctttcaaatcttacacaaggttctcagttacctttatttgtactccctagactgtattgcatcccttgctatgttgactaattcccacctaaaataattcaatggcctcccaatataatctggcattctaattaataagctaagaaattatttggtttttcactcattggcgttaaatattcttcagtgcccacatttggaaatattggaacacagaaatgaaaaaagatacaatcagtttctctgcttgccatgttttccttgatatggcaatacgacaacaggtcaccctttgaagaaaattcagagatgctaaagtagaaattaaaactgaagataagtcaaggcaggatagtataggagtctgctacagctgccatagcaaaatactacagcctgggaggcttgaacagaaatttatcttctcacagttcttgaggctagaagtccaaaatcaaggtgccattggggttggtttctgaagagggttctcttcctggctttcaggtggccaccttcatacagcatcctcacgtggccttttctttttgcctgcatggatagagatctctggtgtcttccttgtaagaacaccagtcctattggattaggaccctatgctatgacctcatttaacctaattaccctatttaaggccctgtctctaaatacagtcacactgggggttagggcttaaacatattttaggggaacacaagtcagtccataacacgtgatttgctatagttttcctttacctaaatcttttccaaccttgagagtggattttggccaggtgtggtggctcacacctgtaatcccagcactttgggaggccagggaaggtagattgcttaagcccagaagttcaagatcagcctgggaaacatggcaaaaccccgactctgggggggcagggggagtgggggaattagctgggcttggtggcgttcacctctagtcccacctactcaagagggtgaggctgaggctggaggattgctacagcccaggaggcagaggtcacagtgagcagagatcacaccacttcacttcagccctgggttacagagtgagaacttgtctcaaagaaaaaaaaaagtgggttttattcttccccttaaattcctattaatagtgaggtgaggcttcttgtgttttttttttttttttccaagacaatggttaatgtgtgattacttaaaaatgatatataacactaagaaataaagaattgttaagtgagaaggaacatattaaaatggcttggaaagatgggtaattttttacattttaagtaggttttctcaactctaactctgtggaacttggtcaatctaatcagtctaaatatagcacaaataataatagttatatggacaggagaaatagtagccctcaaagatagtgaaatacatctgaatatcactaacaatgtcatgaatttgcttgttctaaagttttctgaaagtatgaattcataactgagtttttttttttttgcctatgactactaatgtttgaggagagagtagtgtcagaaccacccccccatttattacatgtttatttcatattttggtactgaaatcagtgtttattttgtgtcttcctgataaatcttgccaataagtaattaccttccatactgaaaagttcttaggattaccaggttgctgggggcaaccttaaaaggccatgcagaacattgacttaggtggctattaccctgctttattcaggtctgagcatttactttcctactacaatcagaatactgacctacatttaaaagtgcaacactgccctgttatctaaatccactgtgttcctgagaggaaataccagaaaagagggcaccaatattatttttctgctgttcttgatcataagtgattacctttttttttggttaggcattctgcttctgaaagataactgaggttgaagttaatagaactaagattcttatataaaatcataggaaagataattttcaggattattgaatcatattgaaaaatgatataattgtgttaaaagataaggactaaaatgagttaattcaatttggaaatagttaaattagaatttgcttctgtttttgatgaatactgctttttgaaaaatcttctgagtatttaagcttttactactctagtcattctctctaaagtagacatagaagcgtgttcttatcttgatttggtaaggctctgaaaatgcaaagcaacagatgttgtacccagcataattatatgtatcctggaaacacatctttattgagtgggatttgttcttggggaaacaaaaatttggcaaacaaaggacattaacttgctgatctcagcagtaattacttgggttagattataataatcttgtgtaggtggtaactgcatgcatatattacaaaatctaattctaaaatacgtacattaaaaggaaaatgaacttgcgcaaactttagatcatgtatccccttgaagagcagaaaagatctcaatttcattatttgaaagttgtttgaacagctttttggaagaggtttccaggattccaaatcctaatatgtgtattgatactgaggctttggactaatctttgggggttactgccttttttatgcccactgaaaatagagcatttcaaacaaatgaactgatctctgatctttaagcatgccagtaactctttggaacaaatccatagttatttttaccaatgactgtattaaaacagtactttctgtattatctcttccattccaaggccattttaaaacaccctctttctcttctcccaataggtraagtacgacagagctccttaggactgggttatggagaattatctggaggtcaatttgagaaccactgtgcaaaccatttcttaaataagtagctacaaggttgtccttacaaaaatttctgaagttgatggtgttgcgttttggagtctgaagcttaaataagagtttgtcagtggtcatggtctaaatagctgattactaccaaggtcatctaatttttttttaacacaaaaaaatgttctgagcacaaatgaaaccttcaggacaagacatttatgttttgagaatgttcttaaatgattcctgtcgtgtatcttattttacatatcttaatgatcagcatgtattttttgttgttgatgatgattttataaatgtgctatcacctagtttctaattcctaacagctccttcatcagtagaatattgctgtagcacagttttgccatctgttaagaaaagatggtgactaataagagtggcacatttcagggctggtgtgctatcgcaacatctagtgttttagtactgaggacagtgatgtatgcagtgttccttacagccatggggtgtgggaatgttttcctcttcggcaaagtctgtgtatttctatagctgaactctcaggatccagaggaaaaccacaagatgatgaaaccagatgattgtcatcaaatttctattccccactacatgattattagttttcgtcaaaagaaatactcatcctatcctgggttggaattggtaaagaattttgcattgtgactaggacacctaaaagtttttaggatgagtacaaatggaatttgatagatttccccaaaatgtttgggaaaagatttattcctccctaggaacagcaagagtagcagcatcacatgaggcaactcctggtaattttttcttcttgctcttatttcaatgatatcttttcattcttttctgtatctctcaatttctatgtttctcctcttaatgtatcctgtaaatttcttagtagaacctttttactaatgagggtttcctagtttgctttaggaggcactcaggatgcccccttttgtaaggcagtaaattgaaaataagaacttggtgaaggtccacgtgacggttagtttccattctccattgtaccaaactgctacagggaaagaaccatatttaatcaacctcaaatcctcaatatttaggtcagaaaacacttggcatagaagagacactcaaattttgcagctaaatagattattgatagaaaatatgtttcttgcctctacaagcaatatgaaaccaatacaatctctaaatatcttcagactactaggggcaaatactgtattataagaataattcttcagaaaggaaaatccagctactctcatatcacctctctatgttgaaagctagggaagataaactggcttccagccagtgagagtccatgtggacctagtgctggctggagatccctaatccaaaggcaagagccagatactggttgtctgctgaaaatcagaagatgacctctctggtagtaaggccagtgactcatccctgcatcttttatcctcttctgatttgtataaggatctctcctttttccccagtacccactctcaagaattgctttcctttttaacatgatcataccaaaatgtatctaacagtaccttgatttcctttctgaggaatttagggagcatatttactttgtcagactcattagaggtttggcttcttggtcgggttcttaaatggacaacttgtttgggtgatttggcagagaataggagaagccagtcccctctgatagagcaaacctggggagctgtggttgacccacctgctaactgtcctgtacaattaggcatgtggcatcagtgggtgactgaccagagccaccatctcaatggcggctgttctttccttcctgtgccttctcagatctcttttttgttcttgttactccactatattggtttttcttgagtttttttcaagcaaatatcattattcacttctactgcagttcctctgttgttcgctttttctcttagtcttcattgttttccattttgaacattcagagatccatcaaaaaaagtaaaataacaggaagggagaggtaaacaccagtcaaatgaagtattataatagtgtattactatactctttaaagtaattgaagggtggttttttggggtcagaatatctgttagaatttggaatttgccactcttgagactggggcaagctatttaaactctaagcttatctgtccttcctcacaatctgtaaaatgggatcataataatggcacccagtttatggtgtagtgagcattcactgacacaattaatctaaacttatttgcactacatagaacagaatttttgtctattaaacaatatagcgttttaggcatgaaagaaactttagattaaattaaatatcatttttcttaccacagggtaagtttctgttttgtttgcccctgtttctctaactcctagaatagtttccagcacatagagattaaacaaatattcgttgaatgaatgaatgcatctattctaatcctcttgttttaggaatgacccgtcaggctcaaaagtgaaagcatttccctcaagattggtgacagagttggggactaaatctaaggctttctcttcctacaccagtgtcctttctgagaacacgatgccattttctcaatatttgtttatttatatggtaaattggtaggaagctgtgtggtactataagaggataaactttgataatgaggtatacttgctatcaaattctaacattctcatttaaaacatggcataccatttgtcttctacattttcatatgtaaagtgaggtgatttctaccttatagaactattgtgaggattaactgaactaatctttgtagagcacctggtcccatttattttttttttttgctcaccccaccccccaactttctagctagataacttatacattcactctgtttttcattccttcttgaatctcctgtggccagacttgacccctgtcactctacagcttactcgtcaaggtcagtcctcatctgacttgacctactaagagtctgacaagtagtcacactatgctccttgatacagctttcttcacctaccttcttggatgtcattcttttggttctcctcctaccccattgggctgctttttcccagtctccattcttgggtattctcattttcccatgtctgtcctctgacttcttattgtctctgtttctgttttctctggttggaccttctctagtttctggcttcaaatactatctaaatgctcatgtctttcaaatttgtaactctagtctagacctctcctctgaattccagttttataaatcttctacttaaatattagaggtctaataaacttctcaaacttatgttctacaacaaactccacattttctcctgcagcctctaaatatgtacctcctatagattttcccatttcagtaagtgggaacttcattattctgattgtccaaaccaaaaacacttggagacttgctacattccaccctttgtctttcattctacatccaacctatcaacaaatcctgttgcctcttccttggaaatatatccacgcttgagcagcatcattgtcaccacttggtgttatacactctcatttctcacctggagtattgtatttctcatctggagtagtgtctgtccaacgatgtcccccatcagtctgttctccatgtagcaatttcgtttttgtttgttttaagattgggtcttactttcgccttggctggaatgcactggtgatcatagctcgctgtagcctttaattcctgggctcaagtgatcctcctgccttagcttctccagtagctaggactacaggcacacaaccacacttgactaatttttttttttttttaacttttactagagatggggtctccctttgctgcccagtctagtcttgaactcctggcctgaagtaatccttctgtgccagcctcccaaagtgttgggattataggcatgagccaccatgtctggcccagatgttaattttaaagtgtacattagagcacatcgttcttctgcatgttcagcataaaatccaatgtccttaatgtagtctatattaccctacatgggctacttgtgcctgatccctctactcttatgtcttatccctctcctgctttctcactagcaccagccacatcttaccgttccttgaacacaccaagtatgcatttgccacaggaccttgatgcttactgttccctttgcccagaaacccttggaaccagctatgtgttaaaattcagatatttactgattttagagagctaaaatggggtatatataatatattacataacactcacagctggtttgtggtagcatttcataattaaataatatttctgaatgaaacattaagaatgcccatgctaagagggatgagtaaagactcaactctcattgtcagttcagctgcagaatgaggtcagctcaagatttgctgccaaatgacttaagaaaaaaatgtttttggagctttggggatttcagaattgcagatgagagattctagacccgtacctacacagcatgctcccttattttgttccaatctttgttcaacgattatttattgggtagtcaaggaagatctctgtctaaaaggcttctctgtgtggaacaagactggcatgtggaaggtttccaattaacgatattgaaagagtgaagctcaaatcatttttcactcaaatacatactatttagaagacagtggccagtttaagaataatcattattggaaacaaagtactatttgattagggatagttaacacaaacacttattagtattagggatatgtgaaatacttaatggatgagtcatgtgctgacataaaacccattatccattttagttcctggtagcctaactggttgaactctgttttattgatctattattgatttggcctgtaacttcaagttacattttaatgtaatttcatccttttctgatcaccttgtgtcttcaagcatttttaagcagttgatagatagttgaaagatattatcactatttcaatctaaaagatattatcactattttaatctacttaaaatttttactacattcattttaagtatgacttatggaacgaatcgaaaatacaagatagtgaaaaacttgtgaggatcacctgaaattttagcattcactttccttacatagaggaacttagtctctctaaagaattatgagtaataaagtatcataatgatatttgtcttagttttggttaagtgtactccacaggagaaagttaggcatgagcaggaattattgtagtcccacattctcaaacagttctccagtaagaaagattttatgtgtttccagaaatcattttcctcctcttcagagctttgggaccataattgtatttaaattgctaatctgttttaaggaatcataataaattgtttaacatttatattcaatcaactttgtaatttgtataaatttttcagggtgacatttgaacaatttttaagaaaatgggaaatacagaagtattcttagttttaatatattttaaaaagatgacatgtgatctactgactgaaatccttcaatcatttttgtttttctccccaagattagatagaatggatgtgattttatttttaatttgcattatggagagtacttttggggggttttatgaaaaagacttcatttattttgttagtggtacttcagttgcataagaaaatgttcttttaaatatagtggtcatttgtgtgcagccttcaagttagcaaacatgcctttgagtagtcactatttttgaaggtctttatatctgattgcaatggcttatattcaatagtcctcctactaaatgaaataaaaatggatgcctcttctgccacagaggcacaggtggacatgttggtagcaagccccatgcggtgtgacacatggcacagcccaacatgggggcaaagagcatgcggcttgagctaggagtcactttatggctactttagtgtagatttgtgtttttctgtggaacagccattattgaagacatttatatagtatgatgtttgtttttcattaaatgctgattgtgatttcttaaaaatagttaagacttgattagcagaacctatttagaagccagagttcccctgcttcacctcttgctatctatataaatgatatttttgactctgtcctttataatgttggcaccctgtgcatattagatgtaatcagggctgaaaggaaacttgaatccatctggaagcaataaacttttctaaaagactgcacagtgttatttaatcctgtgacttcttactgtgagtgaaattaaggtttgatgcagttgtgtcacatcgtattgatatcaaatttatctttctaaaaaaaaactgacagtattacagcacagaggagaagatggcttgctgtaatcctgtaagctattttacattgattacatgctacataatgtacctaagtatataaaatacttgatctagaatgtttatgttttctccaaaattttctcatcaggtaatactttctcaacttcacctttagttttggcttcttatcatagtactaactatgcggtagtaattgtgttatgatgaaaggcatggagaagaaattataattttaaaactattataaagtggagacacacttgtataattaccatctatgtagactgccaaggtataaacatttagcttattttagtatcagactctttgaatcaatttaaggctttttcaataaaattggcttcctctaatttctactccaaaatggttaaaattttgttttacttcaaatacgttgtagggtatcatatttcatgtgactaggagcctaaactatatcagctgactggcataatttgtgaattatatgtgtgtttattaaaatttaaagtttttattaagacttacaattttattaagacttaatttttttccttacattttgagtaagtccaactgaaaataacttagagacttaggaaatttgactacattttataagtaatttccttgtaatttttctttcttgtggaaacaattcttactgatttacttaactcttttttcaatggcaaaaatgaaaaccaaatatatttgtcaactatattcttttaattgtggaaatgaaaggttcatatcccccatttgcctagcatattaaaaataaacatgacctttgtcttgaatgttgttaacttggattttaaaaatcaaaccaattataagctatattaaaattgcttatcaccttccctttgtcttcagtaagtctgggcctaaaaatactcatcatatgaataaataaagttttacaaatactttttagaacatcttgaattatatgtgtgtttgaagcttacttttggatgttcggtcaacaaggcttctgacagtttctttttatcttccctctattccctgccactgtgcaccccaaagtgatccctgaccacagtggtcccattgctggcatcaggaaggtagactgaggagttcaggtatcctagaggctgttaggtgaatctcttctacctctttcctggtcctaggaccactggacacttcaagtaaaaataacaattactttaatctctcaggtaaagtttcttctcccttccagcaacacagatctgcctgtgccgagttcaaatactctgaactttcaacagttgttctgaatacttttttgtcatcttatgatcaaatattgagagcattgaggggataactgaatgggcatggtataaaagtcagacttttagtgtttctaagtagcagaaccctttggacaatttagagggctgtgcgatatcctcaccgtgactgctgggaagtaatgggatctgacctgcagaggtactaccttggctgacaataatgacaaaagtgagagcaaagtacatatgactatccttgaggtcctcaggaaaaaaagagtattagtgagttgaactgtatgtaagggtctttaccaataaggaagcccatgcccagacataatccttacaccctggcaatagaaaccatcattgtggtttacatctcatcctgttcctacagtccagcaagttcaggccacaaaaggtttaagcactttttcctttgttctcatagcaacagttgcccatggaggttcagttacactaatattaacattttaatatacacaaagaagtgcctcgaatgtagtaggtattcaaacttgttaaatgaaagaagtaaactttcagacttaccttgaactactacagttttattctttctctaacctctcccactactaccatcttaaaaccaccatttaattagtattttataacaagttattaaaggctttcaaagacctttgaaccttcaccctctggtaagttaataacttctgatatgcgattaaatgtcaactgagtagtagtgggccctaagagctcagagggactgagaaatgaaggttattgtttagaagagtggctcaatgtgcttcgacagttggttaatatttgaaaagactagagtcaagaaagccttccatgtgctaggaaatgaaggagcaaaggtccagaggtggaaatgtatacagtgtgattaagggattttctgattgatagtaaatacagtcaataaaaaacttttattggaagcctagcctgtgtttgaagcattaagctaggtgctgggatacagagattagagatgaagataatgatgaagatattgttgaagtgaattgctgagaagctggagaaagggccaattaccataatctgaggctcaggaggaattggtgcaaagatcatctggtatgatatatatgaactgtatatacaaactgatctgtgtagctgaactgataatgccaaaaaaaaaaagactaggtttttgattaagatgaatccattaaggtcatgttttctgttggtgccattcttggagacctcccccaaccctatacatttataaatgtttttcctgagggactgagatggaagtggacatataaaaggaaaggtctgggcaaatacataagtaggtagtaaaatcaaggaacaaatgatctcaacaaaattgcccttcttgaaatgaatgaaaatgatgaaagccaatcacattgcatgatgaacttggggtatagaatatgaaatatttaaaattgctttatttcatgatgtttcagatgtagtaggaacttgttgcatagatggtgtaaaaacaatctagtaataaaatcttaggtatttaatacaaggtgaagaaagatgcaatgcataaatcatgccattttaggcttaattttcataaggctatgcctgtctttataagactatataccaggagttctcaagctttttggtcttggaacccttttatactcttaaatcgttgaaaaccacaaagaccatttatttaagttataaccattgatatttgttgtattagaaattaaatagacattaaaaatatttactatttaaaaataaccaaaaagatgggcatggtggcccacacctgtaatctcaacactatgcgaggccgaggcgggtggatcacttgaggtcaggagttcgagaccagccaacatggtgaaaccctgtctctactaaaatacaaaaattagccaggtgtggtggtgggcgcctgtaatcccagctactcaggaggctgaggcacgagaatcacttgaacccagggagatggaggttgccgtgagccgagattgcgccactggactctagcctgggcaacagagtgagactctgtctcaaaaaaataaaaaaaataaaaataaaaataacagtaagttcattgcatattaacataaataacatatttgtattaaaaataactattttccaaaacaatcaaaaaagcagtaccactcttctattttaaattttttcaaatctcccttttctaaaaaaaaaaaaaaaatattgtgtaagtttaaggggtacaagtgcaattttgttgcacggatatattgcttagtggtgaagtctgagaatttagtgtatcttcacccaaataacatacgttgcacccattaaataatttttcaacacccacccccttctcactctcttgagtctcctttgtctatcattccacactctgttcctatgtacacattatttagtacccacttaaagtgagaacatgtggtatttgactttctgagttttttcaactctggcttaatagaagacagctgaaatctcagaatgcttcttcatccagtctgttgtgaatatgttgctttgattcaagtatctaaggaaaatacagttttacacagatgtgcagctgaaaaggaaacatcttttaatatgttcagataattgtggatattgtcctttgatactatagcaaaacttatcaagtgctaatttcttaaaggctggttataatttgaaatctgaaaacatatctatttaattgtagtttgctatttgaaaatttattggtctgtcttgtactttgaatggatattttgcccacgtatgattttataacatcctgtattggccttttggaaaatttggtttactattatacagtttctaaatgttgataatttttattataatatattttaaaaagtctaatgtcactgccagtctcatcagaaaattctttgagattagaaagctgttaagatcatcatcacacttacaagttttacaaaattttaattttactcaaaactttatattttatcattgacaaagctctcagttgctttgcttagtgactgactcactttgttcattttccagaaagtgtttaccaaatgctgctgcctcaataccagagtctgtattgtcagttgatctttcaagtaaaaagtggtgttctatgaaaaacagctagttcagctgcgactgaaatgatataagtgtttctcctggagcaaaccaccacttcgatttgtagcagaaatgctgtatgtatactttccattgttattactcataacatttttaaaaatatactcaagggtggagatttttttaaaaataagtgttattgcttcatcaagaacagttaaatgaaactggattttttaaactgagtttgagttaatgaagaatgcagcaattattagtaaaatttggtgctccaccttgattcatactgacactccaggagttttacccactatttcttttgtacctttagtgcaaatgttaatatggtaggaatggtaaatgacatctttagtattattataaaaatcgtttttaccctgtatactctttgagactacacattgagaattgctgatgaaggtgttttaatttatcataagcactgaaaagatttacttaattcaccaatttctcctgaatatttgtttatataaaacaagactatgtgtatacacctacctttttattaatggtagagatctaggaaaattaatttctaagaactagccaggatatttggaatgtgaataaatcatatatccagaaaaaagctttagaagattgtctatgattgaaagtcaaacagctctcatttctattatactgttctttttcaaagaatttaccaattttatgtggtatttatgattaaacatacaccatgtaatttaacatttttaatgtcacttttacatcataggtattaaagattagcatttttattgtctgtattttaaagctcaaagaataacatttaggctgggtgcggtggctcacacctgtaatcccaacactttgggaggccgaggcaggcggatcacgaggtcaggagattgagaccgtcctggctaacacagtgaaacaccgtctctactaaaaatacaaaaattagccgggcatggtggcgagcgcctgtggtcctagctacttgggaggctgaagcaagagaatggtgtgaacctgggaggcggagcttgcagtgagccaagatcgcaccactgcacttcagcctgggtgacagagtgagactctgtcttaaaaaaaaaaaaaaaaaaaaaaaaatttagatttttgactgtttcattgattcatcttagacttcacatgaaaatatctgtatatcctcaaatgcttacattcttaagaagtatctcagccatttacacatgatagaaacaactaaatggaaaaaaattgcagttggaaattcactattttttatttgatccgataacaatgtgacatttgcgattggactgtaattttctgtctttctctctgaaaataagttcaaaaatttccctctaattcttttactagataagaagcctacttcgttgtaactcttgatatatgtatgtatttaggaacttaagcttttctgctaataaatgttatgtcataattcttgaggatagtattatattgtgatgggttttcagtaaactacaggagcagccctatttgtttaaaccctagtttaacctgattattaacaattaaattgtgttttcttctaacaattaaagtgtgtttaaatttattggtcccttgcttcacagatttatctcagtatgtggtgtattcaaacagaattttgtatttttaattaggggattagataaccaattctgaagagccaaaaaaattgttagacatcacattgcttaaccatctaatataccataagtgtgtgtatacactatgttgtgggagccatctatcaggcaggcctgtttttcaggcagtattttaaaaagtggacatgtgcagaaactgtgagcacaattagcgccaagcagataaatccagctctaatcctgtttacggtctacatcagacagatgtgccaagattgatttagacaagcccgaggcttacagtaatatttttaaaagtgccattcgctgttctatttttgttaaacctttgctaaatattcttaagtcttgttggttttgctcttcttattaaccaccgtaagtaacctactttaagcaggtcccgctttgctctcatggtgacaaggtaacctgccaggagaggttatctttattccctgtaattaagttgacttttccccccaaaaaaatacaacaataggaagtgggtgctgaattaaataaatagcatgatacccagtagatgtatacttaagttccttgcaagaacagatggtccccagtatctctgtaagtaatgtgagaggacagttaatgttctgaaacaactagctataaccagtatgatactaatgaaccagtagatttcaaataataaaccacatgccgccaagcaaaattatatgtcattcataaggatttaattatcataacttgcaaaaaagtgtcaatagatgatttctatatttttatctactgatatcaaatatcaatttatgaatagagtttcacttcatattttttaccaataaaggtatgttttaacattaaggtagaattaaagttatatttaaaatacatgccccaaagtatgtggtgatttttttttaactcctcttttactatactgtctgtatgtattgggctgtatatggaaatgtagcttttacatacaattaggaaaacaattgcttttatttctagcagaaacttgtactataacagaagtggctagcatgggaatcagagtagttatcttgtagatgacaactgaagcagacataaaagatgtaatattttttcagcactcaaaaatttataagtaaaattttataaacaaaaagcagtatttttgtgattcatatggaaaataaaatgagtctgagtcattcttaaggtgataccgtaaaggtgtatagataagaagtccatttttaaatatacccaagacaacagttttttctctcagtatggtttgttttcccttttttctctttaattatgtttcccataagtatttgtatattctaagaatgtccaaaaaataaatgttttgcagtgggggttgaaaagaaagaaagacctttttagatttcagctgatcttatcagatgatctctagaaccttgaaccttcaaccttcactgaagttagctggagggcttttcacctggaaacctgagaaacctcagaagccttctgctttagctctctctcaagtctaggaagccagtggcctgcgaccccacagagccagctggtccactcctcatataagaacttcggtaacaatacaaagacatagcaaagcaccatctaatctgataactcattaaacaatatttagatggctcaagactttaaataaaaacattttaagcttgtttatagaatactaacaagttttattcccaaagactatattcagagtgagaaaacaattttccttaaaactaatattatatacatgttcatatatgttaggaactagttatatgcaaaatcaagtgactcttgtgattagaactggtcacatttattcatgtagcataaatggttaatattgccaaaatgagtaatagatcagattttctatgtgagatattgacacctgagagatttacagtgtttcactgttgtgaaaaatggagtgctgaagaacatttgtctattgttatacatttgtaaaagaattcacaaattactaatttcaaataagaactaaatatttcttctaagcctatagtttttctttttaatttcttctaagcctacagtttttctttttaatttcttcttgtaacattggcaaaaagaccattcgtgtgaaaacctcagattttgatctgtacacaaatgcaggagtagagattggaagcttgagctggaaaagcaggaaatactgctcagagccttacaaggattttcagaattttcactgttgggtcctcctggttgctgcagtctaacctcgcatctccttgaaggcagccccagtttctgatgaaatactcttcagttaatttatacatatgctgtcttgctgttttcctaaggactgcaggcagaactgtggttcacctactgttttaaatttggctagatttaaaaacagatgatctcacttatatgtggaatccaaaaaagtcaaacttatagaagcagagagtacaattgcggttgtcaagagctgggggaggggaagcaaggggatgatggttaaaggtataaaatttcagttagacagaatgaataagttctggatctattgtatagcattgtgactatggctaataatgtatacttgaaaattgctaatacctgaaaatcactaagagactacgtcttaaatgttcttacaacacaccaaaaaaaggtgtgaggtaatgaatatgttacttagcttgattttaatcatttcacattgtaaacgtgtatggtactgatcttgtacctcatttcattttccatatgaatcagaaaaatactgctttttctttataatatcttatacagcatagatacaatttttagtggtcaattatattgtaatatatacataaatatatatgattttcattggtcaattatactgtaataaaacagcaaaaaataaagttgtaattaaaaaataatttggaagaaaaaattagcaagtggttggagattgaggaagatgggaccaataagtcctccaaggagagtcatacattagttttttttaaaagtccattattaatcttataatatttaatatgtttaatttcttgacacttattaatccaattaagtatgagaacactgtggataaatctaaaaaccttaaagttgagtaaaataaaccagatacaaagaagcacatactttatggttacatttatatgaagttctagaaaaggcaaaacttagctatagtaaaaaaatcatggtcctgagggaataactagagagtggtatgagggagctttctataatagtgggaaaattctgtatctttattgggatagtggttatgtgagtgcatatacttaaaaaaactcatggaattatgcccttacaaatctgtaatttttgttggtaatttataccttaataaaaaacaaaacagatgacagggttagtgattgtttccttgaagaaggtctttacatgggtctgttgttaacgagttgtagtaaaaatcatccaaaatgcttggattcaaatcttagatctgttcctaccagatgtgtgaccacagacaagttacttacattccgtcttcagtttcttctcttttaggaaaaagcatctagtttttgttgtagagattaaattagataatacaaatgaagtacagagaacagcgtttggtgtgtaacacatgttcattattagctacccttattttttagagaatggaaatttttaaatttaaactaatcaaactattttaggataagcaagtgaaacaatctttttttcaatcgatcacagaaatattttcactgaagacaaattagacatttatataagcaaactacagtgtcattaccattcaaattttcatatgcatattcatgcttacatgcatatgaaagcattacacatatgtattctataaatatatacaaaacagtaatggaaatgtgctgtactattttgaacatctttctagtcagcccggcattttatttacttttgagacagggtctcactctgttgcccaggcttgagtgcagtagtgtgatctcagctcactggaggctggaggtcctgggctaaaggaatcctcctacctcagcctcctgagtagctgggaccacaggaaagcaccaccatgcccagcttatttggtttattttgtttgtttgtttattttttatttttttgtagagatgaggtctcactatgttgcccaggctggtctcaaactcctgggctcaagttatcctcctgcctcagcctcccaaaacactgcaatcacaggcattagccactacactgacctctacattttaatagctgagtagccttctgttatatgaatatacttttttttaacaaaaccaatactccattattgtacatttaggttgtttccaagtttcactcaaataatgcttgggtaagtaagtatttttatttattattattatttttttgagatggagtttcactctgttgcccaggctgaagtgcaatggtgtgatcttggctcactgcaacctccgcctcctgggttcaagcgattctcctgcctccacctcctgagtagctggggttacaggtgcacaccatcatgcctggctcatttttgtatttttagtagagatgggatttcagcatgttggtcaggctggtctcaaactcctgaccctgtgatccgcccacctcagcctcccaaagtgctgggattacaggccgtgagccaccacgtctggcctggataagtattattttagctaaattgtgcatatttattcccttagagtaaattcctggaagtaaattgctggatcaaaaccaggtatattttaaagaattttccttttctacattaaaaataattataattctgattacaagaaaggaaaattatggagcttcataagaaaaaattagtctcatatttcatacctcatattgcatatttaataggtaaccagtgttaaatttgttgtgtgttttccactgggatttctttttatctcctttaataaaagcaggatcagatccctcagattactttgtaacttgcttttattctactttttcatacctcttagcatgaatgtctttccagaccagaatacagagatttcacttactcatttatgagctgcagaagatgactatgatttattcaaccattctcctattgaagagcatgaatattgcttcagatacttttgttattataaatattagtgcaattaacattttaaagtcttttgatacatattcccaacttgttctccagcaattaccatttttgcattcccaccagcactggggctacttccctttagttgcaccatcatttagcattatttttgatcttgtgccaatctaaaaggcaaaaagtggtatcttgttgttttaatttgcatttctttgattactaattagattgaactttttcatttgttcattggtcaatttgcatttcttcttttgtgaaatgcctgcttgggtcttttatgtactttaccattaaagtgtttttcttgattaaatagattatgtaactgtcatatgttgcaaatatttctgtccatttggcctttgcttatgactttttatgagtctttaggacttttgaggtctttattaggtattcaataattttaatgttaaatatattgatgtctgtcttcctttgtgtcttacggcttttctatttaaggttacgtaaatttctaatatacaaatattggtgtatattatgaaatagggccctatttttctttacaaaagattagtcagttctaaatcatcctttgctatttctagcggcgcttagatgccaccattatcacatcagtgaatttttaaatgtgtaattgtttcctgatctattcatttctctattcctagatacttctattgtaatagctttaccaaatatatctgatagggtgtgtactccccctcattacttcatttatttatttatttatttagagacagagtttcagtcacccaggctggagtgcagtggcatgaacttggctcactgcaacctccgcctcctgggttcaagggattctcctgcctcaacctcttgagtagctgggattacaggtgtgtgccactacacctggcaaatttttttttttttttttttttttagtagagacagggtttcaccatggtggccaggctggtctcgaacttctgatctcaggtgatctgcccttctcggcctcccaaagtgctgggattacaggtgtgagccactgtgcctggccccctcattgcttttaaaacattttcttactgtaatatatttattccaagagaattttcaaatattttatgagattccttgtccattccttacatcaaaaaataccacggagattttgattgaagttctattataagtagttacttggggtggggggaggggggagggatagcattgggagatatacctaatgctagatgacgagttagtgggtgcagcacaccagcgtggcacatgtatacatatgtaactcagctgcacaatgtgcacatgtaccctgaaacttaaagtataataataaaagaaaataaagagaatactggcatggaaaatatgtaatcttggaacttgttgtatctccacttattcaatcctttgtctctcagtagattttgaatggctctttatcccacacgagtctagaatcattttgctaagtttattcctagatataatatgctaattgatatgggaattttttttatctccattataccttcttcttgggtgtagacatatttgtagccagcttcctcactgcatattttttattaggcctaatggcattaagtttattattttggattttacaaaaaaaattatgataacatctttaaatagttagtttcaactcctcctttccccttaaatccatcaattactgtcttttatttcactttccttatgtactgactagaatgcctagaataattgaatgctatgagtaataataggtattcttgccctgtttttggaaatccttctggatttcagtaagtgtgatgttggcttttggtttagtatctttaaatttgcaatttacaagatattttacattggaatagtcattgagttgttaagtaaagcacaaacatgttaaattcagactgaagtacaggacttcaatgaaaagttaaaagagtttatttcatcactttcattttttctttccctcagtggctgtttgtcccctccccccaccccgctccatcccccagcttccttcctttgtgctcttattgttctaggtttgactacataaaaagagactctcaatttatatgtgatacaagaccataactaatattataaaattagtctagaagaagttatttgcaacctatataataagggactaatttcaagattatttgaaggactttaaagattggtaagaaaaaaatagacaaccgtttagaataaggcaaagcatgtgtagaggcaactcttaaaaaaaaaaaagtgagctgggtgtgatgatgcacacctgtggtcccagttactagggaggctgaggcaggaggatcacttgagcccaggagttcagggctgtagtgcaccacagtcacacctgtgaataaccactccattctagactgggcaaacataagaagactctgtgtcttaaagaaaaagaaatgaaaagatattcagtttcattaattgtttgactagctgatttttggaaaatacccacaaatataaccaagcctacaagttattttaaggtgggtaagagatacatcttatctatatgcattcacctatgtgaagcggacacccagtaacacccccgtgtggaagacaagcttccttaaacttcacaggacagtatttcccatgtagtccatcatagggtgaggatttttcaggacctttggtaagcctgcttgctttcattcttgagggtagaggaagggtgcaagacttccctggtctctcccaagcattttggggaccctggccataagcctacttgctcaacaggtgcaaatgactggtaatatgctgaccagatgcaagtgtaccaccaatgatttgctgtgactgagtttggtttcctttgcatatactatccagctttttgtttctaatatattcttccttaagggaaccaggacttcttggggaatccagatgagcttgaaacactgtttttataagagaagggctgttttcaaaaacatctatagttcgtaacaaaggagttagattgaagggactctcactgttcagtctgtgacaagcatgagtgttaaaatggagacaagaattttagttaattgtaatgttgaatttgtaaaaggctataacttcataatatgatcaaggggaacaagcaatctaaaatgtgttaaagtagcattttcaaagtgcggtccagggactctcagggttggtgaggtcacaactgtttttataatattgctaagaatgtatatcactctccttctctccaaggatacggtggagttttccagaagctatgggatatgtggcgatagccttgccctaatggagtgtgtgctttgtgctttgcatttttgtcctttaaaaatgcttggttttaattttgaatacaataattatagatagatataacctacataaaccaaagttatttgcggccctcagtctttaagggtgcacagtggggcctgagactaaagagtttgggaattgatgttctagagaaaagtcagtcttactgatgagggttaatcaattagtatttactgaccgggacaggacaaaccattcattttataaagacacacagagcatttcactaaaatacttttactctgattaagtggtgattttagtaatagtaatgattgtttgattttctgatacctgaaggaaaaagagcctgttgaattgatactttgagggtgttgagttttaggtcactgggtgactgtagaaatggaccaggagaagaactgaaacttgagccttctaagaaatagaagaccaaaaaatgtttagtgttaccctatcccatgaccacaataattgagaaaaaggcctttccgttccctcttccctaccctcccccttctcccctaccctctcctcccccctcccctccccctcctctcccctaccctctcctcccccctcccctccccctcgtctcccctaccctctcctctcccctaccctcccctccccctcctctcccctcccctctcctcccccctcccctccccctcctctcccctcccctccccctcctctcccctcccctccccctcctctccctccccctcttctccctccccctcctctccctaacccctcccaacctttcccctccttctctgtccccctccccctccctccctgtcttcctcccaccccccactccctgtcttcctccttgtcttccatcctcccttccttcctttccttcctgtctttcttttcctttctttcctttttcttctttccttcctgtcttccctcctctccgtctgtctccttctccttgtccccttctctctgtcttgcctttcctttccttctgtctttttctttctttctctttctttttcactcttcctttttttaatttcccttttacttgccttctctctttcattccttccatgctttcttttttttagtggtatgtatactttgtgagcaatcagactatagcttgcagaatagttgggagaggccaaaaatgcccctgagaatgcaagcaaggaacttcttagtgagcatatgaacatcctcactccaatcggaggataacattgttcatacttcaaggactaaaaagctgagagagggtctctgctttctgttacttttagcactcgagtcatttctgcatgtatttctactgattactttttctcctattttggttcatatgttttctgcttctttgcttgtctagtgattttggattagatgagtgacattgtgaattttactgtgcaggatggctgaattttttttctattcctgtaaatatttttttggcattgttctaggatgtagttaagttacctggaaaaagtgacatccttttgagaggcttgcttttaagttttgttaggtggaatcacagcagtctttagccagctcactaaggaccaatactcttctaaatacttaccataatgtcatatgaatttccatgtttttccacttcagctggtaggaacacctgtgtcatctctaagcattgtactgttaattcttctagtagttcttatctggctttgtacatctgctgatcaatactttcagctaaagtctcaaggggacctctgcaaatctacagtgttcactgttcagctttctcttctgtagtaaattgcacagtgaactctagtccccttagccttcctgaacccccagttctccttaactcagggagatcaccaggccccaccaggattcctgtatctgccctgtgacctggagattctctgcaggcaataggttggggcggtcgtagggtccactttgttttcctcctcttcggcttcactgtcctgtgttacctgatgtccaatgtctgaaaactactgtttcacgtatcttgtgtgcttttgtagttttaggtgaaaggtaaaactagtttcttattattccacattggccaaagcagaagttttggaagtctttttttaaggtctaaaacacttctactttgagagtcaattgaaatggtcttttccacaataattattttctgacctatggtttaaagataagtcatgaaaattttatgccactatttttttttaagtctgattatggttaaattcagggggctatttcctcctagattgacagagtttataatgtttcctactcacaataattgtacttctgcttcctctttgcatgtgttactttaatgggaatgtatatttccttttcgttaaggctgccttcaacaatttgtcataaagtcacttctgttagtgaattctattttttctgttactttactctatccttagtaccaaagagctccttatgtgacaccaatttattactaaaatgtcgctttgtttatgttcttggaattcttcatacattgactatcctcagatgtcgaatgttgtaggcctgtgtggcagggactctcttccatttattctatttttaatctaattcttgacaaaataaacccaatttttcttttcttcccctttccatctcacgtagggactggcataaagggcaatccataaaattacaaatgatgaatttttttggttttaactattattcatacatttaagatatggtcacaatttttatttcttactagtaattcattttattttttaacttttaggttctggggtacacgtgcaggtttgttatataggtacatttgtgtcatgggggtttgttgtacagattatttcatcacccaggtattaagcccagtacccattagttatttttcttgatcctctccctttgctcactttctaccctctggtaagccccagtgtctgttgttcctttctatgaaacacaatggttttaattggaaaatttatttttttttcaggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggtaagtactcctcatgggaaattttaatcagcccagtttccttgatatacatgattaatctagacatgttttgagtaaaaacaactttagtgatgttgagatagtttccttctgttcctagtttttgtcgtgagaaagtgttgaaatttgctaaatactttttctacattaattgagataatcatatttttccctacatcctgttaatgtggtatcttatattaattgattttcatatgtttaacatccttgcattccaggaataactccccaatggccatggtgtataatcttttaaagatgctattgaatttggtttgttaatattttgttgagtatgtttgcatcaatattcataaaacatattgttctgtagtttttctgtactgtttgtctgactttggcatcagggtaatactggcctcatagaatgagttaggaagtaactcttgaatgactattttcatgaagaagcttcaataatctgaaataaaatacttaaataatttagttcacctgagagttgtttttagaagcgtatttatttttctattaatgtcttttttgaactatataagaatgtattctccttccactcacacattgatggcaagtgtgtatttgtactctgtggcctgaaaataagatttttttgaataatcttaagaggccatgctttatactctggtaattgagaattacctatttcacagtagctttttctaaaggttaatttccagagaaaagagaacatgtttattaggatatatctcttaatgaattcagtgtatctgaaatttctaaatgacattttcatattttgcatactaaataaaattcataagtacaaatataatgcaattcataagtacaaatataatgcaatttggatttctagaagttatctagttaaaatatgatcttaggatttattttttttgtcttagatttatgaatcttgcttgtttttctgttaattcatttcttcttgtttgctgcatcagtcagatcagagtagaggcagcttgtatagttgatggcacagtttagggttagatggcacaggatagaaatgggtgctagacaaagagcagtcacagaggcatgttagaaatttccagttccagcatcattgatgaagaaaaccatgaggacccaagttgatcaaaggcagccagccaataaagctatgctcatgcgagatgagctgaagtgacattacattaaaattggaagaccctcttactaagtggctccatgcttccctgctagcccctttgggacttccaagaagacttggttatttcaagaagacaagaacccacagaggctgtagtttagtttatctctctggaaacatagagaatatgtataattaaataaaagcactttaatagtgaatcctttacagtgttatttgaaatttatgtcaagtgatttaaaaagtaaaaatgaaaattaataatttcagtggaagtaaattgattaacatgaccaggaatacataaaacttgcatggtcttgtctataaaataaggatatgtcatttaattaggagagtcaaagctcattcttgcgcttaaggtctgaggaactcttctcccatggggcttatgaagggctacactgaggcaacttcctcaatatatctcagccataaaaccaagagaaagtaagaagcagaggacatcacaacaaagctcaattcagtaaaagcaattttataggagtagagggacttgtcaaaaacaaaaacaacaacaaaaaacaatgtccaaatatttattcagcttaatgagtgatgtttttgtttgatctagggttaaaatctagacaaattacagagatgaataaactacatatcctttagtctaccatcctctgaaaatgttactttttgaaactttgattttgataagagctggaggcactcagggagtcattctctggcatggtctttgagtacagagtgattttgctgattaaaagcaaatagattgacttttaaaatcaactcatacaaacaaactgttaaaatcctctaatgagagtgaagaaacctaaccaagactgactgatacattactgctccatctctgcaccaaagtggactcagggaggcctgtaggagatgccaactccttatcctactccccacaaagacagttcttggctatcttcatcagacacaaatgaatggttgaggctccaaagctctctaccaattcttgtgttacactggcacttttaaaaaattttgtttattttttatttttaaatggagtctcactctgtcaccctggctggagtacagtggcgtgatcttggctcactgcaccctttgcctcccgggtttgagcaattctccctgcctcagcctcccgagtagctgggattacaggcacccgccactacgcctggctaatttttgtattacttagtagagatggggtttcgccatgttggccaggctggtcttgaactcctgagctcaggcaatctgcccaccttggcctcccaaagtgctgggattacaggtgttagccaccgcacctggctggcacttctcttaaaactaatatctcaagaagttttttctttaagaatcttctttcaattgcaggtccatgtagttctggtattcattaaagtgcctatcccaggggttttggtatgttgtgtttcaattttcatgtttcaatttttttgatttatgcattaattttgttttttcagaattcaggtgcaggttgtttagtttccatgtatttgtgtcgttttgagaattcctcttgttcttcatttctaattttatttcattgtgacctcagaagacacttgcattgattttgattttttttatcttattgagatgtgacttacgactatgtggtcaattttagagaatgttccatgtacagatgtgaaaaatgtatattttgtgttgttgggtggaatattctgcagatgtctgtcaggtccatttggtcaagagtctgatttaagtccagtgtatacctttgttagttttctgccatggtgatctgtctggtgctgtgagtggggtgttgaagtcccccactattattgtatagctttttttccccataggtctagtagtatttgttttatgaacctgggtgctccaacattgagtgcatatttatttaggatagttaaatcttctggttgaattgaaccctttatataatgccctcctttgtctctttttgatgttgttggtttaatgtctgtttcttctcatacaagtatagcaacatctgttcttttttaattttctatttgcatgctagatctttctccatcccttcactttgagcccatggttgtcattacatgtgagatgggtctcttgaattcagcagaaggttaggtcatttaaaaaatctaatttgccactttatgtcctttaagtggagcatttaggccatttatgttctaagttaatattgatatttgaggttttgttcctatacatttgatatttgtgtattgttaagtagttgctttctagtttgaattgtgtaattgctctataagatctctgagccttgtacttttgtgtgcttatatggtagcaagtattgttcttttgtttccatgtttagaactccttggagtatttcttgtatggcaggtgtggtggtaacaaattcccttagtgttttcttgcctgggaaagactttatttctccttcatttatgaagcttaatttggcagattatgaaattcttggctggcattttcttttttctttaaggaggctaaaagtaggcccctgatctcttcttgcttgtaaggtttctgctgagaagtcctctattagtctgattggatttcctttataggtaatttggcccttttctctagatgcctttcatattttttctttggtgttgaccttgcatagtctgatggactatattccttggggatggtcatcttgtatcttgcaggtgttttctgaatttcttgtatctggatgttaacctctctggcaagattagggaaattttcctgaattattgcctcaaatatgttttccaatttgcttacttcttcctcttctccatcaagaatgccagtaagtcataggtttggttgctttacataatcccatatttatcaaaggctttgttcatttttcagattctttatgtttgtctaactgggttaatttgaaaaggtggtcttcaagctctgaaatcttgtcttctgcttggtgtagtctgttgttaaaacttccaagtgttgttttgttttgttttgttttgttttgagatggagtctcactctgttgcctaggctggagtgcagtggcatgatcttgactcactgcaacctctgcctcctgggttcaagcgattctcctgcctcaccttctggagtagctgggattacgggcgagtgccaccacccccgactaatttttgtattttttagtagagacaaggttttgccatgttggctgagctggtctcgaactcctgaactcaggtgatttacccatcttggcctcccaaagtgctgtgattacaggtgtgagccaccatgcctggcctgcttccaagtgtattttgatgttccctttagtgaatttttcaattccaaaagttctatttggttttatcttaatatggctatctcatgtttcatatcctgcattgtgtttctggtttatttgaaatggattttaaatttctcttggctctcactgagtttccttgcaatacatattttgtttttttagtctgtcatttcaaagttttcaacttggttaggatccattgctatagagctagtgcaattctttggaggtatgaagacactctttttgtagtgttggagttcttgggcagattccttcttatctgagggagctgttgattcttatttttgaatttcctattggttgggcgggacttaaactttttttttttttccccttgagggtatgactatggtgtatgttgtgtgtgatcattcaactttgtttctgggtgctttcagggggccaaggctctttatggattccttgggcgtggtagctttcttaaatgctgcttattgtagcaatgtattggatttgtgagctgacactctatctcatgtggggctgagggtgcagaagtctcaggaagcttattttgtggagtagtgctaagcctttctggtagtgggctttttatttgatagtacagttcaggctgcaatccagtagatggcacttaaaaaataagaaccagcttgccctcagttaggctgatgtccagtagaagcacctgtcctgacaggggagtgacaggaagagattctgttggtgtgtgccgaggcctttggggtcgctggttggggggagatagggggaggtgcactagctcctcatgcaggaatgtgatctgcttttctatcataccccatcagagggctcatgaccttcagttcataaagattttttccttgggttcccagccatagtctgtctgtaggttatgcatatgcccctctgaaggcaaccaccaaaatggtcttggggcagagcctcttcccccagtctagggcagacaactccatgacttgtatgtcctccattgctgggacactgctgctctgtgtagggatggggagttgggccccaccctttatgtaagcctaagtggcattctcactttcagcaggggtggagccatcttgaaaaccatgaaaaactctttcttcgagtacctgtgctggcccccagtgggaagaaccactgctgcgtcttcaacagcgtgtggggtgggagggtattgccacagatgaccccctctccatatccgttccttgacatggtgttgccccctttagcgattggcactgtgcccacctttcctttgtcccaaaggggttttggcaagttgtgtccctctcccttataggtggcctacactaggggggttagatctctagaggttccatagctccctgggaacttgctggccccctgggcttttcaaagtcagaacaggttatgaggtatgtttgctggggatctggtgctacagagactcaagggtagagaatccctgggcagagcagaggcccaccactggtgcacaagcaatatggtgaccaccatctcagtttgtgtctgaggggagtatgggaacccctgcaggagctggccacccagttctctatccctgggaaattcctaaattaccaccaataacattgccctgggtcacaagggtggggccttgaattctttgggggttgatctctgccagactctagctacttttcctttctgcaccccagcttcttcccatgggcactccaaaaggtcctggctctctttccccagttttccattagaaacttgtccatttgacagtaactttgatcttctttctaagaagagctggcatccaaggtctgtggtcagctatgttggaaaaaagaaggagaaaaaaactagtttgtattaaattctgaaagactagtggcactggttaagtctttaaaggattgttaacaaaagaaaatctttttaaaccaaactcctaattttatcagaattgtaactgaaaatataaatgtatgaaaacataggtattatgtaaaatttgctcaataaaagaataggaaaaactactatttatcttggactgatagcatgttagtttgagatttgaaccctttctactctagtaagtagtggtgggaaaaattcactgtaggagtctgcagacataacaaactatcattagactgccaagacctccacataataaagcaagcagagaatgtcaaataagtatgtgaaaaatgatcaaaaaagagaaattgaaaatataaatagggtgctattaaaaaaggatagcatttatgttatgacatatgtacacatgaatatcactttttagaatttcatccttcttaggacttattcctgagtccgaggattgagaggttctgataaaataagtctcagtgggttccaggcatgggctttctttaaaagtctctccagggattctaatgtgttgccaggaccaagtaccatggacagccaagatctcatcagcacagtttgattgaatgaacttatgtagaaccctgaatgccacacttaaccaaagaaacctttccagggattaattataggtgacagaacatgctatattcttattaaatattattaaaagttaagcaatacccattcctgattcatgtaaaattctcacttattttccaagagttttactgtatgactggtttatgggatgcttggaaaaggttgacagacatggcaaaggttcctgcagtgtttctctttgtccatcaacagccctagctcataacctctaccctttcagctaaaagcaattagctcttcagaagtgattcattctatttatacttgggataagtaacatcaggcagtcttccctagggcttctcacgggccctggtggcatttttattctaagagagggttatatttttacatgtaattggtcataattatactaaaaacaagtaattggtgtcttatacaagaaaattatatttctgctttagtcattgacagagtatcctgagaataagagttaagaagtatattcattgtcatcttatttctgatatatttcaaattcttttgctaggaagaagcccttttgactgtgctttgtgtaacaaaacttcttcggagaaacaatttagataaactttgtcagatcttatgtgattatattcaaaatgctaattgaagattctctaaacattttcagtaaaatgttgaattgttttcatgctgttaaataagttaacatgtcttcctttactaaagtcattattataaaaatgtaaatcctaatgataatagctgatgtttattaagcatttagtaggttccattttttgatagcaacttttatgaattatctcattaaatcttcataataatagcatcaagaactacaaatatgttttcatgtaagaagggaaataaaattatgagttttgctgtgaggtttgaagaatgaaaacaatgcatgacttagaaaatagtataattaagtgaattttattatcattatcatctcttagtttataaatgaaaaaactaaggcttacataatgtaaaaatcagttaacaaggttaaacaaccggtagatggtagaggaggagctgggaataaatctgtacatgtctgaatctggagcaggaacccttaactgatgtgtcattctagcaggtcatcagttactctacaatacctattaagtatactttatttactgtgtttagatttatagtagatttagactctactgtaaaaacaaggacttcatacacctgctagaaagtatccatatcatcttgtttgaaagttgtcccgctctagtgttcttttctaatcatgatgattcagaactccaaactcttgaagcagggcaacccgtagggtcagcattcataatttctcaatacttaaaaaagtttcctcatgactgttgctattattgagatttctcaaatgtcttggcctgaattgggtgtgcactatgaaaaaaaaaatggcagacatttctttttgttaaaggaattttaaaaacacatataaacacactgatttgtgacagattaccaggctttatgtttagcagggtttcctaagcaaaacacaaattctgtaaatctacagaattagataaaacattgactcaatccttagatgagagtataatggattatcacttaataacttctgtcactgaaaataaatgatgtaaaaagtaataaagttctactctcacagtatgaataaataggaaatacataatactttaaattaggcaacaaatcattaagcccccagcattcattagactatcattaatgataataaaattgtgtggtatttatacagatattatatgtaactccaggaattttgttataattgtgtatgaatatatttgttgtttgaggcaggtagatggatatttgcagcagctatgtgctgaagcattctggtaatagttttcaaatcaaccatttttttctccttgtcgatcatctttaaagcaaaagcaccgttttttactatattttttgaaaaaaatacattaggtgtaaaattatatattttgaagaagttcactttctgtttttactagtttcacacctttgttattttttcagtggaaggagcagagataggcaaaggcgaagcctgtgtgtgtggtcaggttcctgggcccttcatagcatctgatgccaagctgtgttctcttttgtgtcattgccttcccacttgctaattacgtgacagagctagggacttccctctgtctagaatgccccccatctcttgtttgcctagtgaaatctggtttgaagttcaaggtctgatacaaaccaggtgatcctctgcaaaactaactgtacctgagcaaaccaggcacttactcttttatatgttcctggcactgctgatactctgatagaaaacatcatcacttaatgctaactgtgggctcacaaaggggatacttctactgtaagaagactgtaactcttcttagcacagagattagtaagtacttgaaacagagtttcacatataataagtgttcaataaattttattttttatttctaacacttggcacactgcatagctcagtaaatgttggtgaagtgaactgagtattctccttatctattatgtggtaggcattattctagttgcttctgttataaaccaactcatttaatccttatcacagcacttttattgtggtcaatattttttaatcctcacagatggctaaggaatcagcactctgagagattggttgacttgctttgggtaaggtgcttataaagtggtagaacaagattcctatccaggccttctgattcaaaaatacattctttttttttttttttttagtagtgttttctggaaaggcagggtataactgactatgctgtgtatttgggactaagtatattattgtcaagtatattaaaaatgtcgcaacactggaaaggagtccatcaatgggctatgcaggttgagggatttgtagatgagaaactgataaatttggttagcaaggaaagccatcaagctgtgaaccctttatattggcaaaagagagggtcctttgaaatctaagggaacagaactttcctgttctccaagtttggagcagaataggtaagctctaggcagtctaatgcccaacttttaccagtggtgttttagttttttttttttttccaaaaggaaatgatggaattctttatatacttctgaattgtctatcttttcaaaaataaaaattttcattttgcagtacatacagaatcaaaagactttcaagtcctaactccacaaatgtttattttgaagctctttaaactgtttaccacggatattagtaaatctgtcagaaatgaggtgacttacttatccttgtcccaccagatatgtgggaaggatgatcacgctagatagcatggatgggtcctctatttatctctttttacttgaatggaaaacacatcattcagattaatcaattagtcattgtgactgatagaatttttatatggataatctgggtttggtccctagctttaccacttacttggggtctttatgtcttctatggtctcctatctgtaaagggaagttgataatgccaatctagctaggttactgagatgcttaaatgtgtaatgtatgcaaagcagcaggtactcaataaagggtaactcttactattattgtatagctctccaggtatgtattgagcttctatagaatccatagccccaaactctttagccctttgagaccaagattaagcattgtctttccagaggagagggtgagagagattgccattatactaatagaattcatcattatcaccgtcatcatcatcatcatgatttcttggtgtgtcatggaatgtactgtgtttcacattaccaacagatgttaattttcacaacatccctgagacaagaaactatgattacattttacagataaggtcatgcagctataaagttgtgaaattgggattcaaactcaggcagtctgtccccacagtccatgttcttaacccaccatgctctcctgacacttgaaaagttaggaggcgtactccatagcctgtaatgttgctgcagagagaatctaattttaaatccagtgaagcatattagttgctgtctttgatatgccattcagattgtgctatccttatgatgcctaccttggttgtatatgtaactgggcgtcaaatatataaatactcaaaaagtgataggtgccaataaaatattttatagttaatacttatgtaatctgtgttctctgtgtttgagggctggttctaaaatactgctctatatttgacttctggttaaaacaataaactttgctcatattagttatatagttgataccattctcatgttgctaacatgtctgtaagtaacagttgaaattgatctggcaattttagagctgtcagacccaggagatgagagaaacatttaaaatgtttataacattaaatcagctgagtcaagagagagaaagagaaagatgattcagatttcttgtactggtggatgtaagtgcttggaactgaaataaaggagaaggtgtagggagggagaaagataaagaagtcttccctttatacaagttgaaattgagttttctttgagatatagaggtgaagacattttaagaaacttcttaaaactctctaatgtggcttttcaacctgtttccatcaatttggcacatctcacttttcggcacaacagaatattctaggtttatctcacaccttccttgccccagcccaggaatcagccatttctctaagaaactcttgtttattttggtggggaacagtattgggaaaccaacatctgggagctaaatatactcctagtggttaggaggtcataccttgtagactcttgtagctgacggagttaggacatatttattagaaatcataagtttatattgatcttgctaggatctatccaatcctacaagattcttccctgtgtctctcctttgtatttgtgtatcctttcttccatattaagaactgtggctcccaacaacaaggcatgtgcccatttgcccaatcgtatgatgtataaaaactactttgagaaaagtggcagccaaaccactaagaaaaataaacttgctgaaatgagttcaagatttattggcagctctttttttggcccctagactgaaagtatatatttcaagtattgtgttcaaaaattatttgggttagctttttccacctttcataatagtaatattatttacttgaaatacagttggctttgtttctatattcagtttttttctctctatcttcattaatttcattatatatatttaatatgtaggacattaacatgtttccaaaagaagaaaacactccttcctgtatcatttccacctcatctctcttaccccttataggtaaccaattgcactggtttctagtttatcttacttatattcctatttgaaaagttacctcatatatgtatgttttttaaatttttatacttttttacacagaaagtaacgttcagtatgtactttgccactttccttttaaacttaacagcgtatactggaaatcactccatatcgtgtcacagagagcttccttatattttttaatagctgtataagacttcattgtgttgtctgtaccatattttattcacttccccatgtgtggacattttgactgtttctagtatctgcaattactaataatgctgcagtaaactttgtgcatatcgtaccttggtaaatttctagacatagatttctgggttaaaggttaagcacatgtgtagttttgttagatattgataaattcctttccatggggtttatatcatttttaaaatatttaccagcaacgtataacagcgtccattacttcaaagcctcaccaacagattgtatgttttaagtacttttatgttttagaatttttccaatgcgataggtaaacaatggtatatcaatatagttttaatacattaaagttcagcatcttttcaagttcggctagtctcagggctattcttaatatcttgtgaattatcttcatattattttcccatattccataatacttttggttttttttcctcctcaattctgacaagttctttatatttcaggaatattagccattttatttgatatgttacaaatatttttctcccaatatataacttttctcttataacgatttttttttcatgaaaagtttttaattaaaaccttttatgggcccaggtgcagtggctcacacctgtaattccagcactttggaaggctgaggtgggcagctcatttaaggccaggagttccagaccagcctgaccaacacagtgaaaccctgtctctactaaaaatagaagaacattagctgggcttggtggcacatgcttgtgatcccagctactcaggaggctgaggcatgagaatcacttgaacccagcaggtggaggttgcagtgagtcaagatcgtgccactgcactccagagtgggcaacagagtgagactctgtctcaaaattaaataaatatataaacaaaaccattatgggccaggtgcagtggctcattcctgtaatctcagcactatgggaggtcaaggtggttgaatcatttgcgccaaggaactggacagaccagcctgggcaacatgggaaaaacctctctctaccaaaaaagaaaaaaaaaaaaattagctgggtgtggtagcatgcaccagtagtcccagttactcgggctggtcacatgagcctggggaggtcaaggctgcagtgagcagtgattgtgccattgcactccagcctaggcaacagagtgagaccatttctctaaatacatacatacatacataccttttgtggagttaaatttacacactttttctttattggctctggcttttgcattgtagtaagactttctttacactcaacttatagataaattcacccatgttttcttctagtacttgcatagttgaattttagatctctagtccatttggagtttattttttgtatggtagaaggtattgatcctattttttcccaaatagttgttacccagttgtcccaaaacaagttattgaaaagtccatctttgtcccagatagactggaacaaaatgaattaaagacttaaatatgaagatttttacttgtgtatcctttcttcctagaaagaaaacataggcgtaaagcttcatgacgttgaatacttcatgccattggtctggcaataatattactattatgaaaggtggaaaaagctaacccaagtaacttttgaacacagtacttgaaatatatactttcagtctaggggccaaaaaaagagctgccaataaatcttgaactcatttcagcaagtttacttttcttagtggtttggctgccacttttctgaaagtagtttttatacatcatacaattgggcaaatgggcagatgccttgttgttgggagccacagttcttaatatggtagaaaggatacaccaatagaaatatttatatttaagtctggcaatcatttttaagatgtgaacttgaacaggcaacaaaagcaaaaataggtacgttggattacatcaaacccaaaagctcttcacagcaaagggaacagtcagttgagtgaagagacaacctatggaatgggagaaaatatttctaagccacacatctgacagagggttaatatccaaggtatataaagaactgcaacaactcaatagcaagaaaacaaataacatgaataaaaaatgagcaaaggatctgaatagacatttctcgaaagaagacataccaatggacaacatgaaaaaatactcagcatcactaacaatcagggaaatgcaaattaaaaccacagtgagatatcgcctcacacttgttagaatggctgttatcagaaagataaaagataagtattggtggggtgtggagaaaaaggaactctagcccactgttagtgacagtgtaaattagtatagctgtgatggaaaagagaatggaggttcctcaaacagtttaaagtagaactaccatatgatccagcaattccacgactgggaatatatccaaaggaaatcagtatattgaagagaactgtattttagtgattattgcagcattgttcccaatagccaagataagggatcaatctgagtatctatcaatggacaagtgataaagaaaatatggtgtgtatacacaatgggataccattcagcctttgaagagaaggaaatcctgtcatttgccacaacgtggttgaacctggaggacattagctgagtgtaataagccagccaccaaaagaaaaataccacatgatctttcctatatgtggaattttaaaagttgaactcaaggaagtagaatagaatggtagtgaccaggggtatgcgataggctgagggatcaaggagatgttggtcacgggatacaggatttcagttagataggaggaagaagttcaagaggtctattgtataccatggtgagtatagttaattataaagtatacttgaaaattgttaagagtagattttctgttcataccacaaaatgataagtatgtgagataatgcatatgtaaattggctcaatttagccatttcacaatgtatatatatttcaaaacaacatgatgtacatgataaatatacagtttatttttaattaaaaattttaaactctctaattggtcttcaacatatagtacacaagtcttttcacgactctttataatggaacatatgttcttggaatgctaaaaattattttttttggaggccctgcaaataactaaaaatttatcttaaaagccacacctaattacttacatatgatccagaaaggatactttgaaaaagctttttaattgataaaatcattaaggtaaaacatattcataaaagtgttctctaataattttataattttctagttcatgaaggattaaatatacaactatcatttgaattggattttttatgaggttaattgtatttaaatgctaattattttaactaattttgtggttgacttctatgtagagtagggaaaaagaatttcctaaagccagttacgtatatctctttttagtctggatttttaattaggaaaagtgatatagttaaataggtctactctatagcatcttctaaaatgagtaaaaattcattatatcaggataaaaaatgataaagatatatggatgacacatttggctgaatttttcttcttcgctgttctcttgctctctatttaaatagtcttagctcttttatcatttaaattctgaagtattgaggtgattattccggcagcaggtgattctgctaattactgttcagtcagttttagctattagaaacagagatatgtttacattgctgggctgcatgtaaatttagaagttacatggctttgtttttactttgacttacggcattaaaattattttcatctgtgtatgtaaagatctgcatctataagcttttgtggataataaggtgaaattgatgcattttaatataaattgccaatataaaatatctctaactcagacctctactggaaagttgtcaaatcttatgtaggaaaggcttttaccatcactgttacacattaactgggcatagtttaatattaatagctcctgagacttgtggttaactgaggtttctatttcctgtgtttgggttttatctttgcaacaacttggttgcttttctgtgtaaaatagtggtgaatatacacaagagtatgacaaggttctgggctcttaactttgatgaacaccatgccatttccatcatgctgcactcaaaacagcacagatgtgagtctgggagtggcgtccctgccgctctcatgagcctttgtttggagaacaccctgattaacccccacccttcacggttcattgactcactgatagatcaagtttaaactagtatatattagcacatttgttaccaacagaggaacagttggccattctgttttacattgctggttcattgcaaactggcgtgctaaaaaggtctgtactctagagtatgaattgggaagttaccaaaggactgagaaccaagtcagttgcatattaatgttgaattatacctatattttaatcttggattgtctacttgggggatgcttacactgttgtcaagttatgaataagtgataattaccactttgaaattcatctttttttttcaaggagtttaggggatttaggtgtctcaatatagctttcatattaaacagtttgtcataattggatgagagcagagcaaggtcatgactacctgatgccttgtgttggagcattttaaaaatgttttccagagagttatttgtacctaatgactttacataagtccttacattatactttatttctaggtcacctaaaaatgttaattgtttagtcaagagggttaggatgtgtgtctgttttctcatgaaaaaaattaagctgttccctttttatcaattttcttgcaatctaaaggcttttttttcttaccttcctaacctagtgactaaggtcatcttattgttacagttcctttcatgggagataggtttactgcatcatttggcagtttcatagggtgaattttgtcttggcttcatctttccttactggttgtcatcccctgggccacctgcttttttgcattttcctttctcttgtgagatgatgaagctctgtgccccgatggggatgagagacagcactctgagttcaagtctaggataaggcaatgggcttgcttttcaaaacaaactagtgtcatacgggctgctgctttcaggtccactgtctgattttatcactgatgacttgtttctggaaggcaaactgatttaagttctgagcaaaagggtcggtgtttattttcaatgctactattaatttagagttttaatttagaaaagattttttaccagttctcaaatatgatttttctattgactttaagtttgtagatataaggagtagacatgagatagagactgaattgcttttttgtttttaaaacttggcagtaataaggggttgcttgttttttcatgctaaatattttttctaagggatctagatacctatcagaaaacttaactttgataactctggttctttattaagtatttttgtcttattttaggaattaatagaaatagttgtaattttagacttcctttataaaataccaatttaaagagaagctttttgcttaaatgattgttttgcagtgttgtgcttttgttttctttaatgcagttgaaatcgcagctttataacttattttttaatttggggtttttaaaagaatattagttatttatttatatttattgggcacctactgtgtgccagacactattctaggaactagtaaacatagcagagagcagaatcatgaagttcttgacctcaaggagcttaaatcctagtggtagagggggaattcaaaaaaatcaaataaatgtatttctattatgtcaagtgatggtatgtactaccaggcaatcagatgaaaatatttcctcttctatacacagtgggcaaggaaggcttcattgactgtggagttttagaagaaagctgaaagtaatggggaaagagagccatatcgatatatgaaggaaaacatggtccaagcagaggaaacgaaaagtgcaaagaattgagcaagaaagtcatgttcaagtggagtcagcaggggaaagagtaggtcacaaatgcggctgagggtgggtcatgaagggccttacaagctttgtatgagtttttacttttattctgaaaaaaacaaaaacaaaaacaaaaaaaaccggggagctatttggggattttaatagaaaagtaacataatttccttttaaaatggatatgtggccactaagtggagagagtggtgtatatatgagtggatggaataattgatacaggcaagcaggagacaggttaaatgaaaaatggattaatccaggcaaaagatggtgacttaaattaagctgggagtgggagagatggtgagacatgcttagactttggattcatttttccagatagaactggctgacagagacatgtcatttaccaacatagacatggcagattttttttttcttttctgagacaaggtcttgctctgttgtccaggctggagtgcaatggtgtgaccatagctcatggaagcctcagactcttgatatcaagtgatcctcccacctcaacctccctagtagttgagattacaggcatatgccactgtatccagccaactttttttttttctgtagagacaatatctctctgtgttgcctagggtagcctttaactcctggcctcaagcattcctcctacctcagcctctcaaagtgctgggattataggagtgagccaccatgcctggccaatatggcggttattaagaggataagtcaaagattacatgaatattctgttatgaaaagtgtcaaacatatagaaaatataaacagtattccagtgggcacccatatttttatcaccttgattctacagatcttaacatttttctgtatctgcttcaaacattttattctgccaatgtgttctaaagtaaattgttgatattgtgatagttctctccaaaatgctgcagtgtgtagctctaaaaatagatatttttcagataaccaaatatcattaacctgccaaatcaatgaatgataattgcttattaacatttaatacttggtccatagtcaaattctccatattttccataatgtcttttatagttaacttttaccaactagtgtctgatcaagaatcattcatttaactaattacatttaaactgtaacattacaacatgttttttcgtatgttttattctctctgacattgacttatggaagagactagattatttgtcctgtagacattttatcatacataagagttactaggagagctctgattactagtccccactctcagaaattttgattcagttgctctttccagtgagctgctggtgatgctggactttcattctgaagaccatactttgagcactactgctgtaccactatccgatggcttctttgtgatatcgtttaacttgttgttctgttgcctgtatttcctctaaactgaattttcaatctaaaggcttactgagattcatgtttgatactttgggcaagaatacttcataagttctagtgcttaatgttaggtagcacttaattctgactatttcactattcatgaggctaagctaaggaggtgacagcctgatccttctattgtaatgtttcatgtgaaactactagataatttgttgagttggggggtgggtagggaagagatatctagttttcaataaatatttcacctaatggttttaacacacattgatcatccttgcctgaactaattatttaattagggatggcaacatggagactttctaattcaatctttttttttttttctaaatgaatggccttgtttttatttttaaatggatgttacttcgcaactggggttatttgattacccagaaatatagcgcatattaaaaaggtaggataaatgcttagttaactaattaagcaatttttaattaccagttttcacagtaaggcactaaagtttctgacttgagcaaagataaagtggaaagataaagtggtcgtttagtgagatgggcaagactgtggataggtagactaggtttggtgggaaagtcagaatatcagttttgaatatgttaagtttgagatgtctattagaaacatatgttgacgaggccaggtgcaatggctcatgcctgtaatctcagtactttaggaggctgaggtgggcggatcacctgaagtcaggagttcaagacgagcctggccaacatgtgaaaccctgtgtttactaaaaatacaaaaattagctgggcttggtggcatgcacctgtaatcccagtaatcccagctacttgggaggctgaggcgggagaatcacttgaacccagggggcggaggttggagtgagccaagatcccgccagccactgcacttcagcctgggtgacagagcgagactccatctcaaaaaaaaaaaacatatatatatatatatatatgttgacaatatttcagttgaataaaataaaatattctagctattttaggtagaaaggcattttataccgatactactactaaagggtaagaagatatgactgtagtacattaaatatgctgatggcctacaactgttgctgtgttgctttttcctcttcaccacacatatgcagcctcatgaaacattttccatgaccagcacactgaaggaaataaaaggaacctagtttagagatggttctgcatgatacaacaaaaatgagctgctaaagcattacaatcccactcaagagtattcccccatcaaatagtggggctggtattttaatcagttgatactaattgtcaaggtgtgatggccaagggattgatgtttatcagtgtatggacagtggttcagagtttggtgaattagtcgagttgaaagagaaagattggtgacaaagatgtatgaggtggaaagtatactttcacagaataagaacagaaaatgagatttatgtttttttgtaaacgttcaacaaagaaaattcattcagaggaggaaataggtaggcaagatgccctattctacagatgttagtcagcatcactgcaaagcaacctcagggcttatgcagtggacacttaaaatagcactggtgcagggatgggagaaataaatggatttaataagcactgctgcttaccaaggttgattgaattgccactattgccaagtgttctacctgcaaacagatcaaccttgagccctggatatggcaccatgtcccagagcaaccagccagccacctggtggcaggttgattgcattggatttgctccattatggaaggtcagtggtttgtcactgctgcgatgaatgcttactgtacgtttggatttgcattccctgcccaccatgtttctgtcagcaataacatggccttattaaagccttattcaataatatgacatcctatataatattgcttttgatcaggagactcattcacatcaaaataagtgaggcaattggctgtcaactacaggattcactggtcttaccatgttcctgttgtagcatattgtattctacctggaagatgaaaccttgtgacattaaagtagtttttagttccataaacataatacaggggtctatgaatcaagaagtggaggtagaagtgttgtcttttacttcacatctaatcacatgttcaaaatattttttcatcttgcctctgcaactttgaactttgctgacacactgaggttttagtgtgaggaaacaatactttcacatgggaacatgatagtcgttcaattgaactggacatttagaataacctggccacattactgaactgtataactgaaacaacaaatgaaaaaaatgaagatgctacgctggcaaagatgattaattttgattattgggagaaatagtattgctactgttaggaggaagactatatgtctagaaactaggaggaaacctgggttgcctccttgtagcagggtaaaatgagtgagtaccttgtctaagaaagggaacatgaccaaactgaacccagaagacataggaaatctaaacagatcaattaacaccaaagaaacgggcattttttggtacttctaaaaaagtaccagactgatattttcacagagatgttcgttatacccttaaggaacaggaacagaaaacttctatactatttaaactattttagaggatagaaaaggaaagaaaactccagattttatttatagaacttgcatgaaattgataccaaattctgacaatgcaagttcaaaaaggaaaactagagatcagtgttacttatgtcaaacagctcttaatagaatagatggatatggttatcaacatgataaatatgtttatcacattttaaagcctacatggagaaacatttgaggttttcttattctagaactgacaggaatgtcctttattatgagcactattagtcaaatttttctggtggaactaatgtaagtagactgctgaagaaaatgaatggtatgaacattggaaaggggaaattaaatgattattatttacagataaaataattgttaagctggaaaatccaagtgaataaagggaaggcctacaattaagcagttaaggaaagggctaggtatagaaatcaatagttttgatatatgcaggctatagccagttaggagatcagttaggggaaaaacacgttgacagcagcaacgaaaagctgataaacctagaattgttcaccacttatcttaaaatgtttaacatggtactgagggacacaggagattatttatgtggaaaaacataccatgtttctatacagaaaaattgaacatcacaaaagtattatttgatcttaagataatttatatttaatgcaatctcagtgaaataccaggagaatgtttttaagctagacaaacttatttcaaagatcatatgtaaaaataagcaaaaatagatgtgaaaaattctttaaagtaatgagagaccagtcttattgactattaagtcattataaaactataatgtttaaaagatggtactgacatatgaatagatcagtggatctcagatgggcagtgcagaaagagatccaaacacatacaaaaatttagtacctctaaaggtggcatttaaaatctgtggggaaagatggattttccaatgaataatgttgggataggtagatagccatctggaaaaaatgaaagtcaaatcccaactttttaccttttatcaaaatgaacttcagatacaattgaaaatataaaattgagaccataaaagtattagaagaaaaatgcagtttttaagtctcaaaaggggactcttaaatatcatacaaagcccagaggccataaaagagatgattgataaattcaaatataggtccgtgtaagcgaaaactttcagtatggagaaaacataagttattaaggcaaatgacacactaggaaaagcatttgtaactcataacaagcctagttttcttactgtgtaaagtactgccataattgacaaagaaaatatgaagaattggcaagtgacatacatagaaagttcatggaaaaaataactcttaaacatttacaaaattttacaacctctcatgaaaagagaaatggaaattgaaattagagtcacatacagtatttcacttttcatttgtcaaagatcaaaaagtttgaacatactgtgggtttatgtttataaggatgtaagaaaacaggcaatctaaattccttgtagagtgtaaattggtagtaataagagaaaaatttactgaatactttgtgccaggtgcttttctaagcactttacatttaattatctcaattaacttatccagaaagtaccattatttctgtattacacgtgaggaatttgaagaaaagttagacaagtaattcaaagtcacacagttaataaatgacagagtgaagatttgagaccatttcctttttctcaagtgtccacttttggtcgcaactctgctgtttctgtagtgagtgatttaacactatatgataaaaccttaagagtacgtactctttgatccagtgattctacttccagaagtttgtccattttgcatcaaatagatggagaatagcattcattgcattgttatttgcagtaaaggaagattggaaacaacctgaacatttatcctcaaggactcatccatacaaaagaattgaagtaaattcatccagatgaatatgaggcagctttagatagagtgagatggcatcctatgtagtgatatggagtcatctttaaaatacagtaaaaggaaaaagcaagatacagaatagcatgtagggaagctgctgtctatgtgaaaagctgtagaatatacgtgcatttttgtatatgcatagaatattcctagacaaggacaaacatggtggttcatacctgtaatcctagcactttgggagactgaggcaggtgattcacttgactccaagttcaggatgagcctggccaacatggcaaaaccccatctctagaaaaaatataaaaattagctgggtctggtggtgtatgcctgtggtcccagctacttgggaggctgaggcaagaggattgcttgagcctgggaggcaaaggttgtagtgagccaagatcatgccactgcactccagcttgggtgacagagcaagacaccattcatctctctatctcttttctctctctctctttctctgtctacacacatacacatacccccccacacacatatatatacacacatatatgtgtgtgtgtatatatatgtgtgtatatatatacgtgtgtgtatatatatgcgtgtatatagatacatttctagaaggattctcaaagtgatatcagtgattgttgtgcaagaaggaaactagatatcagtgaatgcgctaaataaggtgattttgaattctgtagcatgtgtatgatttacctatagagaaagcagtctagcatgagcgtgggtttctcaaatatagaatgtttgcagtgaggtcacttggtgaaaagtatagccatgtcagacagatgtaggttcagattccaggacttccaggactgctgaaagggaaaggggctttggatctccttcagctccaggcagcattgctcctttcccagctttgacattagctggagggaagacaagttcttagagctctatgtgcttgggacaagaccccttccccctactgccttactcgccaaccataactgctgcaaacaattcttacctcttccaccccatgtcactgcctaaaacccttcatcacctggcctcccatgcctctaagtctctgtacatcccctagcctgatactgtccccaaccctcctcaactccagacaccattttactctaccctctggaattgtccattattagcaaaatctcctttattttcaacctcctttctaagtatttcccccacattcttgttgtaatagagacacagctttcccaggactgtatagctttccttgcagtcctctaaagtggtaactggtttctctgccatacatttcataccactggtcctggagatattgtcaatatcttaatgtcttccttccatctcacttaaattttgagaccataattcctttttcctctcttaaaagttctcagtgttgaagctcaatccattagatacctctagctggcactactagttgcagtcctgtgcagactactgagtcattttctttactccctgaagacttaaactctatcttactctcactctctctgacattactcctattaaaatgttatgtttctttagctattctttcagtttttggtctcctctccttcaacgaggatgatttctagaatgttggttctcaaaatgtggcccctttgcagacatcgtcagcacctgggaacctgttataaatatgaatctgcagaccacaccccagactactaagcccaaaattctgggggctggagcccagaatctatgttttaagaagcacgtcaggtaattctgatgaatatgccagttccttagatcttgttattgtcattactgacaactttctctgagaccacaatttgaatctaccaatttttcactagtactcacccatcttaagtccttactttccccttaccagccagacatttgaatattccttgactcttctctttcacatactatatccaaagagtcaacaaatgctgtcagctataccttcaaaatacatgtagaatctaacttttaacctccactgcagtcacttcagtccaagcacaaccatttcccacctggagtattgcaactgttcttgtttggtggcccttggccctactttatctactttccgcaaagcagccagagtgtttctttcaacacctaaggttatatggcttcattgattgaaattcaccgtgcttcacctctttctctacaaaagccaaagtccttgtaaatgcctgtaaggctcgagggtgatctgaccttccctggcctgtcgtgtttcggtaaaagtaagctgagtctttcatagttaaaggacagcaatattgtcctgcatgatattttaaaaacccaatcaagaatcacacattgcatttaattttcatgcctttagtctccattaaaagtgtgccctttgtattaataattggagtgatgagggacagagtttaagaatatataaatattttgtccccaactgactgtcactggatggctttggcacccattggtgattcttacctgaatcagtaattattgtgatgactgaaaatagtgatttttctcactgtataattcttctatatttattaattaccttaatattatcctatagaacagaatgttcccttctcatcttttgtttgtttagtgtcagtattactcatgaagttgggtgtttagaaaattcaatgttgtataatactgttattattcaatattgtattttctcagtttgagtcttccatctgcgtcctttcatgtaaatagtataaagatcagtaatagaggaacatagagtaaagtgtgagcagagaagccttactctgagacaaacttcagagaggtgaactctgttgctgattaagaaaggcttcactgaggaagtgttgtttgaagtgagctttgaaaagtcataaaattttgacaaaagtggggatggggtggagcttaaaggaaaaactgtctgaacaaaggaaggcccggcagactaggaatttggcaataatacagtggttttggaccttgatgaggaagttgaaatggaacataaaaaccctctgcatttagctccatttatttgctcaggcagctctcactgcctaaaattttcacccctgctgttttgctcaggggtgggatgaggggtaatgagggaggaaattttagggggtgaaaacagcacaagccaaaaaccctgctcagatactcccttctcttgaagccttttccagatccctaataagaattaaccaccctctctcacacactctgttgtactttgtccttctctgttaaccagcctctgtgttttgtgctgtctgtatttgtggatacatcttcctcctttaaagcacgaatcatatcttaatcccttggcccttcttcccagtacttagcacaagtgctcaatacatgtttctttaacgcgtgtaacagaggaaggcgaggagagtgagtgggattgggagcaggaggattctgaatgtcattttaaggggtttgggctcgctcttcaggcagcaatgagccatagccgcctttgaactgtgcagcactgaccagagctgtgatgccaaaggatgcagtggaaggggaggacagccagcatgcctgggcatggtccccaagtcagaggacatcagtgggagaagggagaaggcatggaagcaagtggctaccatcttatgaatctgagcactcattcaaaggtggcaaggaaaaaggaaggcattgagcacggttttgaggtttccagcctgggtgattggaggctgatgcaggcttcttaccaaaaagggccctaggcagtttcaccaggaatgtttaaggagtttatcatgaccctatctcttcctcgtctaaaactctccctaaaatcaaaacagtatgtcctgttgaaatactttattgtatcaaatataatgagaagtaaaatattctctctacttgatgtatgaaacactgacttcttgtagtggacaattttcacttgtctttttagtaatggtttttattaaaaatagatgttaataactgcttgtttaatctttaaacgtggccctctgagagcagcttaccgtaaaagaaacggttgtcagctttctttttgctcctcagtccctcctgccccttcctaacaacagaaaatttgctttgcacctgctccaactgggttcgaagagataagcatcttgcaagcccagaaaattgtagtatcaaatctcagccccaactgtgaggcagcactatcattgaatccctgctgagaggcgttgctttcccaattcccaaaagagttctttctcccctggccccttttcaggcttgaactctgaccgaaaccctctttttaactcccagcatgcactgcacttggtactgacactgacccatccctgcttcctctgttctgcactggactcatcagtaggtcaggcgttggtagccctggggtcactggggtgcccaattccaataatgagcacatttagctaaggagaggaaatgtacccttctatttgttacagtccattgctttttttccagaaacaaatgctaaaagaacatttgatatattgtggtttggtaaatacacatagcactgcctaatattcacaaagttgcctcttttttttgcatcttccttcataaattaaatatattgttctaactcatgatttattttaagagggatatacctatttcacagctaggaaaatgttttcaaataaagttatattcagaatactcttgcaagaatttcaaataaaaatagcaaatactatttaaatgcatataacattctaacagacttgtgtgtcattttaaagggaaagaaaaaaaatgatgacaaggactttacaactttgtctttaaaatttcttcttaggctttccaaacagaccgaagtcattaaaaatactccttaacccccaaagtcacaaaaaagaagctacccaggtttattatgagaaggttgaacctctgttgaagcttgcaggaataaaaactgatgtaacaagtaagtaattttcagaatataatttcaccatctacaaaaacatacaaaagcaaaataatctgaatttgtccttaatgcaaacttgggaaactacttgtaatatctatagcatttttacgtcttcataacctactgcagccagctcgagggttataatttaattatttttgttatttttattagaatattaatattttctctttagaattttttcagatattttttcagacttaaacaattgttagatataattacaaaggaagctgtatacttgtttacatcttcatggagatgtttgctacttacacgttaattttgcagttaggcaagaaattgattttttgctcacttatatagttgatgtctttccatggaattcttccttgggttgttttcgttctgactctgacccctggtggttaggtcaaaactaagcactgaactgctggttttattaatagatgaatttagagatgctagaagcttaaatttgttgtctaaactaagaaatgtacttaggtttgtgccaaggaaaatagaaacttgttaatgctaaacttaatagatgattagtaatatcctttttgatttttttaatttggtagtcacatttctttgtttctttgagacttattttcgtatggtggggaactgagtagaagagtcgatgctatggagaatcgcaaccttcctagctttatttctatgtggcttcgctaacagtggaaatttgcaataaattttaattgatgaaaagtattataaaataagcctactcaggggacaagcccagagtgcaattggaacttcctagtcccagttatagattcctagggaagggattcacagtgatgtggctttactcagctgtaaacaaaggagataagtttcaagatgttaataatatcattgaaacctacacctagtgatctgatggattgaggtagaagaaagttcaaaaaaaaaaaaaaagcaagttttgtaggaaggtcagcccccatgaaatgtgcctataactatagaggttcgagagaaactaccatgaaaaactcaagaggaatttttgaattaaaataaagttatagtgaagaagttaacctttatgtttgtgaccttcggcttatttagaggtgatttacaagtaaaagagaaaattcagatttatgttttctttctactgaagatttccaaagattggctgaaggaaaagtttgagatttgtattagggtgagacaattaaaagttgaataaacatattggcatactcaatgactattttgttcattgcttttacatgtgaatactacaaagcagcttaacatggatattgctatatagcattcacttcaggaatctcattgtatgcttgctctgtgttcaacatagtgcaggatgcgagatgaataagctatcatacttggatgactttctacattattagagattcaaaaaaatgcttaaaaccattataactggggtatacataaaagaactttgatgtctcagaggtgatattttgatcggaagattcaagaaaagcatttgaactaggcagtttttaagaggcagacaaaaaatgagggaaggaagtcaggctaacaggcatgtactgtaaaagttgggagggggggcggagagagagagtgtgtgtatgtgagagagtccatgtgtgttacacccatacatctggagagtttgtgccataactttgctctactttcctcagtttttacattatctgaaatcttactctatcatcataaaatagctgccagtgaatttcatcctttcttattaatatccagtgggatggggagaggtgtgcatatgtgtgcaagagagacccaacatgctttaatcctgaagatgaattaaaatttccttttttaagtttgggcacagatactgtattagcgcagtcaatctggaataatcatttatttaaccatcaagactcttcccaggggctgaggacagatccccttttcctgatgactgaaatgcctcagctgaatctggattctgttagggagaagaaagggcaaaatgacttctaggaaggctctcaacaatgtatactacaggaggtataattccaggttatggatggatccttaagctgcactcagcagtttactcatcgtgtattgatccacagttggtgtaaatttttttttatcatactgttgcaatctggtttggcaaagatgactccaccagcagaattaaaattaaaaaggaagagagaaaaagagattggagacaagaaaactgatatacaaggcctgaactaaggcagaggaaatcatctaaatgtgctttccttcttaattgtattggagacaaaactattatgttctaggatttttttctctaaatttgtaaatattactaagtaccatatttaaacataaaacaatagaatattccgtaaagcaaatttagaatttacttacatttgtgcagaatggctaattattagctgcctaacactcctcctacaggcaaatttataaaattacatcatttgcttataaaaccattttagtatgcatattggctcaatatttatgaaaaatatttcttgaataaacctgtgaatatttgaaaagttttagtcttcctgcctatcttacagtgttatttttgtagttgaaataatatatttgaaactttgtatattatactacagaaaggtggtcataatactgttagtttcagtttcaaaaattatgtcatagtaagatcgaattcgtactttatttgaaagtatatggaagagtaaagcagaaagaggacatatcttctgcatgtccagtgggacattgttttaatgtatccttgtgtgaatgggtgagtccaaatggaattggaattacaaaataaaccctatatgatgagttaattaggaaatagtgctatataaatatgaagtataatatgaagaattacagctagatatatacactataaggtactgtaattttttcataaatttattttaaaaatggatcttaccacattaataaaaacacacttctttcattttgggttgtgctgaaatcctaactacttctgaatatagatcagcatcttttgaaatatttgtgctaaagttgcatccccactctgctaccaccaccaaggtagtatcttatctaatagcatcagaaaaacttccgggagaacctggaaagaattattttttcctaattacctattcgtacacaaatcaaagaagagtatgaacgataagcccatgctggcatatgatatcatttctcttgcttctgaaacaaagcaagttttagagattgtaccattaaaggtgtgacagatattttgaggatcagagatccataggataattcatagtacaatagagtgaaaaagttaaggcagcagagaaatcagactgaaaagaactttcgaggccatatggttcaatttttctccttgtgggtggagcacaggtgtgtggcactcaactttggcttggccacctacactagaggcagagtacgttgttactggacaatactgtttgacattcttatgaatgttcagagttactgtacctttgggcagattagaaaaggcacctcctctgtgctgacttacaaaaaggtgccctttcttccagactaattcatcctttgcttataaaaccatttcagtatgcatattggctcaatatttatgaaaaaaatatttcatactttcaaaatattcatatttcaaaaatattcagcccaaggtcactagattcagcctaaagtcatttgttagattgcaaatccgtcattcccgttagccaagtacctttgtgctaggcataaactgtacaaaatgagaacttgtcagctgacattcgcctctttgtaatttttatgtactagagttaatgttatctcttgtagtaatatgaaataaatgtgccccatctattgtataggagtcattgagatatttgaagagagatatcctgtctgcccctcatctcttgttcacgataggtacttccatcgccttcagttactttttgcattaacagagctgctagaccttatcatggtcattatcattatcatactcaaagacatttatctgaaggaaaccttgatctctgccagctcagggctcttgggagtgcctagtcaccagataattttacctcctgggcagagttgtcaagaaagtggtgtttgttatcattttccccttctttctcctaaaatcacgcttctaacatggctgttaacaagcctcttcatagtgtttctctggttgtttatggctctacttgaagccttccatttcttggaaatgcctcttgcctttctaaatctcacccagcagaaagctaggccatctaatgaaactgtgtcacaaaagattccagtagcctgaggcatcactccttccaattttacctgcattttaatacaaaatctgaaaagtaaatgttcatgcatcatatctagctagagagaaagataattctgtgtaaaagattctttttgttacctcttaaataattgtgggtgtatatggccagtcctgttcccagcattcagatgtgagttaggaagttggaactttatacctggggacgatgaagactcactaatggggtatatacaaaaaagtgatatgattaaatatgtatctgaaaatggttattctggctagagtgggggagaggtttgagggagacaagataaaaggctattgtagtacaggtggagtatcccttatctgaaaggcttgggaccagaactgttacagatttaggatgtttttagcttttggaatatttgcattatacttaaccacttcagcatctctctaatttgaaaatcatggacacaggaaggggaatatcacactctggggacagttgtggggtggtgggaggggggagggatagcatcgggagatatacctaatgctagatgacgagttagtgggtgcagcgcaccagcatggcacatgtatacatatgtaactaacctgcacaatgtgcacatgtaccctaaaacttaaaagtataataaaaaaaaattaaaaaaaaaaaaaaagaaaatactccaatgagcatttactttgaacgccatgtcattgctccaaaatttttagatgttgaagcgttttggattttagatattctggttacagatacttaacttgtctacacatgaaagatatttagtgatcagatcaatcagctaatttagggaattagctgggagaaatggaggaatgctatggcataatttaaagacagaaacaactggccttggccatggagtggttctggagagtggaggaaagggacactctagaaagaagtcattttcctgtcttggggtagatgatggaacacaaaaagaacaatatatttgagagagaatatatttgaaggtatacataatggattctgttttgagcttactaactttaaagtacctacaggacaggaaagaaaatgacatttcagtatcatatcccacactagaattttatcaccaaaccaagaaatgtttccttatgtccaaatcaaatctcacctgattttatttcaggtgattttctcatcaacattgaatatcaaccttaagactttcttgtcttcctgaggaagttgcatttgcaccaaagaggggagggggaaattcccagcagtgagaattgtgttcaaagacctgtaaactgtgaaggcttcacatctcctatttagaaagagcacaggttggcaatctcataggaaaaggcaaatagatgaaagaagaggctgggttacattttttgaaattacatttatctagcaatcctttctttgtttgtttgtagggggatgatttgaatctggctgtcactgattccagggcccacaatagcctgtctaaatacatatttggtcctttctactatatttaaatagtaatccagatcactctttatccttttgcctaacattgttttgtataaccacctattacttcatattataattcattatttcattagcatatattgtctatctccagaatgcaaattcctgaggccaaagactaattcattttgttcattttgctaatatattttatagatgtagatagtcaggttcttttcattttgtttctttgttctagatctttgattttattggacttttgcaatgttacttaaaaaattgctattttcaggcaggttgcattagtgtataatcaaattccacccacaatatcaaaaaaagactattacaaattaaaaaaataaaaatagcattcaataataacacagttctaaagctcattattggatctgaaaaactttaccaatgtaagctttggtataaaagtaaggcttggtgaactgattcttagcataaatattttttcatgatattcttatttttaatgtgtatatgtaagatgttttattttgcattttaaggttgtaagtacttgctgtagttataaatgaatgatcagcacacatcttctttgataacctttcaactttattaatattaatgtttcatatgtagttttattatggctttcttctgattggaatttaatatagagaggttttattcatgtgagtgttaatggcattttgaataagctatgggagaattacaatgtaacactgctggatacagaatgattcttttagacaccaagactaataatttttaacaatatcgaaaaacattgtaggaaaagcttgaaccatgctggcaccagggacagacaagcatgaaagattaatgtaatcttgcatataatgacacacattcttacacaaaaaatccatctgcaatgtcatgtcagtcagcagaaatctttgatgggtggatacagctgggctgtctcttctggcagagctgccctggaaaatgctaaatgtggttgtgatgcttggtgccatctgcagtgtgcccgtttatcctgtcttcactggcatttacgatactgcatagggcatcagtgactgtggagacagcgatacagagtgacagattcatttcctcggagggtctgagctctggtgggcctgtgtgccaccctccttcttgggtctgggtctcttataattggtgttggctttactttgtattttcacatccaactcttcctctttttagtctaacagttccagtacacattcttctggtttgtaaatcttacactaaccttttgactaatttattcatgtaaggttgccaaaccgatttaagattgactgttcaatgccagctaatatgccttatttccaaaatactgctcctcctaagcctctgatttaaaggacatgtgtcttatttagggaatactaaacaggcaccaggacaaattgggtaaccactatgcgtgggatattcccaaatgactttatgtagttgaaacaaatatatgaccttctcttacataaagctataaaacatcaggccagtaacacttagtcctcttgcccatgattaaaatataaatattcaagaataaatgctgttttatgacttgaccatatgtttatcatattattttgccagaacaagttaaaaagtgtgatcattgtttaaaactgtcactttgtgtatgtgtgtgtgtttttttaatagtaatggaatatgaagggcacgctctgtcactgcttaaggaatgtgaactccagggatttgatgggtaggttatattattaatcaatatatgttatatcatttatgtattaaatgccttcactagttttagctacatatttggaacctaacatttaaaaatatttgtagtgtatgtactttggctctatcttgttcatatctatgtaataataattaatgataatatgacatggtcatctatctctcaggatctggcataggaaagcaaaaagaggaatctaattattaaaatactgggaaatgacagtgtactactctatacttactaatgtgcatacatttgcatctataattatttgcttttaccatatatctagagaagcactaatggaagatgttatactggtcacatggcataactatatgatgatcttcttttgcaaattaattgataggtttaatagctacccattggttaacttgtctgtgatagattgagggaagatattttataaatacaagtaaataaatacattatttccagaaacaataagaaataattttaattatctcataatgtagtgactacaatttaggtatgttattcacagtgggcatcggaaaccattgttcgcaatacattggagtgtacagagattgttcactggcatgcaaacgttagaaccaaggcaagtgatataaatttcattgccattttttaaaattaggtgaaccaatttgctaaagtgttggactgatgtgtaagactaaaacatattatattcctttagggaagttctttttacgtgagtagatatttgagaatttaaaaagttgacaagtgtgtgaattatttgtgttacatggtgatgggcagggggcaaagacccataaggtcaggaaagggagttaggtctgtactttcaccaaagtgaaaggcattaaccttcccaaagactgatttgaatgtgctggggagggaagtgatgcaatcaaaatggagtattggcagggctgtttttcagaaatgcttatttatttatttattttttggatgaggagaaaacaatagctgttgagaaagaaaatgtggtaagtaaaacatgatttttccaaaaggaatctaattgagggaagtaaatctagatagcaatattatataaacattgggaatcaaaaatatggggtaggagattacttcagaactttatacttagaggtagacaaaaacattaataggcttcatttagaaaattgtcttacaagtatacaatttaagaaaagtccttgtgggaatcatgcataccaactacctatttgaatatgctgcatagtccctcactagacctcatgagtacatgaaggtagctgcattgcaaatgagtacctgcttcaaaacttgattaaagaatgagaataaagatatcacagatattaaacttgttcttacacagcagcattacagaatgttctgctgaatgcagtatctatcaatatgttttactggtatttgtactgggtaaagggatgaaaagaactttgcagaatgaagaaagacgattgctgaagtgtagtacaataatatttttctctttacctgaacatatttaatccttatttatttttcatggcaggtgttgttatttttcagtgtagagctaaaagatgtatagatttttcagttattatattttataaaccaaatagtttggcctaaccattatatgaattgagttatgtaagtgtttctaaactctatggcatgctgatttatttcagacttacaataatttcaaatttctactgaaagtcatcttccgtgttctaagactctttaaatcaggggtccccaactccgagactgcagatgaatatcagtcagtggccttttaggaactgggaggcacagtaggaggtgagtggcaggagagggatcatttccgcctgagctccacctcctgtcaggtcagcagcagcattagattctcacaggagtgcgaaccctattgtgaactgggcacgcgagggatataactggtcatgcgagggatctaggttgcgtgctcttgatgagaatctaatgcttgatgatctgaggtggaacagtttcatcctgaaaccatccgtctcccaccccaccctgcagtccatggaaaaattatcttcccacaaaaaagtccttggtaccaaaaaggttggggaccactttaaatagcttatttatttttgtggggtcagttttcccagtagaagctgatatggtagttggagtaattatcttaataaactggcaattttaagtcactgtacttagaattacatagagagatatatgaggagaataatagaaacatagtttcttcaggtacttcaaaggaacaattctcttgcaagtaaaattgtttgaaaatggaatattctacattggtgagttttctattcctgaacctgttctaaagagtggctaaaggaaaattttgggggaaatttatagaaaaggtgcagagatgagagaaggttaaccccaaaatgctatggcattttgatgagagacagactcaaatttctttaagaactttggcctgaagcacctccgtctgacactagtggaactattaatagggagtgattaggaaatcacctaacagtttggtttctagatacaggctgaagaagttaagagccaagaaagattctatgtatagtatttagtaaagcaaaacaatttggtaagtaatgtttaagaaatgctatttcctaagattttggagttgtatttattttttttaatgaattacatatgtttctatgagacatcttgtgacatttctaaacccaacagaaacagtgtatcagcacttatgacagctagttctccactgcagtgtgtcctaggaaacactctaagatccactgttaaaccttatgagagcttcagattctatattgctccctattttactgggcatgagtaggaagttttaggaaggaaaataaaagaatatcagctgcatagacttgaagcagtaacacttgcatttataagtgtgagtatagttttaaaaatctatagattttatgcaattgtaaatatatgaattcctcgctattaatatttgtttcagaatttttaaaaaaattgttgagttacttttcttttgttcatttcaccattaattagacccataatgttgtagacattatttggattatattgacattttatcagattgaacatatctgtattacttagtaaggtaaaaagcaaaaacaaaaacaaacttttccagaaagaaaaaaaactgtgaatcaaaactacaacaatatattgaacatttcatagatgatgggttcatagataagtataaaaacattcattaaaaaaatctttatcactctttgaaaaaggatatattatcacccagtgtttcttttctagacagaataattctgtttggagccatggcaaggagtttacttattttaaaaacaagatttgtcacatgcaaaggattagttactctaaggtttatgttttagagtgacacaagtgtgattaactcactataaatgattgaatactttgctttttgcctttcttgtatatttagactcttgtgatatttttgtaagaagctgttgatgaaaaaaaccaaactgtaaaatatttaaagaggtttattttgagccaaatatgagtgctcatggcctatgataaccccaggggggtcctgagaacatgtgcccacagtagttgggttacaacttggttttatacattttggggatacagaagttatagccaaagacataaatcgataaatgtagggtattcattggtttggcccagagaggcgggatatcatggagctggtgggaaggggagctcacagatgaattcaatgattttctgattgtcagttggttgataagctttgctgaaagattagaagtcagcagaaagaaatgcttgagttaagataaatggggtggtgtaggctgggtgcagtggcttagcagtggctcacacctgtaatcccagctctttagaaggctgaagaggggagatcacctgaggtcaggagtttgagatcagcctggccaacatggcaaaaccccatctctagtaaaaatgcaaaaattagccgggtgtgatggtgtgtgcctgtagtctcagctacttgggaggctgaagcaggagaatcacttgaacccaggagggagaggttgcagtgagctgagatcacaccattgttctccagcctgggcaacagagcgagactctgtctcaaaaataaaataaaataaaataaaaaattataaaaataaagataaatgaagttgtggaagcacaggttcttgttatgtagatgaagcctccagatatcaggcttcagagagaatagatggtcaatatctcttatcagaccttaaaaggtatcaaactcttagttaaatctctcctggatcaggaaaagacctggaaagggaaggagattctctatagaatgcaaatttctcctgcaaatgatagctttgcagggccatttcaaaatatgtcaacaaaatacattttgggataaaatactttgatttcctctagggcctgctatttgttatttaatgctataccagagtcaggttggagttggggatcttattgctaccaagtctgttttgtcagtcttatgatctattttttttttttttttgagataaattctcaccctgtcacccaggctggagtgcagtggtgcaatctcagctcagtgcaacctctgtctcccaggttcaagcaattctcctgccccagcctcctgagtagctgggattacaggcatgcaccaccatgctcagctaattttttgtttctttaatagagatggggtttcaccatgttggccaggatgatcttgaactcctgacctcgtgatccacccttggcctcccaaagtgctggaattgcatgcatgagcctggccaatgatttacatcttaatgccagtgctggccatttgcgcctaaactccaaaagacaagagggtataaggaggcatatccaacctcccttcctgttatgacctgaatagtttttcagattttctttgtgaccttcatggccaaaaggggaggatccattcagttagttggcgacttagaattttatttttgttttacaaaacttatttcctaggttgagtcactttacctgaacatgatcttaatgattgaatagttgttaacataaataaatacatattttttctaactcacttaatttcacactggttctactggtaaactgtttttcaaaataataagattctcataaggctatttttattaggtttcatatatagaaaaggtatctaatatattgaataatattgtagcttctaagaccaaaatgtcttatttcaaatccctgttctattacttactagtggtacaatcttgaaaaagttactttatctttctatgttttagtttcctaatctgcaaattgaaggtaatattacctattgcatacagttatttctccacttaaatgagttaatacatggagagtgcttaggaaaatgtctgatatatatatatagtaattattcactaaatatttctttattgttataattgtcatttgtattagtttcaaaagatttaacacagaatgtattatgacaaaatttcagatgtttcagaacatgctcatagggaggccacctctaataactctagcaatatgttaacatatgcatgacgctataattgtatgcaacattctaggagttaagtgttcgcatcctatgtatgtaagggtcaagttatttggtgctaaattagatttttttgggtatgactccacatagtctttttggtcacacccatatgtcagcatttagacagccatggattgagggttacgtttaagttcacagattagaaatctcatagagatttttgaaatcaggtaagtttcaagtcaaaccttggtttttttcattcataaagatgggactgtggcctattttgcagacttctgaggatttaatagaaattagtaaacacattacctgatatatagtttgtccttagtaaacatcattccttttctctgaataggtggtcatattgcgaacctctggaatcagtttagacataagaataaaacacacctaatcaaacatgacctgggtcatatcttgagtcttctaaccagagtagccttggattgcccaggctatgtggagctagtgggatgaggaagatggggactagagggaatagatggccgagagaaagatggtgggaactgactggaaagacactttcagcctttggtcaccaccctccagagcttcctaaacttagagaaccagtaactactgctgactgtggcccatagacagttttgtttgaaatagtgtttttaaatatattgaatgctagttgcttagtatttacaaattaggagactcagccttaaatcagaatctctggcttctgtagaaaaaccagatctgggtccattaggcctcacacgtgatgtgagtgggccacagcaaagaagtggctgcgcctttagattgagcctactcttccattcctgctgggcccttgtagcccttgagttgtgacacctgctttcactgaggcaaaatccactttccattgggttaactggtgacattttgatacgtaagaatattttgcttcttttgaacataaatgattatgaaatgaatttctggtacttctgtgttattttaatggattctgcccccatagtctacttgatataaagtcttaaaaaatatactagtagtactatctaggatcaaaggctaatagtattacatctagaagcaccgtatagcaataatgtcaaggagatgaaattcaggtcaggtttgtaattactacattcatatagtaatgataattagcagtttcttaaagcttcatattttatatgatttttattgctatctgtcttttcagagctttattgagaattagcaggattttatgactttggttggtgttagttaaatgaattgcagatgacagtattattaacaagaaatgagaatgatatgcttttggatgttaacagagcaaaacgctggtcagatgtgaattaacatgttcaaaagttttcatatctcttaacacacttaaagctattttgtctatggggaattatctagttattatatttgtgaagtaaacttacctgtgttgtgtttgtgttgtcttacccattgacacatattaacatgtttaaaggtacatgtgagcagttatgcacatagactacaaattagtaaactattttgaagtctagatttcatgacttattaccaatcattctgaagttttgccttctttgcttgatttgtatttttctagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggcaagggagtggctacagattcattaaactgacccttctccctcttttcctttcttacttgctaatctagacagcacaacacagaattaatgaacagactttgaaagatccagacttctggcatccccactagcaaatgtgagacttttgacaagtcatttaatctctttgagccttatttttctaatctatagaatagggatcacagatatattattcactttattacaaggttattgtagtactaacgtttggtttagtaaagggtttaatatatagttaaaccatcagtatatggaatggttattattctcccttcgcataaaaaatctgttgattacacagtaccaggtaagaagtttcaaaacagggccactccagtctagctgcttacaattccatatgaggtgaatatggtaacttgcataattgatgtataaccagataaccttgagaatgccaaaattacttgtgactggaagggaggataaggtttggaagggtgagattcttaagggcaaggctttttaatctttctactcactgccatttttcagcatctagaatagactatgccacagtgatgctcagtgaagcctattaagtgaatgcatgtaaagaagactttatatagtaaatgacacttggattaggtcttaaaatgggttggagctggcctgaaaaggtgagaatgagttattttcttggctgcaaaagtaataaagcaaaggcaaaacccaggagtgtttgaggaatagtgaaaaggccattcagtggaagataatggtatcaaaataggcccaaccatggaggctcctacatgccacagtaaggtctctgaattgtatttgataagcagtagggaataatgggatgtttcagagcaagggggcaacctgattggagcttgttccaggaggattcattttgcctcaccgtgtggaatgattagaggttgggagcaggagaaagtagaggtcagagacacggagaaccgttagagcaacactgtgatccagaaaagagggaaacatcattcaaaagctgattgtattacacaatcactcatccctatttaacgaacggtgctgggaaaactggctagccatatgcagaaagctgaaacaggatcccttccttacaccttacacaaaaattaattcaagatggattaaagacttaaacattagacttaaaaccataaaaaccctagaagaaaacctaggcaataccattcaggacataggcatgggcaaggacttcgtgtctaaaacaccaaaagcaatggcaacaaaagccaaaattgacaaatgggatctaattaaactcaagagcttctgcacagcaaaagaaactaccatcagagtgaacaggcaacctacagaaagggagaaaatttttgcaatctactcatctaacaaagggctaatatcctgaatctacaaagaactcaaaagaatttacaagaaaaaaacaaccccatcaacaagtgggcgaaggatatgaacagacacttctcaaaagaagacatttatgcagccaaaagacacatgaaaaaatgctcatcatcactggccatcagagaaatgcaaatcaaaaccacaatgagatatcatctcaccccaggtagaatggtgatcattaaaaagtcaggaaacaacaggtgctggagaggatgtggagaaataggaacacttttacactattggtgggactgtaaactagttcaaccattgtggaagacagtgtggcaattcctcagggatctagaactagaaataccatttgatccagccatcccattactgggtatatacccaaaggaatataaatcatactgctataaaggcacatacacacatatgtttattgtggcactactcacaatagcaaagacttggaaccaacctaaatgtccaacaatgatagactggattaagaaaatgtggcatatatacaccatggaatactatgcagccataaaaaatgatgagttcatatcctttgtagggacatggatgaagctggaaaccatcattctcagcaaaccatcacaaggacaaaaaacgaaacaccgcatgttctcactcataggtgggaaatgaacaatgagaacacttggacacaggaaggggaacatcacacactggggcctgttgtggggtgggggaaggtggggagggataacattaggagaaatacctaatgtaaatgacgagttaatgggtgcagcacaccaacatggcacatgtatacatatgtaacaaacctgcacattgtgcacatgtaccctagaatttaaagtattatatatatatataatatacagccttatgaacatatatatatataaaggaaaattaggcaaaatagcattacttgaggtactcaatagcctggcagagcagacattaagggtaagagagactggacttgaatttcagtttggtacttgactttgggtgggtaattagcctttattagtcttgattacacatttaaaaggtttaataaggccgggtgcagtggcttatacctgtaatcccagcactttgggaggccgaggtagtggatcacctgaggtcaggagttgaagaccagcctggccaacatggtgaaaccctatctctactaaaaatacaaaaatgagctgggcatggtggtgtgcgcctgtgatcccagctactggggaagctggggcagaagaataacttgaacctgggaggcagaggttgcagtgagctgagattgtgccactgtactccagcctgggcgacagagcgaggctgtctcaaaaaaaaaaaaaaaaaaaagtttaataatgtccatccccatagggccattacaagaatcaacttttaaaaagtcacacattatcactaaaaaagcaaaatatttttccctatgattatagaaaataatgcacattgttgaaaaaaattcatattttgataaccctattcatttagtatggattttagaatacttagtattgttgataagttgacagagcataagatattcaaatgcccttttagagtgtaaagtctttcagaaagtcagaatttaaaaggagagagatattcagatataatctgataattctagagtatataggaaaacctaaaatggtttctaagtagaagacaccaagatgattttgactcaaagagaaaaatgatgcattttgggccatcttttcatggcattttatttcttgacctttttgctttactttagtagttctgactataatggtggaaactttccaacatttccttccatgcaaagtggatgtgcttaggacacttcattagtacttaaattcctgaggtcattcattgactgccatacatcagaaatagaaagatgggtgtccctacaggtatgcctttgacataaatttggtggttggctataaaaactggtggttattcttatgttttagtatgtaattcagattttataaagaaatagcatttagttttatcactattataattttgaagagtatttctgatttggggagcattttatgtattctttggatatttgtagtaatgccattttaacctgtcttgtttagaagacacagtatgctgccaaaattctggtcattgcataggagttctagcattctaattccatctaataggaggggaaagtcatgtgtggggtatatttaatatgatgactgtatgcctagtcagggcttttgatagagaatgggaactagaactaggcaggaagttttcaagctgaacatgaggagacagtgtgcctttgaagccatttgcctcctggagagagacacccagagggagagtgtttagtaaattaatccactgagccaacagactaagctgctgaattatggtcagactcaaatggatcagatgtggagaagcctgtatttgaactgctggccattaggaatggtgtttgttgctatgggaactggtgctaaggaactatactgagagactctgattaaaagggggagggggaatggagaaaaaagcctgagaggacataaaaataaaaaagcaatccagttgttgtaaaacaaggctcaagccacatactgatggctgtgaaccatatattcctatagagtttgcataaataaattcatgctttccaattaatttgaggagaataaaatattgccgagggactgttaatttctatgatatttcaggcaaagaaccaaagtgtaggtgccgttttcatgagaattttagatatgcttgactaggaagtcattacatcacatttatctgtttggatgtgggagacattaacagccttatgaatattcatggtatctggttaattaagttaattgttctgcagaagtgcttgcacttccaaggacattttttttttttttttttttttgcctccatagtttctccctggtatttcatcagtaattctttacatgaactgctacttctgtccttacttttttgtatttggaacattttagcagctctcaggaggaagtggtaggcaaagtttctggtagtgttaagaaaaataactttcaggctaattaaaatgtttaccttgaggtagaacatttatagcttttgtgagaacattaaaattacgccattgttatttatgtgagcagcatgttcttttggcatgtagacatcttttcaaatagagtacagtttcctgaaacaaaatgtaatccatctttcagattatcccaacaaaatatagaacaagctatcgttttgcaattttacatatactttctcataaactttccttttttcttcagagtgtcaaaaaccacatttaaagactaagatacagattaatgagtagtcaatgactaaaataattttctgacttctagtcatgtctgttatcactgccaacttctacagaattagagaaaagttgcaaagcctgagaagacataaacaatttttaaagccatctctagcattctaaaaaaattttgtacttgggcatacccaccgtacttcaaactcacagggaataaatggtctttattttcttaagtcatgatatgtgtcattctctattgcacatgacattacattatgttttttaatagcctttctagaggaatgcttttacggtctactcataattaaccatggtaatggaggaaatgtgtttcatggagtactgtaatccatcgataatcctaaatatctgactctaattatgtggcctcctccaaaatctttaccacaaatctgattgggaagcacaatggattgacttgtttcttccttttctcctgatccattccagatttattagcaattagatggtcaaagggcaggctgtagagggccacaagatcattggaaagaccttgataaagatccactgagtaacaggtttctacactacttgttctcaaaacttagggtccatagactcaccttgtgaacttgctaaaacagagatacctgggtcctccctcctccaaacacattctgagtccatgagttggaggtagaacccaggaatgtacgtttttaacaagctcccaggtaatgatgctgcttggaccatgcattccagaggagtttctcaccaagtcactgtgcatacaaaccacctggggatctaataaattgcagactctgaatcagtgtgtctggaatggggcctgagaggcaacattttaaaaataatatattttttacttccattaatactgctattactgttttaatacctattatccttatttttaaatggacaaaaattgtatgtatttattgtgtacaatgtgatgttttgaaacatgtatacattgtgaaatggctaaataaagataaacatgcataaaattgacataatgatcacatactgattttacattgagaacacttaaaatctcccttagaaatttccaagtatataatgcattgttactaactattgttttagcctgttctcatgctgcaataaggaaatacccaagactgggtaatttataaaggaaagaggtttaattgacttgcagttcagcatggctggggaggcctcaggaaacttacaaccatggtggaaggcaaaggagaagcaaggcacattcttcacaaggtggcaggaaggagaaatgctgagtgaagtggggaagagtcccttataaaaccatcagatctcatgagaactcactcactatcacaagaacagcatgggggaaaccacccccgtgattcaattactcctacctggtctctcccttgacatgtggggattatggggattaaaattcaagatgagatttcggtagggacacaaagcctaaccgtatcaactgtagtcactaggttgtataacagatctcttgaatttattccttttacctgaaattttatatcctggaccagtatctccccagtccttcccacccattagccccagtaaccactattttactcttcgcttttatgagtttaagtttttcagattctacataaaagtaagtatttgcctttctgtgcctgtcttatttcacctagcataatgtcctccaggtttatccacgtgttgtaaatgacaggacctctttaatgccaaatagtattccattgtgtatataaacaggctgattgtccctaatctgaagacttaaaatccaaaatgctacaaaattagaaatgtttgagtgccagcatgatgccacaactggaaaattccacacctcatgtgacaggtagcagtcaaagtgcagtcaaacctttgtttcatatagaaaaatattttaaatattatataaaattatcttcaggctatgtgtataagatgtataaaacttttatgtttagacttgggtcccaccccccagatatctcattacaccaacagtgtaaaagtattcccatttctccacagccttaccagcatctattgtttattgactttttaataatcgccattctgactggtgtgagtgtggttttgatttgcatttctctgatgatcagtgatatttagctttttttttatatgtttgttggccacataaatgtcttcttttgagaagtgtctgttcgtatcctttgcccactttttgatggaatttttttttcttataaatatgtttaagttccttgtagattctggatgttagacctttgtcagatgggtacattgcaaaaattttctcccattctgtaggttgcctgttcactctgatgatggtttattttgctgtgcagggattgttttcttgatttctttttcagatagttgtaagtgtacagaaatgctactgatttttgtgtgttgattttgtgtcctgcaacttaactgagtttgtttattagctctgacaattcattcatggagcctttagggtttcctaaataaataagatcatgcctacaaacaaaggcaatttagcttccgtatttatgatttgcaagccttttatttctttctcttgcctaattgctctggctagaacttccagtactattttaatgacagtggtgagaatgggtattattgtcttcttgaggaacaagacattgtttctcaactcatgagagtaattttaataagcactcaagtattgtcattcctgtttgacagtaggccgtattttgagtaacaagggtcacagcataacttgccttttggtgaatcagttggaaccagtttgccatttagttaaaataaacttttctttgcactggtattactagaagtaattgtgcttatttataattaataataattaaatatgcttattcttagttacctaaaaaattatgatattaatgacctcttggttgataatggctaagctgcctcagcttctccaatttagcaacccaagtacatatcagttcaaagtaacacaaattgaagcaattatgtatgatcacataggaatgcttctgattaacaaaatccagaggactggtctttgccttcataaccggaacacaccacatgcatggtttcacagctcttggctattattggacttacttattatattctttaattcaagaaaaattgtagcttcattcattctgttcttaataattttaaattctctttagcctcctgggaatgggaagggctagctggtatagtcccctgtatctcagatttcagttacacataaacattaaaggggcctgacttagggcgctctttgcctctgtggactggtggggaaaatccaggtgtgtcttaaattctaataatcatgaaaatcagaaatcataatgtttcaaatacaaatcttcatacatgggaaatacaattgaattaaacattttcttcaatgtaggagacatttgtcagataacagaggggattctcatttggctaagagcttacctctaagattcattaaatgtgtttagagcatattttttgtagtttgtagttattttatttttctgagttattatttggattattttctcttttatttatgtatgcatttgtcactgctccccagaggcacctcattttggcattgaagctaaaaacccattcattaaggttgggatggagtgggctttgatatagctagcatttgggaggtagaaaatagacattcgtgatcaaaaaagctgtaagcggttactataaactatttttaaatttctaagtattttaaatattgaacaaatgtgtagacatttgatgtgcatctatactgtgaataagaacttaaacttctaatattcacattaactttcctgattttataaattctcgtttatttttcatctgaacattgaagaatgacatctacataaagtaaaagcaaatgttagtttgaacacattctaccctaatagtgcatgttttaaaattgctttggcaggatctaccaatgtattggcacattctcttcatggagttcctcatgtgataactgcaacattgcacattataatgggtaagaattcttccaaagcagttcatattttataaggaaatgttgatttatataaggaaggccatcttatttccatcagactttaagaaaaggcaggttctttgtctcttagagtagagaaatgtttgactaaaaaaccaaaaggcaatgctttactatgtggattgcctgtcttttcaaaatacttgctttgtaaagagcagtaaatgaagttttattgtaatctgtacagaaaaaaaatattgtagtgtgctcaaaattataattttataaccagatgaagaacattaatgaatactccttaagtatatccaacactgatgtaggactgtaccaagactctaggactaggattatgttattaatgaaaaaacataaccagaaaaaaatttcagccagtagatgtctatagatattttattatccctattggtaaaaagcatataagctcaggtatatgtaacactaaactactgttaaatctgtgtttaccttgcctatctactttaacttcgtttctttgaccatgttttataggaaatagcaataagctgaaaaatttagtactctgtgtttcttcactagtacctgaacaagttaaaaatggtaattattgtagttataggtaaagggaactgaagagaaagtgaggatgttcatggtctacagtacctttagatattctcctataagccaataaatatgctctcttatgtttgctgttttgatacaagtcctactgtactcactgattaatatttaatgtaatattcaagggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaagtaagtctttttcttaaaccaaaaattgtatcccaggttcaatgactgttaataacaaatttcattacattttagggcagaagactgtgaaatatcatttttaccatttaacagctctgatgatgtgcaagaaaggtaggtaaaaactcaatgtaatacagataacctgtatctttaaagcataaaacattctgacaaacaattgatcagacttaggatctttggttatttttctaacatagtagtaaagaatatagaatcacagactcttacaggtcctagtaagcaaacaactactcactcagcctttttctctttttccttccttctttcctcccttccttccccctgtctctccctccctccttccgttctctttttcccttcccttcccctttctttcctttcctttgtttttttccctttctttccttttccctttcccttttcttttgagtgcctactatatgccaggcactttgaatacaacaatgcaccaaaaaatgaacaaaacacacagttttgtccctcgtgataattttggtctagtgtgtaatacaaatattaaagccatattaaagaagggttatagtctttaaagaaatagtacattattattccttataatactagtttacctttaaatgaatcaacacattatgttggcagcaacaaaattgtacgtttttacttactatctaattgaagaaagtatttaacatatataatgatgagttctctaattttctcatatttaatagatttgtgtgtgtctgtgtgtctgtgcgcgcgttatctgttttatgtctttgttttgttttctttcttttaggagggcacagggatctcccaaatctggtgagtcgaaaagtatctccttgagaactgtgccaggttctgttgacattttgttctggtgagggaaaataaccaatcactttcattacctttagactgtaatgatcaatggcaaatgatccagggtcagttcttgaatgtcagcattatggcaattccttgcctgtgttcagtggcacctagaggcttggcacctaataccaggttagtaagcatttttattgaattgttgatacatttcttatagaccattttttttccagggtatccaattaactgttggttagctagaaacttaacaggtagtttatctttgtatattagagattctaagggatttgtcatcacagtaggttgagaacaactgttgaactggaataattatcagataatcattgactatttaacgtcactgaggctaaaataatatttcctaagttttattgatagaattttatgcctactttacttgatttattcatttagttgtggagaacattatattaaatactgatatttcttgtgaatgtctttgctttccaactttaatgcaaacataaatatccttagcatgaaaatcacacatatgtatatttgatactgtattagtctgttttcatgctgctgataaagacatacccgagactgggtaatttacaaaagaaagaggtttaatggacttacagttccacgttgctggggaggctccacaatcatggtggaagatgaaagtcacatctcacatggcggcagacaagagagcttgtgcagggaaactcctatttttaaaaccattagatctcatgagacttattcattaccatgagagcagcacaggaaagacccacccccatgattcagttatctcccaccaggtctctcccacaacacatgggaattatgagagctacaagatgagatttgagtgggaacacaaagccaaaccatatcagatacttttagtcaaaagaaacatttcagttctatttaatgtgaatagtagtgcatatcaatctcctgcccacattttcaattgaataaaatatgagacatcttatatatatctttttatccatgggatatagacattccttctcttgcacattcttcttaatcagctgtccattatggggctgaaaatatttctttcctgaatccaatcctgtagagtgtaggagaaaggatcgtgagtgttgtgaaatataggcaataaacggggaaatattcaaagttagagaagaaaaaagagaaactgcaaacttcgatattgaaaacccagatggcaaggtcctcattaattacatctagtgctaaaacttcaaaggagtattttgaaccttgtgtgatttagaaattgagcctggtggttttccccgacaccttcagaaatcctagatagctgtgtgctttcataatgtagtttccctgactaaacttgaagacgtggctagctgaccaaggagctatgtttggcaggacttgagacaatgtttatctaaccctgtttgtttaaggaccttcttgggagggtagacctgctcttctgggaacaatcgattcatagctccttcaaagccactccataaatgttctgcttgactagaattccactgttgactctgcaggcttaatcagtattaatgaatttttcagagaaggatgactaattagagatttcttctgtggtttataatcacaacatgccatctttgcaaagaccttttgatcaagactcatttgaccggagatttttcagagatgtagcttctgatgattcaggatgattgaacaggagatttcactttcttctttttcccccaccatgataaataataatttatgttagaatatctcagtgcaaattgccagtaggaactaatattcttatattctaagtattctaagattaaatgtgttcatatatgtgagacatttaaagcagtgccagccatgtaagttgtgtttctatttcaagtaaatattgcaaagcaggcataggatagtgcttttaatgtttataaattatgcaattaaagatgcacagtaacactaccatgaacgttttggtgctgtttatttttaattgggaagaagaagcatgatggaaagcatactgagcacctggagtattggtgctgatgaccattttttctctgtgtgcctttgaacaaatcacttaaacttggagttgtcttttccctctacatgaaatgagcgaatgatgagataatctctaaggtcccttacagctctgacttgagctttcataagatactaagagctctttttttattttgttgttattcttaaattaacttcatgtttgcactgaaatcaagctagaagtcatttgtatgtatttctgcaaactgcattctatagcttgatgcatttgtgagtggctgttttggcactaaatcacacctctgaattttcactctcttatattggatggaacagttatgcaagattaaaatgttcagtcatttaactgaacatgtgtggcagcatttgttcactccatttcatccatccaaaggccactttgatttatttcatttcctatgtcacttagaccttctgtctataaataaatatttaaatcacactttagattttagaaaatgttgagctatttgttacacaacttgtgcatattaactcttctataatacatcttttaacaacatagtttcacatttagaatttctaattacattgtattttaaattatgtcttgatatgtgagtaggacgcttgatggtttgctttgtaaaatgctctaatgtaagagcttattgagaaggaagccagtgatttaataaaactcatttgaaagcctgcatcatttaaaaaatagcaagatacggtttatgaattttaggtaaacgtaacatggtgatttatctatcttgtccaatactttcagtaaacagtatacttgttataaggaacagtatgtcataatttttggtataatctcttagtaaatttcttgatgtctaatagaaatatttaatttcagattaaataatggaagtatggctcttataattgcccgaaacacttctcggccagaatttataaaacacctgaaaagatatgccagtgtaaaaaatcaggtatagtaaattctttttgttacttatttgcaaagctattaatcatgtagaaaaagatgctgcaagaattgacatcgaatcctgcctcataagaaggttttattttcttctgaatatattaatcttctttttcccaatctatttcatccaaattttgaaaagcatccgccaggattaatatagattggccttttttgaatgatgaattagtggttatgtatctgtaaccacaaagataaaataggaaatgtagtgttatattgcaatgtgaaataaattaaggataaaattccatactcaggctgttcttcagaatgaaaagaagtgaaatttgagagtttagccttcttgatattatggcagcagactttctaaagttatgatctttagatcttcctgacatttgtttgcatatctgcattgattgaaatagatctgtagatatgtatttaaaaatatgacagttttatacaaatattcattcaaaatgagaatatgtgaagatatacatttccacttaagtgatttgctttaaagagaaacagtaactattacaagccatattattttggcagctgttttgacctgattattaggaaaatgatccttgaactatgtgaatttctgaaattgtgagtctttgaagtacataggtatggttgtaaaaccctatagtttcacactttttctttttctttctttttttttttttttttgagttagagccttgctgtgtcacccaggctggagtgcagtggcgtgatgtctgctcactgcaacctccacctcccacgttcaagcgattctcctgcctcagcctcccgagtaggtgggattacaggctcacacctccatgcccagctaatttttatatttttggtagagacagggtttcaccatgttggtcaggctggtctcgaaactcctgacctcgtgatgtgtccacctcggcctcccaaagtgctgggattacaggcgtgagccaccacgtccggcccacacattcttaaaggtataaaatggtgcttggatagagttgggagataacagacgggaggaggaggagagtaaacccagccaatgactggcagctgaaccttgcttatgtaccttagccatagcaagtctctccatttttgcctcattatattttaaaactttcttaggccatcttcatgaagtttgatctgtcagtaacattatttgatcctcatgtattgaacaactaactgggctgcttaggaacttaaatcataaaaaattacagtcccactttctttatatgtcaaagtagatcagcaggtataatgtaggttgtgagcctacataacagttttatgtatgtgtttgggtggaatatggagatttattgattttcaaaggaatatatgccctttcacattttaataaatttctaaacattaaaaccaatttttaaaaaacccaaagcactatatattcattgctgtttttaagtcagaaaatagaaacaagaaaatgattttaaagcactcaaaattccatgttcctcaagattagtgtcattaccttggtagaattttttccgaatccttttttattaaataaatgagaagtaaagtaagtattaacctcattcatgtacctctatttgagaacttaaatagtattaacctattaatgtacccctgagaagttctgtatttattttggggaggtgtatgttgcacaaattgtttatggaaggtctcttttgaaattgcctatggggcaagtctctcaggcaatttttgtaaacattcttcttcttcatttttttaaatcaatatacctttcttctgattttaaaagcaatggttaccttacacataaagacagacatacagaaaataataaaaatctgtatcgataggaagacgttttctaagagataatattatgcaggatttatcatattttctcatgtactctacgaggcatatcttgcttttgacacaagaaacagttgcctgtgtgtgattcactggccttaactctgatttatttatcaactttcaaaaattaaaatccatgctattttttttttttttgcaaagaattctaaaatattttgcatagtgtatatagtaagaaagattgattcccagggtgactgctttcaagcaatgttaatttgatttgttaattatccacacaggtgtgtttatttaggctctttccttcatggtgacattaaaaatgtgaatttatataaattttgtaagattatgaaaatcagatctatgtaaaaatcatgtctactgcataattcatagcagtgctggtattcaggaaggaaaatgtggcaattcagtttaaggagagtaacatctgcttctctgaaccatttttaccaggttgaataagcgaatgttactgtataacactgtaaaatagattgaaaccaccatgtgcggagtggctcctgttccttccccatctctgtgtaaaattagatagaggctgaacactacccttcaaagtccttgcagctccatcctattgctttgccccccttctcactgtccacacttttctctttcattgtgaccatttttggtagggagtttaaaaccttaaatgtgagtgcttcccccaggatttctttgcagccctctcatcttctcaggatgccgtctcctggatggcctcattgcccctcacttttgaactgtctgaacatcatgcactcccaagggttctgtcatctcgtcttatctgcaggacctctgtcttcttgtatgctgaagaggttctgaaattcaccggcatctggaggccaacatgtctacagccgaccttatcttttcccctaaagttgttccttctgcgttgctctgtgcgggtcaatggcaccactttctacccatccaggttaccctgaactgttccttcttcctcattcctcactaccagtcccctaacttgttctgttggtctcctcttaaatgtttctaaaatttctccctcaccttaattcaaactttaatcctttcttgcttacagtagcctccttttggccttcaggttctctggtcttgtcttccatacctctttttagagaaacttttttctaagacacacattggatttctctcctgcttaattcttcagtgcctttctcttgttgtcagaataatatggaatatcctcagtctggaacacgtggcctttgtatccaggtccctgcctgtgttgcaaccccacctcttattaccaccctccaccacattcccagtgttttggcattttattcgttggctaaggttgccataacaaataccacagaaaagatggcttaaacaaacagaaatgtatttctttcatggttctggaggctagagctgcaagacaatgtcagcaggtttggtttgtcctgagtcttctctctctggctggcacatggctgctttctcacagcacccacaagtgagtggtctttcctctgttcatccccgatgccttttcctatgtccaaatttcctcttcttataaggacaccagtcgtattggatgagggcctaaagacatcattttagcttaatcgtctctttaaagatcttatctccaaatatagttatgttctgaggtatacagagcgaggatttcaatacaggaatttgagggccaaggggcatgatgttgagcacctaggagtcacactgaattctgtgtagttgcttgaccatggtttgcctctagttttgtaaatgcttcctctctccagactttcttctccaggctaaatcttatatgttctttaaggctcaattcaaatgggaagctttcccaacatccatagcctgtttgcctcctcttgtttcctctgttgaactccacacttgcaccatcatggcactcccctgtatcaaaattgtaactgtttacttctcctccccgtgccccaaacataccctcacacaggatactaagctcttggctcccgaaagtcccacttaacagcgtctgtggcttcacagttaaagcatttgaaggatggctagatcttcattttgtgaggagtgcacatgacaactgctgatttaagataatagacttactggtggtggctgtcaattcttgacattccttggcttacagctgcatccctccagtctctgactctgccatccttggcattcttctctcataaggacatcagtcatattggattaggtcccgccctaatgacttcatcttaagttgattctacctgcaaagaccctatttctaaacaggggacattcacaggtaccaggggttaggacttgaacatagttggggtggtggagggaaatataatttagatcataacaggcagttgtgtgttttaaatgaattatcaactaacatgaatgattatgtagataattctacaaggatgaggcatgtagccaaggctttatacccgaggtaggaggtctaacgcagttactgtcaaacagttttgcttggggccctctaattctgtacctcagtcacaacagctgatgccatcatatcatctactgtttaactgtgtttacagtataaactggaaagttggctggaccttggtatctacatatgtaaaatatgggtgttggggaaaatattagttttctgtcaacttttaaaactgtttcattgaggtttacatgtggaaaaggggaaaaactatgtagatgatgtttaattaggaatgtatctcatgtcatttttctgaaaactgaaatgagtagttatacatttctgctcaagttatttggctatattttcttaattatgtcagaaaatacatagtgctttttcagtatagtttccttaggcaaacaagaaaaaacgcaagttgaagtttaccttgcaccattctatagtggtaagtaaacagtgatcttgcagcttgtgtccattgttaaagtgggaatggggcaggcaaacaccttttaaaatccatatttgattggctttctcttttaaaagaagacatacatcccattttatcttcagaagtttagacttgcgttcttccaaattaaattccaagtgtgaaacttgtactagtttgctttatgtcagctaaactaattgacaagttgataatggattatatgtcttctgtatctacaggccagtattaaagattatctttaattgaaaaatctacagtatcactattttatgtaacttctcacagatatgtactatttgtcataaaacaagatttctaggtgctagatctaaaagaacccaaaaggctttggataagagattccttcttccaaaaaaacttggagatccctgttcatagtctcaaagctattaaaatgtcagcatacatgctgatatttacttgtgagagagggctcagtgaactttgattcgcgttagtagctagagataaaccaagtataatgattatttgtatttatttttagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattaggtaagtctatttatttcaccgcttattgtcaaccagtaaacataaatctaatattacaacgaaagctctcttctctgaactatcaaagcaggcagttggttagtttttaaaaaatcagtaaatcagggaagcataaagagacatgcacaaatttcaataaataaaaagcaactttacatttattcaactgttatgtagacccaaggcattttctttggttatgcgtgtctacattggctttctaatttattgttgtgcataaactacagataatgtctacaacttccattttggatttttaaaaatggatcaagatcttaaatcttttagtggagccatctgaatagtaaagtgttagatttttatccttccatcttagtttcctctcactcataattactgtaacatgttttgttcagtaatttgcttttattaggcctttacagagcattcaacttcccttgggaacaattttacatagcaactggtataaacaggtttaggaacctgcaaacgcattcttggtaggcattgtgacactcagtggttagaagaagcatgcaggggtgcccactagacatgggtgttctagaggcataactgactgttttacagaggtaatggagagcattggacaatcaaggaagtcagttaaggaggttttagagcaattattgttgttgatgatttatcaatcagaccttctcagttttctagattacagctctgttgggaatgctgtgtttgttatcaatttgtatttggcattggcattgtgtaccatacttattaggtgtatgtgaaaaacaacaaaataagttgatgaaataatgtattttctttacagattgcatccaagacttatcagtctttatggaggaagcatggaagaaatgattccaaagtaacatgtaattgtttctaaaagaaatgtacaaactagaattttaatataaagaaatgtggccatgctttaaacctgtggtccccaccctttttgggaccagtttcatggaagacaatttttccgtggatgggggaatggtttcaggatgaactgttccacctcagatcatcaggcattagattctcttgaggaacatggcactctagatccctcacataccagttcaccatatggttcgcacttctatgagaatctaatgctgctgctgatctgacagggggaggaactcagtaatgctccattgctctaacctcctgctgtgtggccaaacggatatcctaatagaaattgatgttactaacaattagcctctagggctttaaaagtcaagatgaaatatcaattcaaattctgtttttagatatcaattcaaattcttttttttacaatgtgtttattggacacacaaaaaaactttgcaaccatcataatacatcaatatttaacctagataattctgaaataatttggattctttcatttttcaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttcttaaagtggtagggttttaaaattcatgatacaagtaacaaagtaagttgataacaaatactattttgaactgggcaaaatctagcccaatatgtaattgtgttccccttgtatctgagaggcctgtgttggacaaccatagtactctgctttcactgtgctcagataacctgaaatatatagttgtttctgagtagttctgagtaggaaagaaccaaatgtaaatttccttagagaccatcctggagaagacagttctaaatcggggcttgatttttcatctatgatcctagatgttctcctgaaagaatgactagcctttttataacgatacaaagttttttaaaaatacataaatgtcataaagtttattcctgtgtatacacactctgggttcaggaggttttgtgcttacatttcactactcaaatgccttcgcaaatctcagaacattcctcaccatcactgcaggcctgtgaacagataactttcatcaattaggatggctggctagtggcagggacttcatataaagaaatctttcccagaattgtttttccacattgccttctaatttgatcactccctataacagatgttcaaaattcggccacagctctcttatgaaggcagagtcagataaaatgatattctgcaattatctagatcataagcataaaataaatattacaaaaatgattgtatttaaagaaattttttaaaatccagaaagtcatttaaaatagaacctcatatagtatgaacaaactataaaaatattttacatttca

SEQ ID NO: 17 - DNA, 145347 bp, Homo sapiens
  mutation 42469: c/t SNP in reverse strand
attgctatttgggcaacaatatggctccttcagaactggtcgagaatttctgtggtctttgcttgaccttcaagttgggagtttcaaatcagaggctttgaagtctggaggagttcgcagccattaatccttccggggttgtgctaaaggcgtttctagaaagagatcggaaagacccgttcagcacaggcccattgcatcttctctttgaaaacgcttgtctgaatcaagtatcttatacagacccgagactgaggggagcaagagcgcaggtccggctgtggcgaggtgtccaccaccgtacttgtggtcaatgcctggactagagagccgaggccgtccagggcgggctggccagggaaccagaagcgtccctggactggctgagtgagggtgccctttccagcaacccagtggccatggttaaaaggcagaatacaaccgtcaaagaagtccccagctcccacataagagagcgcaaaggccaatggaaccaaggcctcctcgcgagaactagctcgctttgaggacaagatcctggggatggaggtggggactgacgtagtgagagggtctggaggaacagtcgtagctgaaggtcaggacatgaagaattgcacgtatggtagggatagaatggcaggtacaacttttctgtactgaaggaactgggagaggacgatccggttagggaggttggggaactaatctcaacgctgcgtttacagatgaagccgcttttatatggcgtatatgtttgcttagaggggccgacggagattaggagaagccatcctttggcgccaatgatcaaagcgtctgccaaggagaagaagccaagggatgggcctttcagagagggcaaggagtcatgctgctctggatgccagtgtcaggacaagaaatcgaaaggagcgaggactcttcactgcgtgcctcagtctccccgcttctgcctctttcacctctgtcctacttccggcgcgaaagcaggccactcgctctgatctagacctagttaacattagcttttcccttccttccctcaaatcccctcccccctctatccccgtcccttctgccgcctgaaagggttaatctctcctgcgggtaaaaacaggtccgcggagtctctaactggcgacagatgggccactttcttctggccacaaaggggccggaatggagcgctccgcggcatacaaatgggcaggtcacgtggttccaggctcttggctggaccgggaagaccatatggcgcatgccggggaggaaggaggaggggcgggggtaggggtggagggtgaggggagcggttgtcggaggagggcgggagacgagcaaggcgtggggagaagtggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaaggtaattacagttctttcatttttttgccccagaatagaagcaataactgaagactgatgaacctacatattctgtatgtgtgcgtttgcgagagtgtgtatgtgtattgagaccagcatccccctccataattgcccataagtactcacacataatgagtcgtgtcactcaagtaccccctgcaggctttctaatttaaattttaaaaatttgggtttcttttgtggatagcataggagcttcttggattttttaaaagaatgcacggtaactatgattatctgctagtgctgattttaaagtcccaaaagcaataatgacttcactttctcacttcttacagtaagaaaaaaaaatctatgttatcaatatatattttgtgtgcatgtattttacgcacattgggagtgtcaagctgtgttttcagtgaatgaaagggacatggataccttgagtattcacaccatggaaaataaatcaggttcagagatagtttagttgagaggggggaaagtggagaaagggagagggactcactcctgctacctgttaccgctccagaggcggccaagtccccagcagccactactggagccagaaattcagttgttttactaaaggctttttattttccttactagaagcggcaacttcgcggttgccaatcgctgaccattataattactcaatcttttaaagggaggtttgaggcgaactttgaaaagccccaataaagagcgggcggccctttcaatgggctgtttattagagaggagccttccgcacctgatccccggcgcgtgggagagcgctctgcgccgcgcccccagccctcgccctgcagctagcgcttttgtacaaggtggaaatttagcggtgggccagagatggaaggcaagaaaagaaaggcgagggaggggtggaagaccctgtccacttttgttgccaaatgttacattgatggtgaaacaatttggtggaaactatttttcctcctttctgcatttgcttttcagtatcccgtcgatgtaatcttcttaaaaatcgctgccagtattagtaaattacgcaatggctgttcaacttaaatcgctaagtatctggaagccaggacagaaatggaagtagaatgtgtgattttacagcttttttttttttttatggagttgtgagtaactttgaacacatttggataaacatgaagtcgctgaaatgtacagtcatttccacacacattatcctgtcgggcaaccaccataaacacatttaagttaatcactaggatacaaacacatatgcgtgagtggtgtacacatatacatattcactaccctcccccagtcctgtcctcactcctacgtactagcggggcacacgcacgcgccattataaaacactgcatttaactttttctcagaggcattcattttgtaatgggcaggtacttttcgcaagcatttgtacaggtttagggagtggaagctgaaggcgtatctggcttttgaatatagcgtttttctgcttttctttctgtttgcctctcccttgttgaatgtaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaaaccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtgagagcaattgttgcatttcttcttaaagggattctgtttttatttttggggaaagtagttgcttttttgctgagttaaaaaatactaaacactatatgtagaataaaagaaaagaaaaaagtttaccttggcatatgctcttgtctgtttatcttgcacagggagtcaccagttctatgtagataatgaaaagacctaactgatatttcattatttggaatatgggactggacggcagtacaaacagtgtgtttttttctttgttttaagtggcttagcctttaggttttttatttccatttttaaaaatgattgttacatgttttcttctatttctttttttaaaaggtggattttaataattattaacaagcaagacataaacaagtatcctagcttagtttgtctatacatttaagatgtataaaacattactattttcttggtcttctgttatctgtacatttttctgaactaaacagttttatcttgcaaactagtactgtcccagaaaaatttatacacctttaggaagtaccaaagggaaatgagttaattaatttaaagaatccaagagaagtaacattttataattgttctattaacatcttgtgatgatttccatcatttttccaagaaaaagcataatggattatttgtactgaagaacacactatttgtactgtatttaggaaggtgtaattatttcctccccccaccctttggggcactattctgttgtttcatgaacacaactcactggaaaaacttatggatgattctgtctattgttaagtccacttcaaaaaaaaaaaaacagtttggcatttcttttcctctggatgtattgactgacagtcatgattcctagggaatatcattttggcacttgtgccctggctctactgtggtgctctgattactgtcattagtaactccattgtttctactctgattcgggtgccacattggatgactaccccccttcccaagcttgttcctttaatctccttctcattggtgatttaggggttccagaaagctgacctcatttagcaagctgctccagaaaaatgtgagtaatgtaatggacaggaacaattagccatactaataacattgccaatgaggctgcgtcaagctgtgacagaagcagtaaggaatacttcgacgttaaaaaaatgtttgagagcaatttaaaatatattattttaacatgttttctatcagccttcatcacatgacagaaatacttttaagttagtcccaactttatctaaaatgcagcaatctcattccaagtgaatcagagttgttattttggaatcaagctgttgctttctatatcctggattgttctcactgttcttactttaagagacataatactgatatgatacttgaatactaccagccttccagtgtaggaggtaatgaagtgagcattcagatctgatctaacctattaagtagctcaatttcacctgcaattaaaattagacatcttcatgcaaactaaaatctgttgctgtagtgaagagaagaaataaaagaatgccattttgagaattccagcttccaaaatagcaaacagggaaatctagactgtgttcttttgtaaggtagaaatgaagactaaaagttaggttttttttttttttcttcccattttgccaatacaacttcattctaaaacatagggattctttcagtcagtcaaggagtaactcacatgccaccatcttttattcaaaggcaggcacagatgttccttctgcaggggaggatttaatttatgaaaatgatattgtttatgcatgaatgaactgcatgcactctgcataacacatagcacttccatctgatcagagaaataccacagaaccagtgccaatgtcagaaacatattctacaaatttactcacttaaatgtttaatgaatatttggaaggcattttcaaaccataagaaacattttaaattatcttcttttatgaattcctacccatatttaaaagagactcttacagtttttgtaattggctaatgcttatacccagtttgtaagaaaagaacatattttactaaatgaaaaccaaccaaaaaaaaatgctggcaagtttggcttcactggaaaaaatatttcgtttagttttgctgtttaatgcttgtcatgaataatatttgggattctatctgtttcttcatcttgagccacgactattcctatcaaataagatgcttaggtatacttgtttaatgtgaaaatcctatgaatagttatttctagaaaaagctggtatgtaaaatcagggggaaatttcataaagatgaaattgggctaaatattgtaacatgcataattactattgaataggaacacttcacataacatattttactttatataaccaattgcagctatatagtatgatctatctacttttaatcattaaaacaattatatataaattaaaatgaaagattataatatcaagagtgttctactaattttaggtttataatatgttacagtaaaataccatttgaaataaattttgtgttctaatttatcttaaaatctctctgtttttacatttgaaagtccttacattcttacaaaattaatgcattttctgaaagaagctagcaattactaaaatgatatatggatcattagctaacagtttgaatcaagctgttttagttctataattatacaagaaatttaaagtgaaaatacctattaagcaattaataaaactaggtttcaaaatattggctaattttctcctaatgggaaatgtaaaatagcaaaactgcttcttaaactacacaaaaacctcctcacttctccttttctctctctctaacaccacttatttcctgaaaatcatctaaataaaatatttaattccagggtctgatgaagaataaaagagccaatgcaacatcttgtggaacaccaggactgagaactcttgttgttaccattgcaaagaggcgttctggcgtcagatgcacagtgatttgtatggtggcataatcattggctcctggccaggcattatgtttcagaggacactattgtcaagaaccattcaactagaaatctgcactgtatgcactcaaaagttgagatcatctgccttcctatgacaggaagaattctgtgctggcaattgactcatggactctcttcacatacactaaggcttggtccagtggctctgatggaattaactgtgcagccaaactagtggcattgacaagacagggccacagtctctggggacttcaggagaaattgctaattttaaaatgcagagtattatgttaatgctggattaaatcttcagatacattaaatgtggatttggccatctaagcattattatgttatttgcccagttaatttagaggtagatggatggtgacaataaccatctctacagatccacaattctaagagatggatccaattgtgaaatgatatggagagatagagtaagttcaatctagcatatatgaagtaatttggtaactgacttttcttttaacaagatcaaaagctaacctgctttacactttcatgtctaaggacagccaaccagagagatggcttcacacactagcccactgctaagtgcttttcattcactttcatatttcatcatcaaagcaccctcctgccttatttatagatggggaaacttcaggaagttgagatacctagatatttgcattcctgtcttcctttcttcattcaggtttttctttcattgccacttcctcaaagaagcttttactgattcccatttaaaatagcaactgacttcaactccaccaaaatcactgtattgcccctccctctttccagagcatttgcctatcaaatgttatcttatgtatttacttgtatagcttaattttaaactatctatctctaggtcttctgagcacctgagaaacagagacaaagttgtctcttctgtgtgttgctgttcctctggtgcttagaagacctagaggatcctcaataaatattaactttccaagggaactgaagagcactaatgtgatgctaaagcctgttgccttaaccactatgctataagtcaaatcagttgagaatggagaggaccacaaattattttcagtccagcaagtgttataaacattaattctataaaaagaaaacaattgaaactaatttcttattatattgcatggcaccaaactccccccacttcctttttgaggatcatgagttgtctgtcattgtttctttttattgatatcaattggttaaatataatctggaattggaataaaagaaaaactattataggctttttccagaccatgtatttcaatgcatattattttttcctttctgttcattattctttcagtaattgcacttgttctatttttagtgttatgtaaaattactgtagctcataatttctattttgaagggttcagtgtataaacttagcacatcaatactatctttttagtgttcgcgctcaatggtgtcagttaagagatcaccatcacttttggtgacgtcaatgaaggggtattgcaatgcttaagagaactgttaatccctttccactggtgtcactaacaattgtagtgcttgtttattcatagcaggtacgtgactaagtaatgttaacatcaaagcagaaagaggataatagagtgttctaaaaagaaaattcggtggttgggtgcagtggctcacacctgtaatcccagcacttttgagaggccaatgggggtggatagtttgagcctaggagttcaagaccagtctgggcaatatggtgaaacctcgtgtctacaaaaaatacaaaaactagtggtgcatgatggcatgcatctatagtcccagctactcgggaggctcaggtgggaggatcacctgagcctggggaggtcaaggctgcagtgagacgtgattgtaccactgtactccagcctgggtgacaaagtgagaccctgtctcaaaaaaaaaatgatttgagataacatcacttgtcattgtttgttaactgaataatctttattctagccagtgcctaaatacataataaatgatagtacaaatggatataaattataactaaacctaagtagtgatatttatcacaatatttctttactagaagaatttctttgttaatagaggcaaggctacttgtttagataccttaaaataacataagatttttggataaataaattaatgattctttgattctgactggcatattaaaaatattaagcgaagagatctttgcttcccaggttttattttttgtctaattaactactggtgcatttatattaaaacatattgtcaagggaaaacgtatatatatatatgtgtatatatggtgtgtgtgtgtgtgtgtgtgtgtgtgtgtgcacacatatgctatacttggttgagtagtatccccttcccttgcccacctctctcccaaatttatgtccatccagaacctcaaaatgtggcctcatttgaaatattgtctttccagatttaattaagatataagatgtaaattgatacaagttcatgctggattacggtgggccctaaatccaatcactgatgtcctgataagaagcagacagaacacacagacacacagcatacaggaagaatggcatgtgaaggcaaagacagagactggagtgatgtgtctacaaatcaaggggccccaaggatttggggcccacatcagaagctgggaaagagacaggaattctcagcttctccttctgaatccctaagaaggaatcaaccctgctgacaccttgattttaaacttcttgtctccagaactgtaatataatacatttctgttgtcttaagctacccagttgctggtgatttgttatggcagccctaggaaactgataggtatactaaaatctctaatgaattgatgttaaatatatataagtataggagagttcatttaaattcttctgaaaatgtcttcttaaacttttaatgatacagtatataacaaccagtatacgtagttggtatcgggtttgacatttaaacaagctgacaaaaaacagctgtttaataaacatctgaattatataaaagttttattgtttattattcatgtgaatgacttaaactgacatctacatttagtgaagtgtgaatgggcctagccaataaactatgggtaatttttttaaagtctcatctttgaactcacaaaaaattatcaaatatcagctattatgtattcttcatgtgaagaaaatgtcatatttatttgatttgtggattagcatatatattaatagagcttttgaaagaacaaatgtagcactttcccgatttcatagacactcatttaacacacaagttcatattttaaagtacataattttaaaaaaattctagtccaaatgaatttaagtgccatgacttctaaaaattctgtctctatttttgggttttataggaccttgagccagtactcttctggtgagcttaagaggctaagacttcacctttagttatatggggctttcatctgattatttgtctattttgattgctctaaatacaagttagtgtgtatttcatctgaatgtatttcattataagttttggttttatgtagatctggggatctgtcttgtttttaatcttgattggtctgtttgttttgggatagttggtactttcatttcttatgcttgctttctttttcattttgtgcccacctttagtcaggtgaacatcagtaaggaataaaattttatttttttaagccactgaaaaaatttaaaaaccacatcataactctgcctctgctgactgataaaaatgctaacttattaagacaaaatgttatgcaagaagactttattggaatagagaaacatcctttttatgtaagaaatatcaacagagacatgtgcctttcttgtgacaaatgtggtatgtgtgtggattagaggtctggaatgtggcagcatttcagtacttggaggggagaattagagtagggtagaaagatagacggggagcagaggatgattctcacccagtagaaagcagagtgaagaaagaaaggggaattgttttttgcattatattatttgaactgtggattaagtctttccataagccatccctacgcctctaagtaggttttattaacttaagctggtttgagatgggtttttggtcacacacaagaattgcctgatacaagagaggctttgattttgttgttgcttgctcatttttatacactaagatggagaaaaccctggacatagtgaagacgaaattgaggaaggtgttgggtagagtggagggtagaagacctgtaacataggtacagaattacattaaactggaaggacttatatccagatataggagtcagggtagaaagagagaatgttagcagtaagggtaacagagtagcagaagtttattcttaccaggtcctgttatgtgacagtggaggcatgttgaccttctgactaggggagttaaaggagaacactgaaggtttagaataatgtctctaaggatagaaagagaaagtttcatcaagactcatcaataatagggcagcagggcttagggccaagcaaattcagagaccatgatattatagtagtttgtagtggtcttaatccatctaatttttcagcattttctcaatggccaatacttagcagtggtagtgttttatggcatttggacaacagaagtgaaagcactggtaagagagacgttgaagtgaaacaccatggggctcagaaaagcagagttgatccatctggtacatgggcaaggatggtcctgaacaattctgcagtaagttggaagatagaaaaaatacctaacgaacttgtagatctgggtaaggagatttttggcagaatattgtaaggctaattggcttctcttaactatatgagatagggttttacaagggagagataagcgagcataatttagaagaactatagggggtcccaggcagactctctggctggaaaattattctgatagcaagaaattagccccaaagcaaagatgaaaagtagggtacttccaattaaacatgtcataagggcaagcctcaatcaagagtgtggctagaaggcacagctcacctggacaaaagtgcttctaagcatattaggagcatataccacaataacctgacttggacccaaagttgagagaggccagtctcaaaaaaatttgagggaattgcttttgcataatatgatactttatatacatatctgttacatatcatatatatcatattaaaaagaaaaaaaaccctgtttttccttccgttctttcatataacccttctgacaacaaatgtggagtttttcacacactaagcaattctttagttcttgctggacacttcctggatgtcctacaattcaactcgattctcacacaactgcccagagtcagtgcagacccgcagattaaaggcttagccccaaaagactaccccccactttagatgtcaatcacaagtctcaacttcatttacttctgaaggacgagctatacattggaggaaacccctctttctttcaataatttgctagaatggctcacaaaactctgggaaacatttacttatggttaccaatttattataaaggatataactcagaaacagccaaatggaatagattcatagggtgaaaaatgggggagaggcatggagcacaactctctcagcacctccatgtgttcaccaacccagaagctctcagaactccttcatttagggcttttatggagctttatcaagtaggaatgattcatgaaatactggcattggtgattaacttaacctccagcccctttcccctccctcaacattgggggtgaagctaaaagttccaactctgtaatcacagggtgagcttccctggcaactagtcccctgatccttagggggcttctgaaagtcacctcattatcataaactcaggtgtggttgaaagggatgttttgaataacaaaagatgcgcctttttcctttatctttctgagttgtttcaggagctagggacaaaagactaatactataacaacaacaacaaaaaattcaatttttgcttttatctcttgggaattacaaggattttaggagctctgtccagaagccagtgatgaagatcaaaatacatatttcttattatatcacaattcacacatgtacatgatatccgtaagataagtgaactacataaagtaagctcacaaagtttctgtaggagttttgtccatttacaaacagtttgtaagctaaaagtatctgtgacaagcctcagtcaatttagaagttcatttttccaatgttaaggacatgcctgtgacacagcctcagaaggtcctgatgacatgtgcccaaggtgatcaggctacagcttggctttatacatttagggagacataagacatcaatcgatacatgtaagatgaatattagctcagtccagagaagcaggactactgaaagtggaggcttgcaggtcacaggcagattcaaaggttttctgattgggaattggttgagttattatcttaagacctggaattaataaaagggaatttatcatgcagatgaagctttaggtagcaggcttcagagacattagattgtaaaggtttcttatcagacttaaaagagtctgttctaacagtctttaggtctcagtgttgatgttaatgctggtcagctgtgcctgaattccaaaagggaggagagtataatgaggcatgtctgagtcccttttcccatcatggcatgaactagtttttcaggttaactttggaatgtccttggctgagaggaggggtccattgagatggttgggtggcttggaattttatgtttggtttacaagtttaacattaaaagcctctgtacctccaatgttttatggacaaaaagaaggctgaaaaagctacttggctgtaatcatgggccatttcttgctgaaaagaagaataaaatggaggcagaaccaaaagcccagaggctagagccaagagctgctgagaatgatgaattagggaaccactctcagagagcagatctggatgtgagataggaacattttctttctcagggtctatgaaactggcaacatatgctctcctgaatttcagaattgctatggaccagtgactgtgatatgctttctatatttttcccttttgaatgggtgcatctatcttgattatcctctgtctcattattgtatgttggatttgtgtgggacgataacatgtgtttttagttcctaggttcccagaataagaggagcacactcaaagagcgacatttatgagatactggatttttcacttgatatcataattgggtgagacttgaaagaaagtgaacatattttgcaaatgggagggatgttaaccactgacaaccacacccacagggtccactgtattagcctatctgcaaagacggctgccaaaaattccttctgtccatatatacattcccttttttaatgtgactgtttcacctgccagcaactgaagggctttatttccatttccccttgtgacttgtttgactaacagcaagaagcaaaagtaatgctattccaattctagacctgggccttaagaggcatgacagcttctgcttttactctcttgaaactcaatgtcattttttaaaagctcaggctagactactcatcatgagggaccacatgaaaagagataggcccagctagtttccacccattccagccgctccagatgagatgccagacatgcaaatgaagccatcttggatatttcagccccagctgagcttccagctaaatgtaagtacattcagttgatacctcatagagcggaactactgagctgacttcatccaactcacagaatcataatgaataacaaatcattgttgctttaagtcaatacatttaaagtttttttgttatccagttgtagatgaattatacagcctggggggaaaaaggagatagcacactgttagttgcctcatcaatattcatccccaaattctttttcctttttagtaggtctcacctcccacctggaagctgaaaacacctttcccagtctctctggaagctacagcacaggcatgttgcccaattctaaacaataggacatgataggaggtctgctgggtgggatttttgaaaatatttttttttctggttaagaaaaaagaaatgcccaaggaaaacctacaaatgccccttccattcttgcttttggacattttttgggagagggtatgatgcttagcactcctgcagccatctcggggccaacaatagaatccttgttgctacctggtgatagtgaagtagaaagctacaaagctcttgatttcttttcttttttttttttttttaaattttattattatactttaagttttagggtacatgtgcacattgtgcaggttagttacatatgtatacatgtgctatgctggtgcgctgcacccactaactcgtcgtctagcattaggtatatctcctaatgctatccctcccccctccccccaccccacaacagtccccagagtgtgatgttccccttcctgtgtccatgtgatctcattgttcaattcccacctatgagtgagaatatgcagtgtttggttttttgttcttgtgatagtttactgagaatgatgatttccaatttcatccatgtccctacaagggacatgaactcatcattttttatggctgcatagtattccatgctgtatatgtgccacattttcttaatccagtctatcattgttggacatttgggttggttccaagtctttgctattgtgaatagtgccgcaataaacatacgtgtgcatgcgtctttatagcagcatgatttatagtcctttgggtatatacccagtgatgggatggctgggtcaaatggtatttctacttctagatccctgaggaatcgccacactgacttccacaatggttgaactagttcacagtccaacagtgtaaaagtgttcctatttctccacatcctctccagcacctgttgtttcctcactttttaatgattgccattctaactggtgtgagatggtatctcattgtggttttgatttgcatttctctgatggtcagtggtgatgagcattttttcatgtgttttttgactgcataaatgtcttcttttgagaagtgtctgttcatgtcctttgcccactttttgatggggttgttttttttttcttgtaaatttgtttgagttcattgtagattctggatattagccctttgtcagatgagtaggttgcaaaaattttctcccatgctcgtgggtaggaagaatcaatatcgtgaaaatggccatactgcccaaggtaatttacagattcaatgccatccccatcaagctaccaatgactttcttcacagaattggaaaaaactactttaaaattcatatggaaccaaaaaagagcccgcatcgccaagtcaatcctaagccaaaagaacaaagcttggaggcatcacactacctgacttcaaactatactacaaggcttcagtaaccaaaacagcatggtactggtaccaaaacagagatatagatcaatggaacacagcagagccctcagaaataacgccgcatatctacaactatctgatctttgacaaacctgagaaaaacaagcaatggggaaaggattccctatttaataaatggtgctgggaaaactggttagccatatgtagaaagctgaaactggatcccttccttacaccttatacaaaaatcaattcaagatggattaaagacttaaacgttagacctaaaaccataaaaaccctagaagaaaacctaggcaataccattcaggacataggcatgggcaaggacttcatgtctaaaacacgaaaagcaatggcaacaaaagacaaaattgacaaatgggatctaattaaactaaagagcttctgtacggcaaaagaaactaccatcagagtgaacaggcaacctacaaaagctcttgatttctaatgacatcatatgggatgaaccaacccaggaacagcctgactctggacctcttttaatgtcagaaataaaatcttatttgtaaaccactcttagttgttcaggttgttgacacaggcactgaagtgcctccaaatggtgatgaataatgaggcaaaagtcaaagacagcaagtctagtgtcaaattttttgatgcctatgggtaagaagttcaagaaagtgagctattttctttctttttaaaatttatttttatttttgtgggtatatagatgtatacattagtcagctattttcaatagtgagaagggatgttgccacttagtataatgcctttttcatagctatcatagaaaccatatatacatatagtatagaaaatgaggatagatttctgacttaaactgcctatttcatttgtgtgcctggttacacctaattcaagactctacaatacagcattgctagcaattactgtgagaatatttcaagctccctatttgctggaaatacatttcatttttttgttccaagtttatgaatattagaacctatctaaaaaggagcttttaaaaacttgaggaaaggaaaagggagggcctacttttcttgcctgtgttatttcttgttactgctgattgagatgctagagatcatattgggtgagatgtgtcttagaatacagctgagcaattcacttttaacagtttccatctgagtacaaaaaactggtatgtgcagaaaacttgatattctgacttggcgggattctaggatttgttctatttttttctgtaattgttgtagggacatatggccctgtaccttttgggcagcaggagccagaatagcaggaacattctgacaaaattcccactcagcatgagagggaagcagtccccttgatacactgatgatgtgcccacttagcattacaagtgtttgagaggtggacacaactaaaactcacctcactcaaaatatatattgacacggagaaagtaaatacaatttgctgttattaacctttcttctcaccattgagacatgttaaatatctgaaattaataaaggaattaaatttaaaaagtttacttatcatgcatttaacacatttattgagcatctgttatataaatgcactgtttcaggcacaagagatagagccataaataagcagattaaatcactattctcaactgaggtactaatctgatataagagaggagacagaaataagtaaacattataaatcaactacatacttttacatggtgtaaagtgcaattaagaaaatattattgaatagaggtcaattttggaatggttgggcagggaagaccttctgaggtgacaagaagttggcctgggcaccatggggagctctaccatggtgaaaagtgttccagacagagtagacagcaacagcagaggccctaaatgagaatgcacttggcttatctggagagtagaatgaaggccagtgtggtaggacacatactaataataggagaaaactgatagaaaagagggtttgagcaggtgggcaggaattggacaacatggtgtctcatatgtcataatagaagtttggattttattctacctgcagtgagaagttcttaataaaaaaaaaattctataaactggagtttgagaaagaactatgttgatgatagcataagccctcaatcacttgtcacataaactccaaacttcagcagagactcagggagatcaaagggactaccacaggattacccactggctaaaattcagatccatggcagttggtcctgactggaattagacttccttgtctgttgccctcattgcagtgggtctgaatgtctctgtcggctgtgaatttttctccctctatctgtggcactgagaaggtggcccagacttccagagtctgtctcattggcctattacttggggatttgctgcccttcttctggaagtttgggtatttgttttcagagcatacttaaaggcctcctgaaagcaatgttaacaatagcaggatatattttacagtcttctactcagacttggatttttaagaaccagggatggagactgtgtttccagatctagtcaaatcccttccaaacataaagcaacaaagtgccttttaaactaggacctgtactgtttaatgctctggaaacaaatacccaagcttcagccaaaggagggaaagctatgttcaggaagcttcctgaaagttttttgaaagcaattttcatgcattagtattttacatatatatatatatatatatacacacacacacacacacacatatatataaacatatatatatatacacatgaatcactaatgagacaattgatcttcaggaactaacgtgaaataattggggtatcttggtattattgttatagataaatgttgaagaagttcattctttcagatattaattgagcacttactgtgtactaagaactgtgatagatactggggatttaatggtgaacaagataaattctctgccatcagggggcttatattctaacaaacttaaaatttactgagtgttctctgtatttcagtattgttactaagtacactaacttagtggggaagctagacaataaacaaagaagtatgtaataagaattaatagtaagtgctgtaaagaatactaaagcaggttatggtagagagattaatggcagcgtgaagatgtccatgtttcaatccccagaacctgtgaatatgttaccttacatagcaaaagaggctttgaaaacataattaagggttatctgggcaggcccaatgtaatcataagagtccttatctaagacgggggacaaaggtcaaagacagaggaaaagagacgatttaaggatagaagcaaagaggagagatgttagactgctggctttgaagttggaaaaagtgaacatgagccaaaacaaacaaaacagaacaaaacaaaatccacaggtgacctttagaaaaggggtccccagtctctgggccatggaccagtacctgtctgtggcctgtttggaaccaggctgcccagcaggcggtgagtggtgactggtggacaagcaagttttaccacctgagccctgtctcctgtcaggtcagtggcagcatcagattctcatagcagcctgaatcctactgtgaactgcacatgcaagggatctagtttgtgctccttatgagaatctaatgcctccaaaatgctcaccccttcaaactgcccccatccgtggaaaaactgtcttccacaaaaccagtccctggtgccaaaaaggttggggactgctgctctagaagccagaaaagaggagatatattttcctctagagcctacagaaggaatatataggcctgctggcaccttgattttagtcctgtgaaactgattttggatttctgacctccagaaatgtaaaacaatgcattggttttgtttcaagtcactaaatttgtggtaattagatacagcagcagtaagaaatgaatacacaggtttacaggatggtgaattatggagggtgctcaggaatggcctctttgaggtggtggcctttaaacagaaaaatgagcaaagtgaaagaatgaaccatctggtggggagaaaagcattccagtcagagggaacagcaaaagcgaatgctctgagaagggattattcttctcaatgtgtttgaggactggcaagaaggctttgtgtgaatgagcaaggggaaaaagttagtaggtgatctcggagacatagccagggtccagattataaaggacctctcgccttgctaagcattttgactttattccaagaataatgggaagtcaatggaaggctgtgagcagggttatatgctctcgttattttttaaaggcacaatgtaactccaaaatggaaaattggctctgggctggaggtgccagcacaggggaaaccgaaagcagagagctgggttgggagagcggagactgaagttgtccagctgaggggtgcagaagtgcagactgcaatgacagcaggcagaaaggactatatgttctagacagaatggacaggatttgctggtagattggattgaaggcatgagacaaaggagacatggatgatatcaaggattttgatactacagatttgaaacattctgagagggacaggtttgtgatggaaaatcatgagtctggttttagatatgttttagaagcttattggacagccaagtagagatgtcaggtagggagctggacataatacctaaagttcaggagagtggttggagctggtgacatcatttgcagaaccctggatggtacataaagcacgggacagtgtgtggatagatcctaaagagagccctagggcactccagccctggaagaaggcagcttatcaaaggaaaaagaaagaaagaaggaaacacaatccttattacttccatcttcaggacaattcaaagccagtgtttttgacttcctggcttgagtgaagcttgaaaaatggcaacttgcccctttgcaaagctcctaaggagtagccattggcttggcctgtttgcactggctctgggtgagcttttaaaatgccagtgagctctaattgtgttgattgcctaacagctgtgaatacaagatgctgactccagaactgcaactcattctgcgaagggcaccgtccttttccctctaatgactgctgaacagagccacctgaagcctgcatggggtttagcagcagctgcacttctgctctaagaaatagctcactgcagtcagatcaaactgaagctcttccttgcttttcctcgaagcttgggtacttattgtcggagcattaaacagtaagagtcctagcttaactggtgcacagtgctttatgtttggtagggatttggttaggcctacaaaccgtctgagctaagaaccttgagaaactcctgctatagttagctctttctgtgactctgcagtgtgaccaggaatgaggacagaattaagaatttgctgcctctatgatagaactgtttaggcactagaacactggaactagatctacaaccctatgaatttaatttccttttcaactcccctactccttcttttcaatatgatgataatgatcttgtttaaaaaaaaaaaaagccttctgctttacttcccactctgctcctcttcccagggactcactttcttcttgactgcttccccattacaagtactcagctccctgttttatcaccctgcttagagcagccattatcagccttggctgaacattggaattacctgggaacttttaaaaatccggaagtctgggtctcgcctccagagattccagcttagttgtcttgagcgtggcctggacatttgggttttcaaaagttccctatgtaactttaatgtgcaaccacaattgagaatcactagcctccagactctctgtgttatcaaaattaatgagcagctgattttagaaatctcagttatcaggagaaaagggtgaacccccccagggctcttctccttttccaggtgacacttctttatggcagtgcgtgaaagtgaagccctgctgcttgtaatctccctcaagggagtgcaagatccaggcaaagacaagactgcagaggcgctaccttgggggaaagtaggaccctaaatacttacacctggaggcacttacctttaatactgaatttgtcagatgcaaatttgtctatgcaaaccagggccttatctctagcttcccctcaggggttttgggaagtgcgctactactctgaaacagggttgtaaagcgtcacctgtgctctccagggaaccctctggaaaggaggtggaaaaacagaggcttccacccttgcaactctaagtgtgttccttggccagtgggatccatcacctagtattttcttagatatgtggtatctgggggccagtcccacacctatgcaataagaatctccatttgaacaagatgcccaagcgattatatgcaagtttaagattgaggagggctggtttaactcgagggtaacgaaaagtacgaaatcgtactttacaggagaagctaggcggagggagccacttattcttcctcttgcagctgggtctttttgtggtgagtggcgaagcggcgaggctggcaggccagggtgctggactgggtcaggcgcggccccgcctccctcctgggtccctgccctgcgcgccgttgctgtggcagcgctggacgcggctagagctggggctgccgcgccctccacctccttctccaaaggcctccccggacccctggctcgggcccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgagtgcccggccccaagcgtcttcgcctccctccgcgcttcctccctctccccggcccaaggcctacacccacgagcttttgctccaccctccccttttctcgcctcccctccccgtgctcgcctcactgcccggacaggttaccgagtccccaagtcgccgcctcctccttcccaactgggaactcacgcctctcgccccatcccagaacccccagggattctttcgctacctagccttttcccgcctccgagaccttccccgggcaaacgtcacaagcagcttttgctcagagtctcagcagaaaatcttgagccccaaaggggaggtaatttacaaatgtgagaaggtcaactactcctcccctccaagttgaaaaagttttaatccattaactttgatggtacattgaaactataaacatctcacagattatgcctacacaagagttctgaatccaactctcattttgctgacttgaaaatgtaactccagagctttgggagtgtttctgggtttttttctgcccctcaccttccttgccattgtctagaattaagacttcttcaggctcggtctagaaacttttgatttttaatattgaccctagattattggatcacagttttgcgatgcttagttacgtcaagcggtttgcttaacgtttgccttttattgacttaaaattttagttacctaaaaaagttataatgctgtagtttacaacaaatacttcgagtctattttcacgtcttagtcaaatagccttatagacttaacagatattttataaagaccattttgcaagtcttataagtagactttcatatagtcttatttctaagtccaaactcgagaaatactccccattgttgaattagcttagatgtgagcggtgaaagacagatgaaatgggggaggaactacatcaaggttactctacttgcgaggagatgacttgggggagatggaatttggtattcaacctcttttagctaaatacaaatttatgaaattaaaaaaattgccttcccctgttggaaaacaagacacagtgtggtatttatgttacagaatagactcactgtcttaaagtcttgctcaaaagtctaacaaaatgaaaccaactagccagggattcagcactggttgcgattgtgaattctgcctgtgctgcatgtgccatgctcgctcgcttcacgaaaacagtctttgaccttaaagtgttttcaggtgttttaaaaaccaaggtgtagtattttcttgaaccttttaagttaaaagctagggatatagctatggaattatttgtaagtctttcaggcaattcgagttatgcaatatagaagtttataattacagtttggattagcccaaagagccagtttaacctacagtgcagctgaaatgctatagaattaaaatgagacattgtgcaatgagaggtcatacaaaccaatgttgcagtatttgtgtacaaaaaaagcaaacaatgacatgagaaaagaaatgctgttttatattgagtggtgattaaggtaaaataggtttaattagtgcacccctggcagtagagtttaaaatacatcttgacagatttgtaactttaaaggttgcaagtactgattctttgtttaattatgccctaaaaccatttggtggtcttttccttcatacaggtgtaccctttttctttgtaattaatacctggtattcaaaccactttgggcctctaaaattgggggcacagaagcctagagccttagtaagtacttctgtttatggaagaaaccaagagatgttttatttaggtaaaatatagccaggcgtggtgtgtccctgtaatcccagctacttgggaggctgaggcaggtgaattgcttgaacctgggagttggaggttgctgtgagcggagatcacaccactgcactccagcctgggcaacaagagtgaatctccatctcaaaaagcacaacaaacaaacaaaaacaaacactgggaaataagaaggagatattaagagatgatatatttaaatgttagaaatgctctgttgttgaataagcttagatgtgagtggtaaaagattaaatggaagagggagctacatcaaagttactgtacttgggaggacatgatatggtaggatgtggtggggggagagcatgtccattgctggttggcaagtgactggctgcctcagaaaaggatgagggtgggtaggggagatcactggagattattagaacatacgtatgttttcaagattgcttagtttttaaacctcatagtactttgttttcactgatgaaataaaatactatgtgatctttttctaattttccatcttgagtaataagcaaagacattaatgtattttatgaaggctctgactgccaaaattgggacaaattgatggtcttgttggcagggtaaatgagcataaccgtagtaattgtagttctttttattgggttcagggatgacctggaataatggatgtgttattacccttccctgtagaagtgaggctttcgaaaagaggctataagtcaatttgggaggcacaaagtatcagcgctttttggggattttttttttttttaagtagagaaatattttaaatgtgtgatataaagttatgcatgtgcttcttaagcacattaactcaaccagatccaacagctggtctaataactttttaattgtttaaaaaaatttaattgacacattgtaattgtatatatttatgagatactatttgatgttttgatatttacgttgtacaattatccaatcaaagtagttagttatccttcacctcacactttcattatttccttgtgggttagaacattcaaaagactctcttctagttattttgtaatatatagtattttactgttaaccatagtcaccatactatgcaacaaaacaccagaatttattcttcctacctagttgtaactttgtgtcttttgactaacctctctccatccttccttctcccctccccttcccagtctctggtaactattctaatctctgccttatctatatcaaccttttataatagaaaaagattctacatgtgagtgacatgtggtatttgtctttctgtgtctgggttacttctcttaacacgatgtcctccaggcttagcattcacaattgacaggactttattttttaatggctgactagtattccattatgtttctgtatcacattttctttattcatccattgttgtacgcttaggttgattccatatcttggccattgtgaatagtgctgcagtaaatatgggattgcagatctcttcaacatactcattttatttcctttggatgcatacctggtagtgggattgctggatcatatgatacttctatttttaattgttttaggaacttccatgctgttttccatattgactgtactagtttacaatcataccaccggtgtgtaagtgttcccttttctccatatctgtgtcagtacttattttcttttgtctttttggcaatagccattctaactggagtgaggtgtatctaattgtggttttgatttgcatttccctgatgattagtgatgtcaagtatcttttaaatgcacctgttgatcatttatatgtcttcttttgagacctatcaattaaagtcgtttgcccatttaaaaaatcaagttggccaggcacagtggctcacgcctgtaatcccagcactttgggaggccgaggcgggcagatcacgaggtcagaagatcgagaccatcctagccaacatgatgaaaccccgtctgtactaaaaatacaaaaattagccgggtgtggtggcacatgcctgtagtcacagctacttgggaggctgaggcaggagaattgcttgaacccaggaggtggagattgcagtgagccgagatagtgccactgcactccagcctggtaacagagtgagacttcatctcaaaaaaaaaaaaaagtcattattattttatctgttgaattaattttcttatatattttggattttatccctttgtcgcatgtatagattgcaaatatttttctcccattctgcagctgttttcactttgttaatagttttcttcaaggtgcaaagttttttagtttgatgtaatcttattttgtctatgcttttgaggtcttattttaaaaatccttgctcaggtcagtgtcgagaataatttcccttttttcttgtaatttcatagttttcaagttttacattttaaatctttaatctatttttatttttgtatatggtgagagggaggggtttaatctcattcttctgcatgtgaatatctgattttcctagtaccatttgttgaagagactgtctttttcccagtgcatgttcttgacatcttaaaaattcagttggctgttgtaggtgcaaaaatttatttctgggctttccattttatttcatgggtctgtctggttttatgctagtaccatgctgtgttgatatagttttatcgtatatttcgaagtcaggtagtatgatacttccagttttgttctttttgctcagggttgctttggctatttggggttttttttgtggttctgcatgaattttcagattgtaacatttctgtaaagaatggtgttggtattctgatagcaattgcattaaatccatagatcactttgggtagtatggccattttaacaatataattatttcaatccatgaacatgtactatcttcccatttattgatgtgggaagataatttctttcatcaaagttttatacttttcagtgtagagattctttcacttccttggttgtttatttctaggtatctttttttttaaaaaagtactataaatggaattgttttcttgatttttcacatagtacaatattagtgtatagaaatgctactgatttttatatgttgattttgtgtcttgcaactttactgaattctaacagttcttttgtggagcattttgggttttctatctataagatcatatcttctgcaaacagggacagtttgacatgcttctttctaatttggatgctcgttacttctttctcttgcccagtttatctggctagaactttcagtagtatgttgaatagaaattgtgtaagtggccatcctttccttgttattgatcttagaattgatctcgttattggtcttttcccattcagtatgatgttagctgtggatttgtcatatgtggcctttgtgttgaagtacaaactttccatacctaatttgttgggtttttaatcatgaaattatgccacattttgtcaaaggcttttaatgcatctattaaaatgatcatacagtttttgtctttgttaatgtgtatcacatttactgctttgtgtatgttaaaccattcttgcatgcctctgatcccagtgatgaatcgcacttgaatgtagcaagttatctttctaatgtgctgttggatttggtttgctaatatcttgagaatttttgcacctatgttcatcagggatattgtactatagtttcctgtgttgtattgttatctgattttggaattagggtgatgcttgactcatgaaatgagtttggaagtattccctttgcttcagttttctgaaatattttgagaggaattgatattggtttgttaaatgtttggttgagttcagcagtgaagccattcgtttctgggcctttctttgatgaaagactttattactgattcaatttcctcacttattattggtctggtcagattttatgtcttcctaacttaatcttgataggttgtatgtgtcggggacttcgttttttctatgttatcaaatttgatgaaacttgttgaaaaccaactctaaattttgttcatcttttgaaattatttttagtctctatttcatttatttctcctctgagttgaattacttccttacttctaccaactttgggattagtttgttctgttcttttttttctttctttctttttttttgagatggagtttcgctcttgttgcccaggctggagtgcaatggtgtgatctcggctcaccgcaacctctgcctcctgggttcaagcaattctactgcctcagccttcctgagtagctgggattataggcatgtgccaccacacctagctaattttgtatttttagtagagacggggtttctccatgttggtcaggctggtctcgaactcccgacctcaggtgttctgcctgccgtggcctcccaaagtgctgggattacaggcatgagccacaatgcctggccgattagtttgttcttaattttgtagtgccttgaggttcatcattaggctgtttgtcagaaatctgttgtcttttttgatatgggcatttaatactataaacttacctcttaaaactgcttgtgctatgtttcgtaggttttgttatggtatattttcattctcacttgtctcaagaaaaattttaatttcctttttaatttcttcactgacccattggttgtttaggagcattttgtctccatgatttgtgaagttgtcagtttttctcattgttgatttctagtttatttcttttctttctccttccttctttccttccttccttccttccttccttccttccttccttccttccttccttcctccctccctccctccctccctccctccctcccttctgtattgctttgtctcccaggcccaagtgcagaggcacgatcttggcttactgcaatctctgcctcctgggctcaagcaatcctctcacctcagcctcccaagtagctgggactacaggtgtgtgtcactgtgcctacaggtgtgtgtcactgtgcctggttaaatttgttttttgtttttgtttgttttgttttgtatgtttagtagagatggctttcgccgttttgccatgttgcccaggctgttctcaaattgctgggctcaagcaacctgcccaccttggcttcccaaagtgctgggattacagccatgagccactgcacctggcctgatttctagtattataacgctgtggtcagtaaagatacttgatattatcttaatcttttaaaatttgttaagacttgttttgtggcctaacatgtgatctctcctcaagaatgttccatgtgcatttgagaagaatgtgtatctgcagctgttggacggaatgttctgtaagtgtctgctaggtgcatttggtctatggttcagcttaagtccaatatttcttgatctctctgtgtgtgtttgtgtatgtatgtctagataatttattcattattgaaagtgggctgttaaagtctcttactattattgtattggagtttatctctttaggttgaatatttgctgtatgtatctgggtacttaggtattaggtacatgtatgtttataattgttatatcctgttgttgaattgatccctttatcatattatgaccttctttgtctctttttacagtttttgacttaaagtctattttgtctgatatgagtattgctactcctgctcacttttggattctgattgcatggaatatctttttccatttcttcactttcagtctgtctttaacggtgaggtaagcctcttttaggcagcatgtagctgagttttttttccagtcctgcagctactttatatcttttcattagataatttatttacattcaaggtttttattgataagaacttatttctcccattttgttacttgttttctggttgtcttgtagattctcagttcttctttctctcttgtttacctctgtggtttggtcattttctgtggtcctaagctttgttttccttctatctcttgtttatgtatctgttgtaattgctttctttgtgggtaccatggggctaacataaaaagtcttgtagttataataaactattttaagctgatagcaagttaactttggtcacataaaaatactctagacttttttcctccgccatccctaatttatatttttgttgcctttatttctttagtatgtgttccctagccattgtagctgttgttgtttttgaccagttgtactttaaaccttcatctagaggatcgacaggtttacatagtaacatgatatcactggggaattctgagttggatttatacatttacctctattggtgaggtttatattctcacatgtgttcatgatagttatcattttttcatttacagctgtagcactcctgtaaacattgcttgtaaggctggtgtaggagtgaattccctcagcttttgtttgtctgggaaggcctttattctcctccaggatagttttgctggatatagtatcttttgtccttggccgagactcgtttttttttgttcttttagcatcttgaataaattatccctttctctcctggcatacatcagtaatttaatgttactgatgagaaatctactgatagtctaattaggattcccttacatgtaacttgatgcttttctcttgcagattttagaattctctgtcttcaacttttgacagtttgactataatgtgccacagagagaatctttttgggtttaatctaattgggaatctttgtggttccttcatctggatgtctatatctcccccaatatttgggaagtttttagctattatttcattaaataggttttctgtgcctttcttcaacttttctccatctgccagttctataatgcaaaaatttctttgcttagttttttttaaactttgggttatttcacaaaacctattttcagattttgaaattctttcttctgcttgatctggtctattcttgaagctctcgattgtgtcttttattcactgcattcttcagatttctgtgttttaaatgatagatcttgttttaatttctcattttataactttcctgatttcattgggttgtttgtattctcttgtagcctgctgaatttttttaagatcattatttttaattttgtttcaggcattttataaacacccttttctttggggtctgttactagagactcactgtgttcctttggcagtgtcgtgtgtccttgctttttcatgtttcttgtgacatctgcacatctagtggaatagtcacattttccagttgtatgcagtagctttcacagggagagacttttcctgtagatgggtcctagagtgttggttgggtatggtacattggctttggtttggggtggattcagtaccatggtctctgtgtagtttcgtcagctgtaatcttcacagcaatgtctgatttcctcagtggcctaggctgcaggagtttttgatggtggtatagttttgctagggacaggcatgtcatgctagttgtcaggctggacacttgcaggctcggagggctgacaagctgtcttttgggctccccagggaagagaaagtatgattttccagcttttcttctatgtttatttaaaactttgttgtctggctcacagtgttctttatctaaagtctagccagtggtggtggtcatattgcaatcattattacagcttcagactttctagaccttttccattttagtgaccttcagccttcattcgcttccattcatgaccacagaatagatgtagtcatctctattgaaggcaaacccatcccatctcttcagcttcatctagaaatttgtttcatctgttacactttctttctttggtttttagccttcattctctaccagctctttcacttaagcagagatatgttcaagactctcccattctaacagttccctgccttgatcctacaagcttttctctttagctgctaccttgctttttatttttatttttttctcacttgctctgataatctcctagaaaaattggcttactctgaccatctccattagttcacctcttaattattcttcaaccatctgagacctggctttgttctttctctactgaaactcttcaggcagagattagcagaagtcttctaattgctcaatgaagtggaaattttcagtccttattttctgtatttctccttcatttgactttgacttaactctcttggtttttgtaataccaccagcacctagtttatcagtctctcatgggaacttcattctatctgcctgccaaatggtggagtcccaaggactgtggtctgatctgctgttcctcattacatgctttctggtcagtattgcacactgtggttctcatctaccatcatctacctccagaagtgccatatatttagtaagtttacaagaaaagcaactttccttgctccgtagactaactctgatcttttgttccctatcatggttatggaactcactaattattcagcatcagctgtcagaatgtttaactttgctatttaggtttgtgtaagttatgggacaataactaggataactagaattagcttgtagcttatgtgggttagataatacaattgcatatgtaagtagtgaatattttggcttaataagtgaaggagtatttaggaagctatctggaatgttatctaagtcaggattctgaaggtaactctagcctcactgtcccttactcactatttctaaacacccaccaatcctgcctactttatttacttggtatttctccaatctgccatccttctctgtccgaccaatcactaccctagctcaggccttcaaagtctctcacttgacctactccttcacctcctttgaacctgtgcacaaatgttagcttcttagtaaggctttctctggtcacctgtataaaattcccatctgctacatacttcctggttccctgtattgccttatattcctcagtggcatttatctccttgtatactatataatttctgatctctgtcctttctattaccaccccacttcaagatggcaaggatttgtctgttatattagtgactgtcctaataggaaaaaaaatggcacatttatattagagtaacttgagaagaatttttaaaagtcagtatttataaagctgtagatatagagatagtgaagtactcttgggactagtaatcattgggcaggtgataccatttttaagcccaaaagggcatagtgaaagagcaggtgcctgaacctggattcagagagactatgtagaggaggccactaggcaggagctgtggcctttgcctcagcttggctgattacctcactaatcctcactaatcctaaattacccaagttccttcttttctggcccatttcacagtccaaagccaactttaagccagagggcaaggggagcacttgatgcagtccatgcagtatggcctcccagtgaacagggcaggtggaggatagaaactaaatctagatggaggagagggaagatattcagaatatgttttttctttactgtcagcaccttgaagagtgcctggcatatagataatatttattgaatgaatgaatttgttactggtttactggcctcatgaactttagttttgcctattctattataacttggtgactacattcctatatacttgataccaactcctcattaactacaaaggcagtattcccctctccccctttttaaacatcaaaactcttttttaaaaaaaattcttaaatgaatcgccagtatataacacataaaagtatgggtgccttgattggagtggtgggtaaatgatcctgagtctgtctgtttgggttccctctttgcctagcaggaatgtgactgtcttgtttaaagcccactgaagtagaaaacaggatgagagacacactcttcaacatggcataagatttccatgcttggctcctgcctatctctgcatcctcatttctcagtagtttcctcatattttaccatcctgtaattgaaagaattacaaaactagttctctacacaagctttcttgctgttccagctgctgggaattagcttcctttgtgcttttttttatttgaatgattcatgtttacattcattaaaattaatgaagattcattacagttgttttctctttaggcataattggatctcctatactgagacattgaatgcaactttgattgtttttttcccccattatatgttaagctccttgaggttcttttcaactttgcgttattccaggatttctatcgtaagagttaaggttcatccacttctctgatgtgaggttcatggcaggaaggttccatgttgctcagctgcagagtagaaaatactgagcagggcttaaatagattaggatgctgccattataatataaactgtgtttacgaaagagcatcatcaattcagaaaatatctttttcattgactacagtggtgcctgatgatctttctattacaatcttaaattatggtcattttaattatagaatcatacatgggtttatttatgttaaaataaggtaattatcaagctagctgtgacctatgagaaaaatcctgaagaaatgatgaagggatcaggtgactgtttttgaagtcaagtgtgaaaggtcagaccactctgggtcatgggaccctgccaaggcagagcaggtcaagtgctgtgcccagtggggccaacccccagtatggtgccagggactgggtgtgagaagtcaaaaattaagaatacacctcagaaaggggacatggacagatgccacagacttatttgcgtatttcatgatttagcccttagcttgtgctgatactggatcagatattttcagagttcagtattttcaaaagcatcgctgatcacctgttggcattgttttacatctcaaccaaggaaaaacttttgggacatctgtttaacaaggggtaagcttttatttgaaatgttcgattaaagcagaagagtcaggcatttttttgtgcctccccaaagaaagatttgtttactgtcctgtgtgaataaatataatgtcattatttcccgtaaaggaaaagctgatggggagagtaagtaatgggtaagattaggcaatgttaagctcatatattagtatgtttaagagtgatcaatttagggatctctgtgacagagatgccaaatgctcacagtgctatctcatgttggaaacatgtgtctcctccacttttcctcagtcctctgaaatgacggccctttagggattgacagatactatacagatttctgtgctgatatgtgatttgtctaaaacaaaagtttcacaaaacaattcttaccattgccatttaagagtcactctgatatgctctgtttccattgcaaacaaatgctcattatgatttgtgaaattaacttcacaatttcctaatggataacaccttgaagtatgaaaagcactacaggatcttttatagcttccctcctccagctctctataatctgctcccatctgtggtgtaggaaagatttcagcagtggccgctgaaggccctaagatcttgtctcaacagatagcaaggtgcataacagactttggacaggttgtttaacatgtctgagttactgtttattcactggcaaaatgaagggcttatattatattgtctctaagtactatcagttctgaccacctatgaactttcattttaaagaaaatacctatttctatggcctttaggcattagggaattttgtcaaattaaataaatctcagtaaggtttgatggtcaatggggcccactgtctggtgtgtgtggaggggtgttgtattttacatcaggaacttcagagccctcatgaatttctaattagaggaaccacctgggaaatataagtcaaagccctttgctcgccttactcagctttagggcacagtgactagaggtgggcaatcgctttggtgtaggtattgtcattggaaaggaagaaaccattttctggaggaaaagaattggttgaggctagctttaagcagctatttcatgatggacaaaaggactagctcatccattcttcattcgtttctctgtatcctctatcaaatttctgagtaaagattttatacaatgcttgattagcattcaaatagtatgtttcaaagattttaaaaaaaataaaactaggcctttgaatcataattatggcttataactctatttttcatatacttactatctcaagttacaaatttcatgttatgtttttttcaaaagagtattcctgccacaactcagagctcagctgaattagagcagtgactagaaaatctgagaaggctgagcttcaaaataaggtctggaaagtgtttcttattgttacaagagagtcaaaatgattttcttgagctttaagtttatgtaagtatttacttgacacttagcagtttaaaagataatgtgcaaaaatatgaaaatgagaaaaaacaatttcaaaacaagagttggtgattacgtgagacttagtagagcaaagtatattctaagtattaatctgtctaagctgtttgggaacagatgtacgtgaaatggataccgggtgttctgttgtgtacaccccaagtgagacatctgttggtagactgtgtggtcagaaataatggaagcaggggttaaaccccaatatgacctattactcatgtgaattattgaaggactaattactcagtaaaacatgatgctttgattcatcagtctacacgttaagaaaaaagcctctttagaaaaaaatttagttctgtttctaagctgtcaaatttgaggaaatttttaagatgtatgcaaagactcaaatttccatagtaactgcaaatactatctgcttataaagttttaaaatgttttgacaggtctactaatttatcataaaaatagcctcaaaagttttagctttttgttagggtaggttgggtctcacagaaaacaaatgtagagtgaattttctaaagcagggctgtccagttagacttcctgaaatgatgggagtgcactatatctgaagtgttcaatacagttaccaccagctacatgtggctattgaacagaaacatggctagtgtgactgagaaactgaatttttaattatatttaatttttattaatttgaattcaataactgcatgtagcaagtggcaactgcattgtacaacacagctctgacacatggagagttgaaaatgtttgtttactttcttcccaagttttcattttagtctttgtttctacatagaaaggaagatatagcttttgaaaaatgaacctgaatgtagaactgatatggttatgcaatttgagctgcctatttaaagataaagcaactgagtttagagatttcaaagtggcagagtcctttaacatatttcgtgggctggccacggtagctcatacctgtaatcctagtactttgggaggctgagatgggaggattgcttgagcccaggagttcgaggccagcctgggcaacatagcaagaccccatctcagggaaaaaaatatgtgtatatatatgtatatatatatatatatatatatatatatatatatatatatatgcatacacatatatacatatatacacacatatattaacatattttgtgtgtacaaaaaatatttttattatgtgtagattagttggttactagtaaagttgaagtcttgtctatagaaatcattgtatttttcatggtcattgtgatacattgtttgaactgaaatttggcaaattcaatctgtttcttactacaagaatagtacatagatttgaaatggtaactctcttagtctgtgtactctgaccctgtgaacgtctggagactaatgttattcctaaatatgctatgtccacatggcagcatctgaaggcaaacactttttaaaactgatctacttttgtggacccttcctctctctctttcctgcatcccggatggggccctctggggctggaactggcacagaactattcccctaggagtgggttcattgaagccaagggacacacaaattgagaatcagatagactggaccaaggtcattaaaccagagagggcaatccagatggggttgtccaaagtaggaagttctgaagtgaattgcagaaatccaaacatggcaaagctaaaggaatagagaaccagggcaatggatatagagaacagagcaattgggtatgcaggaagatgctattgcctagactggatgtttttgtaccctctgtaatttgagaaaatggaccgtccttgttgaaatggtcagggatgtagtagataaattcattgcagttgtgtaatctcagcactagaatactgatcataaccatatcacttgttatcccacctagcctgccacttgattgggttattagattacatttcagacattgacaagtctacaagcatcattaaaatcctaaacacagacttctgaccgtattcctacccaagttttagaagcactatgccaatgacgggggtagtatatgctgagcaggtgagttttgattgtgtgtgtctacatgtgtacgtgggtgtggtgagcaacaggaaggaactctcagccatgactctaaatgctcttgtgttggccaaaattggtataagctaggaggagaaacacaaaggagagagaggcatgaagttgaaggacattaaaccatttgcaaacttttggcatgcaaaccagaatatgaggaaacttagtgtaatgggtgactgaattcagaggtagacaggcaatcaggaaggtataggcaccaaaaatagttaccattggtgagcgtttttgtttttgtcattggcatggtgttatgaacttatgttaagcctaagggtaagtctaaaataatgtaccagctggcatcagggaattcccatgtacattcctagattttcattagaaacagtgttctggaaactaccactgctgctacacagcagtgcccagtgcttgactgaaaatagtgaacacttagatttgtttactctgccaggttctgtgctaagtatcttatcttgtttaaccttagcaaagaaactatgtagtctagatagaatttttatccctagggcccagaggtgttaaataacttgcccaaggtcataccagtaatttcagttgctggggttcaaagctaggcagtctgactccagagcctgcactgtccccatttggttatgttgcttccccagttaagcaagcaagagtctatctgacatctgagttggtggtagtaaagcatcatggtctgaaccaaaataataaaaacctttgaaacaacattatctgacttctttcagrcttttaagacagttccatcatcaacagcttattccatttctctggccacttccagtttctgaacaaatgaagaaaatgggagtgataaattggagtttttaacaagtttttttaaatctaattttttttatggaaaccaccaaacatacccaaatgtaggaataattatgtaataagtcctcatgttcaaccctaagaggggtgaagctctatgtgacccattactgagtttaaacagttttcaatttatggccagtcttatttcatctatactctacccacatcccttcttcccctggaatgattgaagtaattcctaggcatcatataatttcatctgtaagcatctcagcatgtatctctaggagataaagattttctaaaaaatcatattactactcttcaaatttaaaataatctttatagttttacatatccagttagtgtccagattttcctgatattttctctattttttaaatatgtcaaccttgaaatgaggtccatattatagctgatggctatgccttttaaattttctcatccacagattcttcttccttttttttcctttcaatttatgttttgaacaaactagtttggcctatagtttctcatgggcaagaataaccttcagactgggatggccatcactctgatacccgtaaaggggatgaggcaggttggggaagggagagcctcagaccatgatcagatgtcacaagatttttgcttacctagggtgaggacttgggaaaaagattgcccattaggagtcctgccttgggcaaaagtggccaaacttcagctgtgctgtcacaggctgtgggctgccttggaaatgtaggacctcaactcctctgaagttgaggtggagcttgagggtacgaatccctggtggccattataatgactacactcattgggatggcatggcaagttcatcctcaaagatggatcctagcatccaccatgaccaatgaggtttttttattgttatgatcactataaactcaaggatttaaacctattaaatgtttttcaattcacagcaatgattatttttactgatcttcaaattgtcacattttggatttttagaccaatgggagccccttcatcttgacttctgagttcttttgacattcactcagctgtctgatagcttccctgctttctggaatggcaagatattccaggttcatcttgaacatttcatgcttgagatatggaatcaagctcatcatcagagggtcctggttccttttactggatagtggtattagagacctcaatttgagaactaagcaacatcattgctaaaacttcccctatgtgtaccttgttacttaggtttttcaaagaacagagctagaaaatatgttgggtttttttgttttgtttttaaagaaaaaatgtatcataggattatgctgatacttccaattcaagtgcaggcctaagcttttcacattgtctcttttctcctacccttaaagtcctgattcctaactataacaacatcattactcatttgctttatcctgcattatgtagacacaatagagtaacaacaccaatgctgccaatcaaaagtataattactgaaacccacttaagatagtcctgcaatttttttttttgttcatagagtgtacactactagggaggtgtagtcaaattactatgttttaaagacacttggaataattcatatctgtgaagttatacccccaacttatttgttttttgtattattgtttcattttgcttttgatgtttaggcatttcttttttaaaaatcaattttataattacgtgaaatacttatatggttccaaaatcaaatctactaaacaaactatattctaggaagtatagcttttatgtttcccttctatgcttttccttccttcctgtaggtaggaaagcttatttgttcctcaaagctctgggttgttcttttattttatataaataaacatgtgcatatattcttttcattacccccacagtacccaccgtcttaaacacatgtacaatatatgtgtttttctaccttgatttctttcttacttagcaatatgcccagaagttcactctgtagcgctttacatcagcatcaaaatccattatgtactatcgtttattgacctctctgttggagaaatttggattgtttctagtcatttttgttatcgcaaatagtggtttaataaaaaactttactttccgttttttgtttttcaatgtgcttttaggatagatgcctagaagtgagattgttgagtcaaagaataaatgtgttaataattttgctcaatattaccaaattctttcaaaagggttgtgcaattttgctttttaaaatcattattgtataagggcatgtatttcctgaaaatttctccagaagagtttattgccaaactttaaaaaaacagcctgatacataataaatgatatctcagcatagtttaaatttgcatttttcttgttaaatcattcatgtttttactgtagtcctcctaacatttagggagcaccaattatggggtctctagaaggttccaggattctgtaatcaatttgacatgatttctgtcttcagatattcacaatcttcaggaagatatattgacaaaagaataactacatgatctattttgtgtgcaacttagtacttacagagcattataaatgcacatggaaaaataggtaaaggagaaaatcattctctgttgggcgggctgagggggaagtcaggaaaagctacagagaggttcgagggtaaactttaatgtgggccttgaagtatgatttggagttagcaagacagacaaaggagcaaggaaaccattctagaaaaagaaaattttgaaaaatctccagaaaaggatgctttggcctatttggaaaataacattgtcttatttatgggggagatgacagtgctttgtttttagtcagtagtttatacaggactttgaatagcatgcaaggaagttggcgtctcaacctgaaaattgaggaaggtgtgacaaaggctgggcattaggtgagatcaagtatttctgtttttttttttggtaaattaggtagcaggatagattataaatgggctccacactgaggagcccagtgtgatggctgatccagcagatcagggggcagtggctgcaaagctgggagaatggcaaggtaagcctggatgcaagggatattgtcaaagacaaaatttgggggatgtgaggcttaaaagggaaataaataatggtgatggtgagatttctagcttgggcagtgggatagatagtagacgctgcgcaaattcgtttttaaatcagcagaatgagaagcatcttatttgaaatatattctaccaaatcttagcatcaaatgtgctagtgactagcaaaatatgtaaacagaagggaagtagcttgaaaagtacacaaactggagaaattgctcctgaaggactgtaagttgaacccttttaagcctaagatctgtatttcctatgagccctaggctctttccttgtgtatcctgtttcttattagagtagaggctacttaaaaataatcatagtttaaagcgctctattttcagaaaacattattcattagatgttagtaaataatgtaatctttatacattcataatatttctgcattattggagtgtaaaaagtcagtgaaatagtcatttgtaaagatgtcagtttttatctgtggaaaatagctgttcataccattttaagcttaaaagttcttcatttacttcttaaaatatccatgttggtattattttgtctaatacaagtaattaatatttaccccaaattaagcttttaagtttactaaatgttacaaacataattcaaagcactgtttagtgtccatctgtgcaggaaaaataagatcaatacaattgagcagctgttagcatgtattggtttccttatattttaagtatgttttcatgttttgaaggtgtaaagggatgacagtatgttttgttgtggttttcatcatacagataaaaacttattacagttgaaatcttggtgaacataatacattttaaaatttccattcctcacccatttatctagatatttagacacagtaaaataaataacatggatacatttttgtcatgtgatttatgttttttaaaaagtagaaataaatttctctaaaagttatttttattttttaaatttagcatttttcatatttgaggaaaaaacaatatgtcttggtaccctagcttctgaactaataacacacctgtcattttacaggttattttaatgtttttcattgggatcaaacctactctggaaatatctcatgggtgagctttatttttatgaaatgttcttggcacttgaagacctttgtaggtacatgccagactcatcttacatccagttcttctgcatggaaaatatgtgcattgaaattctaagtgccttttcaaatttgaccttcttagagaataatatgagtcccaacaattaggaaaactatggaatgccttttggcctttacttttcaaagattttcagtcagtaatgtttaattagcattcattgtgtacattgtccttttttgtgtgatatggctagttccaaaggaatattctagaagatctcagccttctgctattgaaggtgataatacactactaagttatgtgttgctttacattaaaataatgttgcagcagttacttattgcttaactagcgggtataggacatcaggttgaaataactgattttgaagtgaagagttcttgtttatatcttaaactaaccaagtatgttcattaactttgagaataacaatgatctttttcattattcttgagtagactggataaatcagaaaacccatgttagaggtccctgtaaaaacttcagtcttatttggtaagtccctttataagagtttcaataaaatcaggtaaatttaaactctgaaaattctacgtactgtctatcatgttcaatttactgttaaccagtactatgcactggaaaaaatttttttcaccttaatgagaccactggtcattactgctgctactgatgctcttttgtctgcacatactgttgcaacataatgtgttgtgcatttgatacggatattatcatattgccataaggagctgctattattttagacaccaactgattccatgatagtgtcagatttctttaacatatgcttatgtttttgtacaaatgaccccaagaaacatctgctagttttgtggtggtatctactgtttcttttttagaatttgacctgtcagtcactttttaacgtgaatctacaatatttgagttgtattcctttctcgtttttatgctattgatattaacaaaattgagtcagttttatggcataattcagagagaaaccgaagctgtctatggatgttattttaaaaatacctttttcatgatgattgtgcctttaaatttttgtcattgattgacactttaaaattgaaaagtgcccttttaatggatcctttaggttccaaaatcttaagttgaaaatttctgtctattggtcctgaaagtactctctgaatttgataagtatgtagtagttgtggtgtatccttggtcagtttatatcctgtgctaattgctaatcttacttagtttctttgatgcgtgtgtgaagacaggcaaagaaaaaggaagtggaatttctacaaaactgtgaaatctttactttatggagactagagaaatttctaagtaaaagaagacactcattctattgtagttaggatcccttcttttacttgcttttcatgatcttgactgaaaagcaacaattgagatttccattgcccgacgctttctcttctgcttttctttttgtttctcttgcatttttaaagacagctatttattcaaaaacaatatgaacttttatttattggacttaaacctggaacatcaacaaaacaaagaacaaacaaaactacctttccaaatttattttattagaggatgctatcaatacaattttgtattatgttcacacttgataccaaacctaaacccaagaaagtgtgtcctgtgttacagcctatccctctgtttaagataataactagaacaatttacttttattttctactcatctgctttctgtgtatcagctgttgtcctccctcagcctcgaagcatgtcatcatttccatctccgtgctcattcagtcatccttgctgctcttagtcccctttttgtcccttgggtgacttatgtcattaggacaaccttctgtccccacttggctgaaactgagctgaggcccttgccagttgcattaggtgtggcacctttcatggctcagtttgggcctctgtgatatctgtgtgccttctactccaaactccattctgccagaggtggcagggtgactggaagctttagtttcagtgacaaaacccaagcgtggctatgctgagtgtctaagtagctttcatttaggcctgaaataggagagtcaggcgcctctgtgtcccctgagaaagagagatttccctcagctctctgggcccagcactcaaccatttaagtcagctggttagtataatttccctaaattgtggtttagtttccctatgagtaggactggagtaggaccaagtaaggaaagtccctagtgacctttctgcctcctgaggagcaggccatttactttgagttgtagcttcccatctgtctgtccccactaccctatccaaggccctggaggagccacaggatgagggaggagattcatggaaaagcgccttcaggtactgggtatgtctggagtaacatttaaagtttaaaagactctttaacaattttcctctgatacttactactgcctatacttgtttggttttagtacagtaagttttgcctatcgtgggggtgaagaaaatagaaatattcccattaactttgtatggtgcttggtatgacaccctgaacaggtgcacccgtaattgtttacttgatgttctttttaataagtcaattatatcatcggaaattgaagaatagcaaagttaatttgtttaatcattctatgggaactcttgcatgctcgttcactagaggaacattgcgtttctcccttaaaggacaaggctttgttttgtttttaataagacacactctttataattaaaacaaaatcccagtgttaagggatttctgttttaaataattggatttctttcctttgttcctctaatccctctatatgagaaaaaaatctaatggtgtcttaggataaatatttttagattaaaaagttctcttaaccactgaaatttaataatacttctcaaagtttatggatgatatagaatgtaatgtaaggttgagaattttagatttggcaaaggcaaagatacaaaaactagtgaaaaacaacaaactggaaacacttttaaaatactgatgtatttatctttgcaataaattattcagaaatataaataaactcactatttacatagttttatttaaatttgtcctcaaaatactaaatttagtactatatattttcttctttcagataaatgctttcctgaaaatggtattttaatatctacagatggtttagtttaacaatggttggggtaaaaatgacatagggaaaagcaaaatgtgacagcccagcttggttacctttagagaaactcagaataaactctattcccatttccttctctttcccctttccatactcgagagcccttttctgagactcttaagtcatgtttgggccttggagaggataaatagcagggtgggtggtaaaaggggagagtgctttgcttgaggcaaagttttcctccatatgggaccttcctcaagccctcccttcaaaccctttaaatgagagcatgagctcctaggacagaggtcatgtggaaagcagcattagcatgaaggggggtgctgtggaggggtgtaaggtgcaaaaagcagcattagcatgggggaaggtggggtggaggggtgtaaagggaatgagatgtgaagtggttaaagggccatttttctagttggcctctgggctttgatgaaccttttccagtgtgcctgtttctccacttagccctgggctaatcttgactcttaactttccaggtgtgtatctatgctgatttctcctgggtttggaagctctgagaagctctggttctagttcaatcacaagacttttaaagaaccagaaaaataaaacaattttttaaaaagtaatgaagaaaagacttttaaagaaccagtgaaaacctgggagtaaaaatatagaagacttgagaaatttcatctttacctttcaagtgggcagcatgagaaattcttgtaaatggtgctttcaaatcttacacaaggttctcagttacctttatttgtactccctagactgtattgcatcccttgctatgttgactaattcccacctaaaataattcaatggcctcccaatataatctggcattctaattaataagctaagaaattatttggtttttcactcattggcgttaaatattcttcagtgcccacatttggaaatattggaacacagaaatgaaaaaagatacaatcagtttctctgcttgccatgttttccttgatatggcaatacgacaacaggtcaccctttgaagaaaattcagagatgctaaagtagaaattaaaactgaagataagtcaaggcaggatagtataggagtctgctacagctgccatagcaaaatactacagcctgggaggcttgaacagaaatttatcttctcacagttcttgaggctagaagtccaaaatcaaggtgccattggggttggtttctgaagagggttctcttcctggctttcaggtggccaccttcatacagcatcctcacgtggccttttctttttgcctgcatggatagagatctctggtgtcttccttgtaagaacaccagtcctattggattaggaccctatgctatgacctcatttaacctaattaccctatttaaggccctgtctctaaatacagtcacactgggggttagggcttaaacatattttaggggaacacaagtcagtccataacacgtgatttgctatagttttcctttacctaaatcttttccaaccttgagagtggattttggccaggtgtggtggctcacacctgtaatcccagcactttgggaggccagggaaggtagattgcttaagcccagaagttcaagatcagcctgggaaacatggcaaaaccccgactctgggggggcagggggagtgggggaattagctgggcttggtggcgttcacctctagtcccacctactcaagagggtgaggctgaggctggaggattgctacagcccaggaggcagaggtcacagtgagcagagatcacaccacttcacttcagccctgggttacagagtgagaacttgtctcaaagaaaaaaaaaagtgggttttattcttccccttaaattcctattaatagtgaggtgaggcttcttgtgttttttttttttttttccaagacaatggttaatgtgtgattacttaaaaatgatatataacactaagaaataaagaattgttaagtgagaaggaacatattaaaatggcttggaaagatgggtaattttttacattttaagtaggttttctcaactctaactctgtggaacttggtcaatctaatcagtctaaatatagcacaaataataatagttatatggacaggagaaatagtagccctcaaagatagtgaaatacatctgaatatcactaacaatgtcatgaatttgcttgttctaaagttttctgaaagtatgaattcataactgagtttttttttttttgcctatgactactaatgtttgaggagagagtagtgtcagaaccacccccccatttattacatgtttatttcatattttggtactgaaatcagtgtttattttgtgtcttcctgataaatcttgccaataagtaattaccttccatactgaaaagttcttaggattaccaggttgctgggggcaaccttaaaaggccatgcagaacattgacttaggtggctattaccctgctttattcaggtctgagcatttactttcctactacaatcagaatactgacctacatttaaaagtgcaacactgccctgttatctaaatccactgtgttcctgagaggaaataccagaaaagagggcaccaatattatttttctgctgttcttgatcataagtgattacctttttttttggttaggcattctgcttctgaaagataactgaggttgaagttaatagaactaagattcttatataaaatcataggaaagataattttcaggattattgaatcatattgaaaaatgatataattgtgttaaaagataaggactaaaatgagttaattcaatttggaaatagttaaattagaatttgcttctgtttttgatgaatactgctttttgaaaaatcttctgagtatttaagcttttactactctagtcattctctctaaagtagacatagaagcgtgttcttatcttgatttggtaaggctctgaaaatgcaaagcaacagatgttgtacccagcataattatatgtatcctggaaacacatctttattgagtgggatttgttcttggggaaacaaaaatttggcaaacaaaggacattaacttgctgatctcagcagtaattacttgggttagattataataatcttgtgtaggtggtaactgcatgcatatattacaaaatctaattctaaaatacgtacattaaaaggaaaatgaacttgcgcaaactttagatcatgtatccccttgaagagcagaaaagatctcaatttcattatttgaaagttgtttgaacagctttttggaagaggtttccaggattccaaatcctaatatgtgtattgatactgaggctttggactaatctttgggggttactgccttttttatgcccactgaaaatagagcatttcaaacaaatgaactgatctctgatctttaagcatgccagtaactctttggaacaaatccatagttatttttaccaatgactgtattaaaacagtactttctgtattatctcttccattccaaggccattttaaaacaccctctttctcttctcccaataggtaaagtacgacagagctccttaggactgggttatggagaattatctggaggtcaatttgagaaccactgtgcaaaccatttcttaaataagtagctacaaggttgtccttacaaaaatttctgaagttgatggtgttgcgttttggagtctgaagcttaaataagagtttgtcagtggtcatggtctaaatagctgattactaccaaggtcatctaatttttttttaacacaaaaaaatgttctgagcacaaatgaaaccttcaggacaagacatttatgttttgagaatgttcttaaatgattcctgtcgtgtatcttattttacatatcttaatgatcagcatgtattttttgttgttgatgatgattttataaatgtgctatcacctagtttctaattcctaacagctccttcatcagtagaatattgctgtagcacagttttgccatctgttaagaaaagatggtgactaataagagtggcacatttcagggctggtgtgctatcgcaacatctagtgttttagtactgaggacagtgatgtatgcagtgttccttacagccatggggtgtgggaatgttttcctcttcggcaaagtctgtgtatttctatagctgaactctcaggatccagaggaaaaccacaagatgatgaaaccagatgattgtcatcaaatttctattccccactacatgattattagttttcgtcaaaagaaatactcatcctatcctgggttggaattggtaaagaattttgcattgtgactaggacacctaaaagtttttaggatgagtacaaatggaatttgatagatttccccaaaatgtttgggaaaagatttattcctccctaggaacagcaagagtagcagcatcacatgaggcaactcctggtaattttttcttcttgctcttatttcaatgatatcttttcattcttttctgtatctctcaatttctatgtttctcctcttaatgtatcctgtaaatttcttagtagaacctttttactaatgagggtttcctagtttgctttaggaggcactcaggatgcccccttttgtaaggcagtaaattgaaaataagaacttggtgaaggtccacgtgacggttagtttccattctccattgtaccaaactgctacagggaaagaaccatatttaatcaacctcaaatcctcaatatttaggtcagaaaacacttggcatagaagagacactcaaattttgcagctaaatagattattgatagaaaatatgtttcttgcctctacaagcaatatgaaaccaatacaatctctaaatatcttcagactactaggggcaaatactgtattataagaataattcttcagaaaggaaaatccagctactctcatatcacctctctatgttgaaagctagggaagataaactggcttccagccagtgagagtccatgtggacctagtgctggctggagatccctaatccaaaggcaagagccagatactggttgtctgctgaaaatcagaagatgacctctctggtagtaaggccagtgactcatccctgcatcttttatcctcttctgatttgtataaggatctctcctttttccccagtacccactctcaagaattgctttcctttttaacatgatcataccaaaatgtatctaacagtaccttgatttcctttctgaggaatttagggagcatatttactttgtcagactcattagaggtttggcttcttggtcgggttcttaaatggacaacttgtttgggtgatttggcagagaataggagaagccagtcccctctgatagagcaaacctggggagctgtggttgacccacctgctaactgtcctgtacaattaggcatgtggcatcagtgggtgactgaccagagccaccatctcaatggcggctgttctttccttcctgtgccttctcagatctcttttttgttcttgttactccactatattggtttttcttgagtttttttcaagcaaatatcattattcacttctactgcagttcctctgttgttcgctttttctcttagtcttcattgttttccattttgaacattcagagatccatcaaaaaaagtaaaataacaggaagggagaggtaaacaccagtcaaatgaagtattataatagtgtattactatactctttaaagtaattgaagggtggttttttggggtcagaatatctgttagaatttggaatttgccactcttgagactggggcaagctatttaaactctaagcttatctgtccttcctcacaatctgtaaaatgggatcataataatggcacccagtttatggtgtagtgagcattcactgacacaattaatctaaacttatttgcactacatagaacagaatttttgtctattaaacaatatagcgttttaggcatgaaagaaactttagattaaattaaatatcatttttcttaccacagggtaagtttctgttttgtttgcccctgtttctctaactcctagaatagtttccagcacatagagattaaacaaatattcgttgaatgaatgaatgcatctattctaatcctcttgttttaggaatgacccgtcaggctcaaaagtgaaagcatttccctcaagattggtgacagagttggggactaaatctaaggctttctcttcctacaccagtgtcctttctgagaacacgatgccattttctcaatatttgtttatttatatggtaaattggtaggaagctgtgtggtactataagaggataaactttgataatgaggtatacttgctatcaaattctaacattctcatttaaaacatggcataccatttgtcttctacattttcatatgtaaagtgaggtgatttctaccttatagaactattgtgaggattaactgaactaatctttgtagagcacctggtcccatttattttttttttttgctcaccccaccccccaactttctagctagataacttatacattcactctgtttttcattccttcttgaatctcctgtggccagacttgacccctgtcactctacagcttactcgtcaaggtcagtcctcatctgacttgacctactaagagtctgacaagtagtcacactatgctccttgatacagctttcttcacctaccttcttggatgtcattcttttggttctcctcctaccccattgggctgctttttcccagtctccattcttgggtattctcattttcccatgtctgtcctctgacttcttattgtctctgtttctgttttctctggttggaccttctctagtttctggcttcaaatactatctaaatgctcatgtctttcaaatttgtaactctagtctagacctctcctctgaattccagttttataaatcttctacttaaatattagaggtctaataaacttctcaaacttatgttctacaacaaactccacattttctcctgcagcctctaaatatgtacctcctatagattttcccatttcagtaagtgggaacttcattattctgattgtccaaaccaaaaacacttggagacttgctacattccaccctttgtctttcattctacatccaacctatcaacaaatcctgttgcctcttccttggaaatatatccacgcttgagcagcatcattgtcaccacttggtgttatacactctcatttctcacctggagtattgtatttctcatctggagtagtgtctgtccaacgatgtcccccatcagtctgttctccatgtagcaatttcgtttttgtttgttttaagattgggtcttactttcgccttggctggaatgcactggtgatcatagctcgctgtagcctttaattcctgggctcaagtgatcctcctgccttagcttctccagtagctaggactacaggcacacaaccacacttgactaatttttttttttttttaacttttactagagatggggtctccctttgctgcccagtctagtcttgaactcctggcctgaagtaatccttctgtgccagcctcccaaagtgttgggattataggcatgagccaccatgtctggcccagatgttaattttaaagtgtacattagagcacatcgttcttctgcatgttcagcataaaatccaatgtccttaatgtagtctatattaccctacatgggctacttgtgcctgatccctctactcttatgtcttatccctctcctgctttctcactagcaccagccacatcttaccgttccttgaacacaccaagtatgcatttgccacaggaccttgatgcttactgttccctttgcccagaaacccttggaaccagctatgtgttaaaattcagatatttactgattttagagagctaaaatggggtatatataatatattacataacactcacagctggtttgtggtagcatttcataattaaataatatttctgaatgaaacattaagaatgcccatgctaagagggatgagtaaagactcaactctcattgtcagttcagctgcagaatgaggtcagctcaagatttgctgccaaatgacttaagaaaaaaatgtttttggagctttggggatttcagaattgcagatgagagattctagacccgtacctacacagcatgctcccttattttgttccaatctttgttcaacgattatttattgggtagtcaaggaagatctctgtctaaaaggcttctctgtgtggaacaagactggcatgtggaaggtttccaattaacgatattgaaagagtgaagctcaaatcatttttcactcaaatacatactatttagaagacagtggccagtttaagaataatcattattggaaacaaagtactatttgattagggatagttaacacaaacacttattagtattagggatatgtgaaatacttaatggatgagtcatgtgctgacataaaacccattatccattttagttcctggtagcctaactggttgaactctgttttattgatctattattgatttggcctgtaacttcaagttacattttaatgtaatttcatccttttctgatcaccttgtgtcttcaagcatttttaagcagttgatagatagttgaaagatattatcactatttcaatctaaaagatattatcactattttaatctacttaaaatttttactacattcattttaagtatgacttatggaacgaatcgaaaatacaagatagtgaaaaacttgtgaggatcacctgaaattttagcattcactttccttacatagaggaacttagtctctctaaagaattatgagtaataaagtatcataatgatatttgtcttagttttggttaagtgtactccacaggagaaagttaggcatgagcaggaattattgtagtcccacattctcaaacagttctccagtaagaaagattttatgtgtttccagaaatcattttcctcctcttcagagctttgggaccataattgtatttaaattgctaatctgttttaaggaatcataataaattgtttaacatttatattcaatcaactttgtaatttgtataaatttttcagggtgacatttgaacaatttttaagaaaatgggaaatacagaagtattcttagttttaatatattttaaaaagatgacatgtgatctactgactgaaatccttcaatcatttttgtttttctccccaagattagatagaatggatgtgattttatttttaatttgcattatggagagtacttttggggggttttatgaaaaagacttcatttattttgttagtggtacttcagttgcataagaaaatgttcttttaaatatagtggtcatttgtgtgcagccttcaagttagcaaacatgcctttgagtagtcactatttttgaaggtctttatatctgattgcaatggcttatattcaatagtcctcctactaaatgaaataaaaatggatgcctcttctgccacagaggcacaggtggacatgttggtagcaagccccatgcggtgtgacacatggcacagcccaacatgggggcaaagagcatgcggcttgagctaggagtcactttatggctactttagtgtagatttgtgtttttctgtggaacagccattattgaagacatttatatagtatgatgtttgtttttcattaaatgctgattgtgatttcttaaaaatagttaagacttgattagcagaacctatttagaagccagagttcccctgcttcacctcttgctatctatataaatgatatttttgactctgtcctttataatgttggcaccctgtgcatattagatgtaatcagggctgaaaggaaacttgaatccatctggaagcaataaacttttctaaaagactgcacagtgttatttaatcctgtgacttcttactgtgagtgaaattaaggtttgatgcagttgtgtcacatcgtattgatatcaaatttatctttctaaaaaaaaactgacagtattacagcacagaggagaagatggcttgctgtaatcctgtaagctattttacattgattacatgctacataatgtacctaagtatataaaatacttgatctagaatgtttatgttttctccaaaattttctcatcaggtaatactttctcaacttcacctttagttttggcttcttatcatagtactaactatgcggtagtaattgtgttatgatgaaaggcatggagaagaaattataattttaaaactattataaagtggagacacacttgtataattaccatctatgtagactgccaaggtataaacatttagcttattttagtatcagactctttgaatcaatttaaggctttttcaataaaattggcttcctctaatttctactccaaaatggttaaaattttgttttacttcaaatacgttgtagggtatcatatttcatgtgactaggagcctaaactatatcagctgactggcataatttgtgaattatatgtgtgtttattaaaatttaaagtttttattaagacttacaattttattaagacttaatttttttccttacattttgagtaagtccaactgaaaataacttagagacttaggaaatttgactacattttataagtaatttccttgtaatttttctttcttgtggaaacaattcttactgatttacttaactcttttttcaatggcaaaaatgaaaaccaaatatatttgtcaactatattcttttaattgtggaaatgaaaggttcatatcccccatttgcctagcatattaaaaataaacatgacctttgtcttgaatgttgttaacttggattttaaaaatcaaaccaattataagctatattaaaattgcttatcaccttccctttgtcttcagtaagtctgggcctaaaaatactcatcatatgaataaataaagttttacaaatactttttagaacatcttgaattatatgtgtgtttgaagcttacttttggatgttcggtcaacaaggcttctgacagtttctttttatcttccctctattccctgccactgtgcaccccaaagtgatccctgaccacagtggtcccattgctggcatcaggaaggtagactgaggagttcaggtatcctagaggctgttaggtgaatctcttctacctctttcctggtcctaggaccactggacacttcaagtaaaaataacaattactttaatctctcaggtaaagtttcttctcccttccagcaacacagatctgcctgtgccgagttcaaatactctgaactttcaacagttgttctgaatacttttttgtcatcttatgatcaaatattgagagcattgaggggataactgaatgggcatggtataaaagtcagacttttagtgtttctaagtagcagaaccctttggacaatttagagggctgtgcgatatcctcaccgtgactgctgggaagtaatgggatctgacctgcagaggtactaccttggctgacaataatgacaaaagtgagagcaaagtacatatgactatccttgaggtcctcaggaaaaaaagagtattagtgagttgaactgtatgtaagggtctttaccaataaggaagcccatgcccagacataatccttacaccctggcaatagaaaccatcattgtggtttacatctcatcctgttcctacagtccagcaagttcaggccacaaaaggtttaagcactttttcctttgttctcatagcaacagttgcccatggaggttcagttacactaatattaacattttaatatacacaaagaagtgcctcgaatgtagtaggtattcaaacttgttaaatgaaagaagtaaactttcagacttaccttgaactactacagttttattctttctctaacctctcccactactaccatcttaaaaccaccatttaattagtattttataacaagttattaaaggctttcaaagacctttgaaccttcaccctctggtaagttaataacttctgatatgcgattaaatgtcaactgagtagtagtgggccctaagagctcagagggactgagaaatgaaggttattgtttagaagagtggctcaatgtgcttcgacagttggttaatatttgaaaagactagagtcaagaaagccttccatgtgctaggaaatgaaggagcaaaggtccagaggtggaaatgtatacagtgtgattaagggattttctgattgatagtaaatacagtcaataaaaaacttttattggaagcctagcctgtgtttgaagcattaagctaggtgctgggatacagagattagagatgaagataatgatgaagatattgttgaagtgaattgctgagaagctggagaaagggccaattaccataatctgaggctcaggaggaattggtgcaaagatcatctggtatgatatatatgaactgtatatacaaactgatctgtgtagctgaactgataatgccaaaaaaaaaaagactaggtttttgattaagatgaatccattaaggtcatgttttctgttggtgccattcttggagacctcccccaaccctatacatttataaatgtttttcctgagggactgagatggaagtggacatataaaaggaaaggtctgggcaaatacataagtaggtagtaaaatcaaggaacaaatgatctcaacaaaattgcccttcttgaaatgaatgaaaatgatgaaagccaatcacattgcatgatgaacttggggtatagaatatgaaatatttaaaattgctttatttcatgatgtttcagatgtagtaggaacttgttgcatagatggtgtaaaaacaatctagtaataaaatcttaggtatttaatacaaggtgaagaaagatgcaatgcataaatcatgccattttaggcttaattttcataaggctatgcctgtctttataagactatataccaggagttctcaagctttttggtcttggaacccttttatactcttaaatcgttgaaaaccacaaagaccatttatttaagttataaccattgatatttgttgtattagaaattaaatagacattaaaaatatttactatttaaaaataaccaaaaagatgggcatggtggcccacacctgtaatctcaacactatgcgaggccgaggcgggtggatcacttgaggtcaggagttcgagaccagccaacatggtgaaaccctgtctctactaaaatacaaaaattagccaggtgtggtggtgggcgcctgtaatcccagctactcaggaggctgaggcacgagaatcacttgaacccagggagatggaggttgccgtgagccgagattgcgccactggactctagcctgggcaacagagtgagactctgtctcaaaaaaataaaaaaaataaaaataaaaataacagtaagttcattgcatattaacataaataacatatttgtattaaaaataactattttccaaaacaatcaaaaaagcagtaccactcttctattttaaattttttcaaatctcccttttctaaaaaaaaaaaaaaaatattgtgtaagtttaaggggtacaagtgcaattttgttgcacggatatattgcttagtggtgaagtctgagaatttagtgtatcttcacccaaataacatacgttgcacccattaaataatttttcaacacccacccccttctcactctcttgagtctcctttgtctatcattccacactctgttcctatgtacacattatttagtacccacttaaagtgagaacatgtggtatttgactttctgagttttttcaactctggcttaatagaagacagctgaaatctcagaatgcttcttcatccagtctgttgtgaatatgttgctttgattcaagtatctaaggaaaatacagttttacacagatgtgcagctgaaaaggaaacatcttttaatatgttcagataattgtggatattgtcctttgatactatagcaaaacttatcaagtgctaatttcttaaaggctggttataatttgaaatctgaaaacatatctatttaattgtagtttgctatttgaaaatttattggtctgtcttgtactttgaatggatattttgcccacgtatgattttataacatcctgtattggccttttggaaaatttggtttactattatacagtttctaaatgttgataatttttattataatatattttaaaaagtctaatgtcactgccagtctcatcagaaaattctttgagattagaaagctgttaagatcatcatcacacttacaagttttacaaaattttaattttactcaaaactttatattttatcattgacaaagctctcagttgctttgcttagtgactgactcactttgttcattttccagaaagtgtttaccaaatgctgctgcctcaataccagagtctgtattgtcagttgatctttcaagtaaaaagtggtgttctatgaaaaacagctagttcagctgcgactgaaatgatataagtgtttctcctggagcaaaccaccacttcgatttgtagcagaaatgctgtatgtatactttccattgttattactcataacatttttaaaaatatactcaagggtggagatttttttaaaaataagtgttattgcttcatcaagaacagttaaatgaaactggattttttaaactgagtttgagttaatgaagaatgcagcaattattagtaaaatttggtgctccaccttgattcatactgacactccaggagttttacccactatttcttttgtacctttagtgcaaatgttaatatggtaggaatggtaaatgacatctttagtattattataaaaatcgtttttaccctgtatactctttgagactacacattgagaattgctgatgaaggtgttttaatttatcataagcactgaaaagatttacttaattcaccaatttctcctgaatatttgtttatataaaacaagactatgtgtatacacctacctttttattaatggtagagatctaggaaaattaatttctaagaactagccaggatatttggaatgtgaataaatcatatatccagaaaaaagctttagaagattgtctatgattgaaagtcaaacagctctcatttctattatactgttctttttcaaagaatttaccaattttatgtggtatttatgattaaacatacaccatgtaatttaacatttttaatgtcacttttacatcataggtattaaagattagcatttttattgtctgtattttaaagctcaaagaataacatttaggctgggtgcggtggctcacacctgtaatcccaacactttgggaggccgaggcaggcggatcacgaggtcaggagattgagaccgtcctggctaacacagtgaaacaccgtctctactaaaaatacaaaaattagccgggcatggtggcgagcgcctgtggtcctagctacttgggaggctgaagcaagagaatggtgtgaacctgggaggcggagcttgcagtgagccaagatcgcaccactgcacttcagcctgggtgacagagtgagactctgtcttaaaaaaaaaaaaaaaaaaaaaaaaatttagatttttgactgtttcattgattcatcttagacttcacatgaaaatatctgtatatcctcaaatgcttacattcttaagaagtatctcagccatttacacatgatagaaacaactaaatggaaaaaaattgcagttggaaattcactattttttatttgatccgataacaatgtgacatttgcgattggactgtaattttctgtctttctctctgaaaataagttcaaaaatttccctctaattcttttactagataagaagcctacttcgttgtaactcttgatatatgtatgtatttaggaacttaagcttttctgctaataaatgttatgtcataattcttgaggatagtattatattgtgatgggttttcagtaaactacaggagcagccctatttgtttaaaccctagtttaacctgattattaacaattaaattgtgttttcttctaacaattaaagtgtgtttaaatttattggtcccttgcttcacagatttatctcagtatgtggtgtattcaaacagaattttgtatttttaattaggggattagataaccaattctgaagagccaaaaaaattgttagacatcacattgcttaaccatctaatataccataagtgtgtgtatacactatgttgtgggagccatctatcaggcaggcctgtttttcaggcagtattttaaaaagtggacatgtgcagaaactgtgagcacaattagcgccaagcagataaatccagctctaatcctgtttacggtctacatcagacagatgtgccaagattgatttagacaagcccgaggcttacagtaatatttttaaaagtgccattcgctgttctatttttgttaaacctttgctaaatattcttaagtcttgttggttttgctcttcttattaaccaccgtaagtaacctactttaagcaggtcccgctttgctctcatggtgacaaggtaacctgccaggagaggttatctttattccctgtaattaagttgacttttccccccaaaaaaatacaacaataggaagtgggtgctgaattaaataaatagcatgatacccagtagatgtatacttaagttccttgcaagaacagatggtccccagtatctctgtaagtaatgtgagaggacagttaatgttctgaaacaactagctataaccagtatgatactaatgaaccagtagatttcaaataataaaccacatgccgccaagcaaaattatatgtcattcataaggatttaattatcataacttgcaaaaaagtgtcaatagatgatttctatatttttatctactgatatcaaatatcaatttatgaatagagtttcacttcatattttttaccaataaaggtatgttttaacattaaggtagaattaaagttatatttaaaatacatgccccaaagtatgtggtgatttttttttaactcctcttttactatactgtctgtatgtattgggctgtatatggaaatgtagcttttacatacaattaggaaaacaattgcttttatttctagcagaaacttgtactataacagaagtggctagcatgggaatcagagtagttatcttgtagatgacaactgaagcagacataaaagatgtaatattttttcagcactcaaaaatttataagtaaaattttataaacaaaaagcagtatttttgtgattcatatggaaaataaaatgagtctgagtcattcttaaggtgataccgtaaaggtgtatagataagaagtccatttttaaatatacccaagacaacagttttttctctcagtatggtttgttttcccttttttctctttaattatgtttcccataagtatttgtatattctaagaatgtccaaaaaataaatgttttgcagtgggggttgaaaagaaagaaagacctttttagatttcagctgatcttatcagatgatctctagaaccttgaaccttcaaccttcactgaagttagctggagggcttttcacctggaaacctgagaaacctcagaagccttctgctttagctctctctcaagtctaggaagccagtggcctgcgaccccacagagccagctggtccactcctcatataagaacttcggtaacaatacaaagacatagcaaagcaccatctaatctgataactcattaaacaatatttagatggctcaagactttaaataaaaacattttaagcttgtttatagaatactaacaagttttattcccaaagactatattcagagtgagaaaacaattttccttaaaactaatattatatacatgttcatatatgttaggaactagttatatgcaaaatcaagtgactcttgtgattagaactggtcacatttattcatgtagcataaatggttaatattgccaaaatgagtaatagatcagattttctatgtgagatattgacacctgagagatttacagtgtttcactgttgtgaaaaatggagtgctgaagaacatttgtctattgttatacatttgtaaaagaattcacaaattactaatttcaaataagaactaaatatttcttctaagcctatagtttttctttttaatttcttctaagcctacagtttttctttttaatttcttcttgtaacattggcaaaaagaccattcgtgtgaaaacctcagattttgatctgtacacaaatgcaggagtagagattggaagcttgagctggaaaagcaggaaatactgctcagagccttacaaggattttcagaattttcactgttgggtcctcctggttgctgcagtctaacctcgcatctccttgaaggcagccccagtttctgatgaaatactcttcagttaatttatacatatgctgtcttgctgttttcctaaggactgcaggcagaactgtggttcacctactgttttaaatttggctagatttaaaaacagatgatctcacttatatgtggaatccaaaaaagtcaaacttatagaagcagagagtacaattgcggttgtcaagagctgggggaggggaagcaaggggatgatggttaaaggtataaaatttcagttagacagaatgaataagttctggatctattgtatagcattgtgactatggctaataatgtatacttgaaaattgctaatacctgaaaatcactaagagactacgtcttaaatgttcttacaacacaccaaaaaaaggtgtgaggtaatgaatatgttacttagcttgattttaatcatttcacattgtaaacgtgtatggtactgatcttgtacctcatttcattttccatatgaatcagaaaaatactgctttttctttataatatcttatacagcatagatacaatttttagtggtcaattatattgtaatatatacataaatatatatgattttcattggtcaattatactgtaataaaacagcaaaaaataaagttgtaattaaaaaataatttggaagaaaaaattagcaagtggttggagattgaggaagatgggaccaataagtcctccaaggagagtcatacattagttttttttaaaagtccattattaatcttataatatttaatatgtttaatttcttgacacttattaatccaattaagtatgagaacactgtggataaatctaaaaaccttaaagttgagtaaaataaaccagatacaaagaagcacatactttatggttacatttatatgaagttctagaaaaggcaaaacttagctatagtaaaaaaatcatggtcctgagggaataactagagagtggtatgagggagctttctataatagtgggaaaattctgtatctttattgggatagtggttatgtgagtgcatatacttaaaaaaactcatggaattatgcccttacaaatctgtaatttttgttggtaatttataccttaataaaaaacaaaacagatgacagggttagtgattgtttccttgaagaaggtctttacatgggtctgttgttaacgagttgtagtaaaaatcatccaaaatgcttggattcaaatcttagatctgttcctaccagatgtgtgaccacagacaagttacttacattccgtcttcagtttcttctcttttaggaaaaagcatctagtttttgttgtagagattaaattagataatacaaatgaagtacagagaacagcgtttggtgtgtaacacatgttcattattagctacccttattttttagagaatggaaatttttaaatttaaactaatcaaactattttaggataagcaagtgaaacaatctttttttcaatcgatcacagaaatattttcactgaagacaaattagacatttatataagcaaactacagtgtcattaccattcaaattttcatatgcatattcatgcttacatgcatatgaaagcattacacatatgtattctataaatatatacaaaacagtaatggaaatgtgctgtactattttgaacatctttctagtcagcccggcattttatttacttttgagacagggtctcactctgttgcccaggcttgagtgcagtagtgtgatctcagctcactggaggctggaggtcctgggctaaaggaatcctcctacctcagcctcctgagtagctgggaccacaggaaagcaccaccatgcccagcttatttggtttattttgtttgtttgtttattttttatttttttgtagagatgaggtctcactatgttgcccaggctggtctcaaactcctgggctcaagttatcctcctgcctcagcctcccaaaacactgcaatcacaggcattagccactacactgacctctacattttaatagctgagtagccttctgttatatgaatatacttttttttaacaaaaccaatactccattattgtacatttaggttgtttccaagtttcactcaaataatgcttgggtaagtaagtatttttatttattattattatttttttgagatggagtttcactctgttgcccaggctgaagtgcaatggtgtgatcttggctcactgcaacctccgcctcctgggttcaagcgattctcctgcctccacctcctgagtagctggggttacaggtgcacaccatcatgcctggctcatttttgtatttttagtagagatgggatttcagcatgttggtcaggctggtctcaaactcctgaccctgtgatccgcccacctcagcctcccaaagtgctgggattacaggccgtgagccaccacgtctggcctggataagtattattttagctaaattgtgcatatttattcccttagagtaaattcctggaagtaaattgctggatcaaaaccaggtatattttaaagaattttccttttctacattaaaaataattataattctgattacaagaaaggaaaattatggagcttcataagaaaaaattagtctcatatttcatacctcatattgcatatttaataggtaaccagtgttaaatttgttgtgtgttttccactgggatttctttttatctcctttaataaaagcaggatcagatccctcagattactttgtaacttgcttttattctactttttcatacctcttagcatgaatgtctttccagaccagaatacagagatttcacttactcatttatgagctgcagaagatgactatgatttattcaaccattctcctattgaagagcatgaatattgcttcagatacttttgttattataaatattagtgcaattaacattttaaagtcttttgatacatattcccaacttgttctccagcaattaccatttttgcattcccaccagcactggggctacttccctttagttgcaccatcatttagcattatttttgatcttgtgccaatctaaaaggcaaaaagtggtatcttgttgttttaatttgcatttctttgattactaattagattgaactttttcatttgttcattggtcaatttgcatttcttcttttgtgaaatgcctgcttgggtcttttatgtactttaccattaaagtgtttttcttgattaaatagattatgtaactgtcatatgttgcaaatatttctgtccatttggcctttgcttatgactttttatgagtctttaggacttttgaggtctttattaggtattcaataattttaatgttaaatatattgatgtctgtcttcctttgtgtcttacggcttttctatttaaggttacgtaaatttctaatatacaaatattggtgtatattatgaaatagggccctatttttctttacaaaagattagtcagttctaaatcatcctttgctatttctagcggcgcttagatgccaccattatcacatcagtgaatttttaaatgtgtaattgtttcctgatctattcatttctctattcctagatacttctattgtaatagctttaccaaatatatctgatagggtgtgtactccccctcattacttcatttatttatttatttatttagagacagagtttcagtcacccaggctggagtgcagtggcatgaacttggctcactgcaacctccgcctcctgggttcaagggattctcctgcctcaacctcttgagtagctgggattacaggtgtgtgccactacacctggcaaatttttttttttttttttttttttagtagagacagggtttcaccatggtggccaggctggtctcgaacttctgatctcaggtgatctgcccttctcggcctcccaaagtgctgggattacaggtgtgagccactgtgcctggccccctcattgcttttaaaacattttcttactgtaatatatttattccaagagaattttcaaatattttatgagattccttgtccattccttacatcaaaaaataccacggagattttgattgaagttctattataagtagttacttggggtggggggaggggggagggatagcattgggagatatacctaatgctagatgacgagttagtgggtgcagcacaccagcgtggcacatgtatacatatgtaactcagctgcacaatgtgcacatgtaccctgaaacttaaagtataataataaaagaaaataaagagaatactggcatggaaaatatgtaatcttggaacttgttgtatctccacttattcaatcctttgtctctcagtagattttgaatggctctttatcccacacgagtctagaatcattttgctaagtttattcctagatataatatgctaattgatatgggaattttttttatctccattataccttcttcttgggtgtagacatatttgtagccagcttcctcactgcatattttttattaggcctaatggcattaagtttattattttggattttacaaaaaaaattatgataacatctttaaatagttagtttcaactcctcctttccccttaaatccatcaattactgtcttttatttcactttccttatgtactgactagaatgcctagaataattgaatgctatgagtaataataggtattcttgccctgtttttggaaatccttctggatttcagtaagtgtgatgttggcttttggtttagtatctttaaatttgcaatttacaagatattttacattggaatagtcattgagttgttaagtaaagcacaaacatgttaaattcagactgaagtacaggacttcaatgaaaagttaaaagagtttatttcatcactttcattttttctttccctcagtggctgtttgtcccctccccccaccccgctccatcccccagcttccttcctttgtgctcttattgttctaggtttgactacataaaaagagactctcaatttatatgtgatacaagaccataactaatattataaaattagtctagaagaagttatttgcaacctatataataagggactaatttcaagattatttgaaggactttaaagattggtaagaaaaaaatagacaaccgtttagaataaggcaaagcatgtgtagaggcaactcttaaaaaaaaaaaagtgagctgggtgtgatgatgcacacctgtggtcccagttactagggaggctgaggcaggaggatcacttgagcccaggagttcagggctgtagtgcaccacagtcacacctgtgaataaccactccattctagactgggcaaacataagaagactctgtgtcttaaagaaaaagaaatgaaaagatattcagtttcattaattgtttgactagctgatttttggaaaatacccacaaatataaccaagcctacaagttattttaaggtgggtaagagatacatcttatctatatgcattcacctatgtgaagcggacacccagtaacacccccgtgtggaagacaagcttccttaaacttcacaggacagtatttcccatgtagtccatcatagggtgaggatttttcaggacctttggtaagcctgcttgctttcattcttgagggtagaggaagggtgcaagacttccctggtctctcccaagcattttggggaccctggccataagcctacttgctcaacaggtgcaaatgactggtaatatgctgaccagatgcaagtgtaccaccaatgatttgctgtgactgagtttggtttcctttgcatatactatccagctttttgtttctaatatattcttccttaagggaaccaggacttcttggggaatccagatgagcttgaaacactgtttttataagagaagggctgttttcaaaaacatctatagttcgtaacaaaggagttagattgaagggactctcactgttcagtctgtgacaagcatgagtgttaaaatggagacaagaattttagttaattgtaatgttgaatttgtaaaaggctataacttcataatatgatcaaggggaacaagcaatctaaaatgtgttaaagtagcattttcaaagtgcggtccagggactctcagggttggtgaggtcacaactgtttttataatattgctaagaatgtatatcactctccttctctccaaggatacggtggagttttccagaagctatgggatatgtggcgatagccttgccctaatggagtgtgtgctttgtgctttgcatttttgtcctttaaaaatgcttggttttaattttgaatacaataattatagatagatataacctacataaaccaaagttatttgcggccctcagtctttaagggtgcacagtggggcctgagactaaagagtttgggaattgatgttctagagaaaagtcagtcttactgatgagggttaatcaattagtatttactgaccgggacaggacaaaccattcattttataaagacacacagagcatttcactaaaatacttttactctgattaagtggtgattttagtaatagtaatgattgtttgattttctgatacctgaaggaaaaagagcctgttgaattgatactttgagggtgttgagttttaggtcactgggtgactgtagaaatggaccaggagaagaactgaaacttgagccttctaagaaatagaagaccaaaaaatgtttagtgttaccctatcccatgaccacaataattgagaaaaaggcctttccgttccctcttccctaccctcccccttctcccctaccctctcctcccccctcccctccccctcctctcccctaccctctcctcccccctcccctccccctcgtctcccctaccctctcctctcccctaccctcccctccccctcctctcccctcccctctcctcccccctcccctccccctcctctcccctcccctccccctcctctcccctcccctccccctcctctccctccccctcttctccctccccctcctctccctaacccctcccaacctttcccctccttctctgtccccctccccctccctccctgtcttcctcccaccccccactccctgtcttcctccttgtcttccatcctcccttccttcctttccttcctgtctttcttttcctttctttcctttttcttctttccttcctgtcttccctcctctccgtctgtctccttctccttgtccccttctctctgtcttgcctttcctttccttctgtctttttctttctttctctttctttttcactcttcctttttttaatttcccttttacttgccttctctctttcattccttccatgctttcttttttttagtggtatgtatactttgtgagcaatcagactatagcttgcagaatagttgggagaggccaaaaatgcccctgagaatgcaagcaaggaacttcttagtgagcatatgaacatcctcactccaatcggaggataacattgttcatacttcaaggactaaaaagctgagagagggtctctgctttctgttacttttagcactcgagtcatttctgcatgtatttctactgattactttttctcctattttggttcatatgttttctgcttctttgcttgtctagtgattttggattagatgagtgacattgtgaattttactgtgcaggatggctgaattttttttctattcctgtaaatatttttttggcattgttctaggatgtagttaagttacctggaaaaagtgacatccttttgagaggcttgcttttaagttttgttaggtggaatcacagcagtctttagccagctcactaaggaccaatactcttctaaatacttaccataatgtcatatgaatttccatgtttttccacttcagctggtaggaacacctgtgtcatctctaagcattgtactgttaattcttctagtagttcttatctggctttgtacatctgctgatcaatactttcagctaaagtctcaaggggacctctgcaaatctacagtgttcactgttcagctttctcttctgtagtaaattgcacagtgaactctagtccccttagccttcctgaacccccagttctccttaactcagggagatcaccaggccccaccaggattcctgtatctgccctgtgacctggagattctctgcaggcaataggttggggcggtcgtagggtccactttgttttcctcctcttcggcttcactgtcctgtgttacctgatgtccaatgtctgaaaactactgtttcacgtatcttgtgtgcttttgtagttttaggtgaaaggtaaaactagtttcttattattccacattggccaaagcagaagttttggaagtctttttttaaggtctaaaacacttctactttgagagtcaattgaaatggtcttttccacaataattattttctgacctatggtttaaagataagtcatgaaaattttatgccactatttttttttaagtctgattatggttaaattcagggggctatttcctcctagattgacagagtttataatgtttcctactcacaataattgtacttctgcttcctctttgcatgtgttactttaatgggaatgtatatttccttttcgttaaggctgccttcaacaatttgtcataaagtcacttctgttagtgaattctattttttctgttactttactctatccttagtaccaaagagctccttatgtgacaccaatttattactaaaatgtcgctttgtttatgttcttggaattcttcatacattgactatcctcagatgtcgaatgttgtaggcctgtgtggcagggactctcttccatttattctatttttaatctaattcttgacaaaataaacccaatttttcttttcttcccctttccatctcacgtagggactggcataaagggcaatccataaaattacaaatgatgaatttttttggttttaactattattcatacatttaagatatggtcacaatttttatttcttactagtaattcattttattttttaacttttaggttctggggtacacgtgcaggtttgttatataggtacatttgtgtcatgggggtttgttgtacagattatttcatcacccaggtattaagcccagtacccattagttatttttcttgatcctctccctttgctcactttctaccctctggtaagccccagtgtctgttgttcctttctatgaaacacaatggttttaattggaaaatttatttttttttcaggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggtaagtactcctcatgggaaattttaatcagcccagtttccttgatatacatgattaatctagacatgttttgagtaaaaacaactttagtgatgttgagatagtttccttctgttcctagtttttgtcgtgagaaagtgttgaaatttgctaaatactttttctacattaattgagataatcatatttttccctacatcctgttaatgtggtatcttatattaattgattttcatatgtttaacatccttgcattccaggaataactccccaatggccatggtgtataatcttttaaagatgctattgaatttggtttgttaatattttgttgagtatgtttgcatcaatattcataaaacatattgttctgtagtttttctgtactgtttgtctgactttggcatcagggtaatactggcctcatagaatgagttaggaagtaactcttgaatgactattttcatgaagaagcttcaataatctgaaataaaatacttaaataatttagttcacctgagagttgtttttagaagcgtatttatttttctattaatgtcttttttgaactatataagaatgtattctccttccactcacacattgatggcaagtgtgtatttgtactctgtggcctgaaaataagatttttttgaataatcttaagaggccatgctttatactctggtaattgagaattacctatttcacagtagctttttctaaaggttaatttccagagaaaagagaacatgtttattaggatatatctcttaatgaattcagtgtatctgaaatttctaaatgacattttcatattttgcatactaaataaaattcataagtacaaatataatgcaattcataagtacaaatataatgcaatttggatttctagaagttatctagttaaaatatgatcttaggatttattttttttgtcttagatttatgaatcttgcttgtttttctgttaattcatttcttcttgtttgctgcatcagtcagatcagagtagaggcagcttgtatagttgatggcacagtttagggttagatggcacaggatagaaatgggtgctagacaaagagcagtcacagaggcatgttagaaatttccagttccagcatcattgatgaagaaaaccatgaggacccaagttgatcaaaggcagccagccaataaagctatgctcatgcgagatgagctgaagtgacattacattaaaattggaagaccctcttactaagtggctccatgcttccctgctagcccctttgggacttccaagaagacttggttatttcaagaagacaagaacccacagaggctgtagtttagtttatctctctggaaacatagagaatatgtataattaaataaaagcactttaatagtgaatcctttacagtgttatttgaaatttatgtcaagtgatttaaaaagtaaaaatgaaaattaataatttcagtggaagtaaattgattaacatgaccaggaatacataaaacttgcatggtcttgtctataaaataaggatatgtcatttaattaggagagtcaaagctcattcttgcgcttaaggtctgaggaactcttctcccatggggcttatgaagggctacactgaggcaacttcctcaatatatctcagccataaaaccaagagaaagtaagaagcagaggacatcacaacaaagctcaattcagtaaaagcaattttataggagtagagggacttgtcaaaaacaaaaacaacaacaaaaaacaatgtccaaatatttattcagcttaatgagtgatgtttttgtttgatctagggttaaaatctagacaaattacagagatgaataaactacatatcctttagtctaccatcctctgaaaatgttactttttgaaactttgattttgataagagctggaggcactcagggagtcattctctggcatggtctttgagtacagagtgattttgctgattaaaagcaaatagattgacttttaaaatcaactcatacaaacaaactgttaaaatcctctaatgagagtgaagaaacctaaccaagactgactgatacattactgctccatctctgcaccaaagtggactcagggaggcctgtaggagatgccaactccttatcctactccccacaaagacagttcttggctatcttcatcagacacaaatgaatggttgaggctccaaagctctctaccaattcttgtgttacactggcacttttaaaaaattttgtttattttttatttttaaatggagtctcactctgtcaccctggctggagtacagtggcgtgatcttggctcactgcaccctttgcctcccgggtttgagcaattctccctgcctcagcctcccgagtagctgggattacaggcacccgccactacgcctggctaatttttgtattacttagtagagatggggtttcgccatgttggccaggctggtcttgaactcctgagctcaggcaatctgcccaccttggcctcccaaagtgctgggattacaggtgttagccaccgcacctggctggcacttctcttaaaactaatatctcaagaagttttttctttaagaatcttctttcaattgcaggtccatgtagttctggtattcattaaagtgcctatcccaggggttttggtatgttgtgtttcaattttcatgtttcaatttttttgatttatgcattaattttgttttttcagaattcaggtgcaggttgtttagtttccatgtatttgtgtcgttttgagaattcctcttgttcttcatttctaattttatttcattgtgacctcagaagacacttgcattgattttgattttttttatcttattgagatgtgacttacgactatgtggtcaattttagagaatgttccatgtacagatgtgaaaaatgtatattttgtgttgttgggtggaatattctgcagatgtctgtcaggtccatttggtcaagagtctgatttaagtccagtgtatacctttgttagttttctgccatggtgatctgtctggtgctgtgagtggggtgttgaagtcccccactattattgtatagctttttttccccataggtctagtagtatttgttttatgaacctgggtgctccaacattgagtgcatatttatttaggatagttaaatcttctggttgaattgaaccctttatataatgccctcctttgtctctttttgatgttgttggtttaatgtctgtttcttctcatacaagtatagcaacatctgttcttttttaattttctatttgcatgctagatctttctccatcccttcactttgagcccatggttgtcattacatgtgagatgggtctcttgaattcagcagaaggttaggtcatttaaaaaatctaatttgccactttatgtcctttaagtggagcatttaggccatttatgttctaagttaatattgatatttgaggttttgttcctatacatttgatatttgtgtattgttaagtagttgctttctagtttgaattgtgtaattgctctataagatctctgagccttgtacttttgtgtgcttatatggtagcaagtattgttcttttgtttccatgtttagaactccttggagtatttcttgtatggcaggtgtggtggtaacaaattcccttagtgttttcttgcctgggaaagactttatttctccttcatttatgaagcttaatttggcagattatgaaattcttggctggcattttcttttttctttaaggaggctaaaagtaggcccctgatctcttcttgcttgtaaggtttctgctgagaagtcctctattagtctgattggatttcctttataggtaatttggcccttttctctagatgcctttcatattttttctttggtgttgaccttgcatagtctgatggactatattccttggggatggtcatcttgtatcttgcaggtgttttctgaatttcttgtatctggatgttaacctctctggcaagattagggaaattttcctgaattattgcctcaaatatgttttccaatttgcttacttcttcctcttctccatcaagaatgccagtaagtcataggtttggttgctttacataatcccatatttatcaaaggctttgttcatttttcagattctttatgtttgtctaactgggttaatttgaaaaggtggtcttcaagctctgaaatcttgtcttctgcttggtgtagtctgttgttaaaacttccaagtgttgttttgttttgttttgttttgttttgagatggagtctcactctgttgcctaggctggagtgcagtggcatgatcttgactcactgcaacctctgcctcctgggttcaagcgattctcctgcctcaccttctggagtagctgggattacgggcgagtgccaccacccccgactaatttttgtattttttagtagagacaaggttttgccatgttggctgagctggtctcgaactcctgaactcaggtgatttacccatcttggcctcccaaagtgctgtgattacaggtgtgagccaccatgcctggcctgcttccaagtgtattttgatgttccctttagtgaatttttcaattccaaaagttctatttggttttatcttaatatggctatctcatgtttcatatcctgcattgtgtttctggtttatttgaaatggattttaaatttctcttggctctcactgagtttccttgcaatacatattttgtttttttagtctgtcatttcaaagttttcaacttggttaggatccattgctatagagctagtgcaattctttggaggtatgaagacactctttttgtagtgttggagttcttgggcagattccttcttatctgagggagctgttgattcttatttttgaatttcctattggttgggcgggacttaaactttttttttttttccccttgagggtatgactatggtgtatgttgtgtgtgatcattcaactttgtttctgggtgctttcagggggccaaggctctttatggattccttgggcgtggtagctttcttaaatgctgcttattgtagcaatgtattggatttgtgagctgacactctatctcatgtggggctgagggtgcagaagtctcaggaagcttattttgtggagtagtgctaagcctttctggtagtgggctttttatttgatagtacagttcaggctgcaatccagtagatggcacttaaaaaataagaaccagcttgccctcagttaggctgatgtccagtagaagcacctgtcctgacaggggagtgacaggaagagattctgttggtgtgtgccgaggcctttggggtcgctggttggggggagatagggggaggtgcactagctcctcatgcaggaatgtgatctgcttttctatcataccccatcagagggctcatgaccttcagttcataaagattttttccttgggttcccagccatagtctgtctgtaggttatgcatatgcccctctgaaggcaaccaccaaaatggtcttggggcagagcctcttcccccagtctagggcagacaactccatgacttgtatgtcctccattgctgggacactgctgctctgtgtagggatggggagttgggccccaccctttatgtaagcctaagtggcattctcactttcagcaggggtggagccatcttgaaaaccatgaaaaactctttcttcgagtacctgtgctggcccccagtgggaagaaccactgctgcgtcttcaacagcgtgtggggtgggagggtattgccacagatgaccccctctccatatccgttccttgacatggtgttgccccctttagcgattggcactgtgcccacctttcctttgtcccaaaggggttttggcaagttgtgtccctctcccttataggtggcctacactaggggggttagatctctagaggttccatagctccctgggaacttgctggccccctgggcttttcaaagtcagaacaggttatgaggtatgtttgctggggatctggtgctacagagactcaagggtagagaatccctgggcagagcagaggcccaccactggtgcacaagcaatatggtgaccaccatctcagtttgtgtctgaggggagtatgggaacccctgcaggagctggccacccagttctctatccctgggaaattcctaaattaccaccaataacattgccctgggtcacaagggtggggccttgaattctttgggggttgatctctgccagactctagctacttttcctttctgcaccccagcttcttcccatgggcactccaaaaggtcctggctctctttccccagttttccattagaaacttgtccatttgacagtaactttgatcttctttctaagaagagctggcatccaaggtctgtggtcagctatgttggaaaaaagaaggagaaaaaaactagtttgtattaaattctgaaagactagtggcactggttaagtctttaaaggattgttaacaaaagaaaatctttttaaaccaaactcctaattttatcagaattgtaactgaaaatataaatgtatgaaaacataggtattatgtaaaatttgctcaataaaagaataggaaaaactactatttatcttggactgatagcatgttagtttgagatttgaaccctttctactctagtaagtagtggtgggaaaaattcactgtaggagtctgcagacataacaaactatcattagactgccaagacctccacataataaagcaagcagagaatgtcaaataagtatgtgaaaaatgatcaaaaaagagaaattgaaaatataaatagggtgctattaaaaaaggatagcatttatgttatgacatatgtacacatgaatatcactttttagaatttcatccttcttaggacttattcctgagtccgaggattgagaggttctgataaaataagtctcagtgggttccaggcatgggctttctttaaaagtctctccagggattctaatgtgttgccaggaccaagtaccatggacagccaagatctcatcagcacagtttgattgaatgaacttatgtagaaccctgaatgccacacttaaccaaagaaacctttccagggattaattataggtgacagaacatgctatattcttattaaatattattaaaagttaagcaatacccattcctgattcatgtaaaattctcacttattttccaagagttttactgtatgactggtttatgggatgcttggaaaaggttgacagacatggcaaaggttcctgcagtgtttctctttgtccatcaacagccctagctcataacctctaccctttcagctaaaagcaattagctcttcagaagtgattcattctatttatacttgggataagtaacatcaggcagtcttccctagggcttctcacgggccctggtggcatttttattctaagagagggttatatttttacatgtaattggtcataattatactaaaaacaagtaattggtgtcttatacaagaaaattatatttctgctttagtcattgacagagtatcctgagaataagagttaagaagtatattcattgtcatcttatttctgatatatttcaaattcttttgctaggaagaagcccttttgactgtgctttgtgtaacaaaacttcttcggagaaacaatttagataaactttgtcagatcttatgtgattatattcaaaatgctaattgaagattctctaaacattttcagtaaaatgttgaattgttttcatgctgttaaataagttaacatgtcttcctttactaaagtcattattataaaaatgtaaatcctaatgataatagctgatgtttattaagcatttagtaggttccattttttgatagcaacttttatgaattatctcattaaatcttcataataatagcatcaagaactacaaatatgttttcatgtaagaagggaaataaaattatgagttttgctgtgaggtttgaagaatgaaaacaatgcatgacttagaaaatagtataattaagtgaattttattatcattatcatctcttagtttataaatgaaaaaactaaggcttacataatgtaaaaatcagttaacaaggttaaacaaccggtagatggtagaggaggagctgggaataaatctgtacatgtctgaatctggagcaggaacccttaactgatgtgtcattctagcaggtcatcagttactctacaatacctattaagtatactttatttactgtgtttagatttatagtagatttagactctactgtaaaaacaaggacttcatacacctgctagaaagtatccatatcatcttgtttgaaagttgtcccgctctagtgttcttttctaatcatgatgattcagaactccaaactcttgaagcagggcaacccgtagggtcagcattcataatttctcaatacttaaaaaagtttcctcatgactgttgctattattgagatttctcaaatgtcttggcctgaattgggtgtgcactatgaaaaaaaaaatggcagacatttctttttgttaaaggaattttaaaaacacatataaacacactgatttgtgacagattaccaggctttatgtttagcagggtttcctaagcaaaacacaaattctgtaaatctacagaattagataaaacattgactcaatccttagatgagagtataatggattatcacttaataacttctgtcactgaaaataaatgatgtaaaaagtaataaagttctactctcacagtatgaataaataggaaatacataatactttaaattaggcaacaaatcattaagcccccagcattcattagactatcattaatgataataaaattgtgtggtatttatacagatattatatgtaactccaggaattttgttataattgtgtatgaatatatttgttgtttgaggcaggtagatggatatttgcagcagctatgtgctgaagcattctggtaatagttttcaaatcaaccatttttttctccttgtcgatcatctttaaagcaaaagcaccgttttttactatattttttgaaaaaaatacattaggtgtaaaattatatattttgaagaagttcactttctgtttttactagtttcacacctttgttattttttcagtggaaggagcagagataggcaaaggcgaagcctgtgtgtgtggtcaggttcctgggcccttcatagcatctgatgccaagctgtgttctcttttgtgtcattgccttcccacttgctaattacgtgacagagctagggacttccctctgtctagaatgccccccatctcttgtttgcctagtgaaatctggtttgaagttcaaggtctgatacaaaccaggtgatcctctgcaaaactaactgtacctgagcaaaccaggcacttactcttttatatgttcctggcactgctgatactctgatagaaaacatcatcacttaatgctaactgtgggctcacaaaggggatacttctactgtaagaagactgtaactcttcttagcacagagattagtaagtacttgaaacagagtttcacatataataagtgttcaataaattttattttttatttctaacacttggcacactgcatagctcagtaaatgttggtgaagtgaactgagtattctccttatctattatgtggtaggcattattctagttgcttctgttataaaccaactcatttaatccttatcacagcacttttattgtggtcaatattttttaatcctcacagatggctaaggaatcagcactctgagagattggttgacttgctttgggtaaggtgcttataaagtggtagaacaagattcctatccaggccttctgattcaaaaatacattctttttttttttttttttagtagtgttttctggaaaggcagggtataactgactatgctgtgtatttgggactaagtatattattgtcaagtatattaaaaatgtcgcaacactggaaaggagtccatcaatgggctatgcaggttgagggatttgtagatgagaaactgataaatttggttagcaaggaaagccatcaagctgtgaaccctttatattggcaaaagagagggtcctttgaaatctaagggaacagaactttcctgttctccaagtttggagcagaataggtaagctctaggcagtctaatgcccaacttttaccagtggtgttttagttttttttttttttccaaaaggaaatgatggaattctttatatacttctgaattgtctatcttttcaaaaataaaaattttcattttgcagtacatacagaatcaaaagactttcaagtcctaactccacaaatgtttattttgaagctctttaaactgtttaccacggatattagtaaatctgtcagaaatgaggtgacttacttatccttgtcccaccagatatgtgggaaggatgatcacgctagatagcatggatgggtcctctatttatctctttttacttgaatggaaaacacatcattcagattaatcaattagtcattgtgactgatagaatttttatatggataatctgggtttggtccctagctttaccacttacttggggtctttatgtcttctatggtctcctatctgtaaagggaagttgataatgccaatctagctaggttactgagatgcttaaatgtgtaatgtatgcaaagcagcaggtactcaataaagggtaactcttactattattgtatagctctccaggtatgtattgagcttctatagaatccatagccccaaactctttagccctttgagaccaagattaagcattgtctttccagaggagagggtgagagagattgccattatactaatagaattcatcattatcaccgtcatcatcatcatcatgatttcttggtgtgtcatggaatgtactgtgtttcacattaccaacagatgttaattttcacaacatccctgagacaagaaactatgattacattttacagataaggtcatgcagctataaagttgtgaaattgggattcaaactcaggcagtctgtccccacagtccatgttcttaacccaccatgctctcctgacacttgaaaagttaggaggcgtactccatagcctgtaatgttgctgcagagagaatctaattttaaatccagtgaagcatattagttgctgtctttgatatgccattcagattgtgctatccttatgatgcctaccttggttgtatatgtaactgggcgtcaaatatataaatactcaaaaagtgataggtgccaataaaatattttatagttaatacttatgtaatctgtgttctctgtgtttgagggctggttctaaaatactgctctatatttgacttctggttaaaacaataaactttgctcatattagttatatagttgataccattctcatgttgctaacatgtctgtaagtaacagttgaaattgatctggcaattttagagctgtcagacccaggagatgagagaaacatttaaaatgtttataacattaaatcagctgagtcaagagagagaaagagaaagatgattcagatttcttgtactggtggatgtaagtgcttggaactgaaataaaggagaaggtgtagggagggagaaagataaagaagtcttccctttatacaagttgaaattgagttttctttgagatatagaggtgaagacattttaagaaacttcttaaaactctctaatgtggcttttcaacctgtttccatcaatttggcacatctcacttttcggcacaacagaatattctaggtttatctcacaccttccttgccccagcccaggaatcagccatttctctaagaaactcttgtttattttggtggggaacagtattgggaaaccaacatctgggagctaaatatactcctagtggttaggaggtcataccttgtagactcttgtagctgacggagttaggacatatttattagaaatcataagtttatattgatcttgctaggatctatccaatcctacaagattcttccctgtgtctctcctttgtatttgtgtatcctttcttccatattaagaactgtggctcccaacaacaaggcatgtgcccatttgcccaatcgtatgatgtataaaaactactttgagaaaagtggcagccaaaccactaagaaaaataaacttgctgaaatgagttcaagatttattggcagctctttttttggcccctagactgaaagtatatatttcaagtattgtgttcaaaaattatttgggttagctttttccacctttcataatagtaatattatttacttgaaatacagttggctttgtttctatattcagtttttttctctctatcttcattaatttcattatatatatttaatatgtaggacattaacatgtttccaaaagaagaaaacactccttcctgtatcatttccacctcatctctcttaccccttataggtaaccaattgcactggtttctagtttatcttacttatattcctatttgaaaagttacctcatatatgtatgttttttaaatttttatacttttttacacagaaagtaacgttcagtatgtactttgccactttccttttaaacttaacagcgtatactggaaatcactccatatcgtgtcacagagagcttccttatattttttaatagctgtataagacttcattgtgttgtctgtaccatattttattcacttccccatgtgtggacattttgactgtttctagtatctgcaattactaataatgctgcagtaaactttgtgcatatcgtaccttggtaaatttctagacatagatttctgggttaaaggttaagcacatgtgtagttttgttagatattgataaattcctttccatggggtttatatcatttttaaaatatttaccagcaacgtataacagcgtccattacttcaaagcctcaccaacagattgtatgttttaagtacttttatgttttagaatttttccaatgcgataggtaaacaatggtatatcaatatagttttaatacattaaagttcagcatcttttcaagttcggctagtctcagggctattcttaatatcttgtgaattatcttcatattattttcccatattccataatacttttggttttttttcctcctcaattctgacaagttctttatatttcaggaatattagccattttatttgatatgttacaaatatttttctcccaatatataacttttctcttataacgatttttttttcatgaaaagtttttaattaaaaccttttatgggcccaggtgcagtggctcacacctgtaattccagcactttggaaggctgaggtgggcagctcatttaaggccaggagttccagaccagcctgaccaacacagtgaaaccctgtctctactaaaaatagaagaacattagctgggcttggtggcacatgcttgtgatcccagctactcaggaggctgaggcatgagaatcacttgaacccagcaggtggaggttgcagtgagtcaagatcgtgccactgcactccagagtgggcaacagagtgagactctgtctcaaaattaaataaatatataaacaaaaccattatgggccaggtgcagtggctcattcctgtaatctcagcactatgggaggtcaaggtggttgaatcatttgcgccaaggaactggacagaccagcctgggcaacatgggaaaaacctctctctaccaaaaaagaaaaaaaaaaaaattagctgggtgtggtagcatgcaccagtagtcccagttactcgggctggtcacatgagcctggggaggtcaaggctgcagtgagcagtgattgtgccattgcactccagcctaggcaacagagtgagaccatttctctaaatacatacatacatacataccttttgtggagttaaatttacacactttttctttattggctctggcttttgcattgtagtaagactttctttacactcaacttatagataaattcacccatgttttcttctagtacttgcatagttgaattttagatctctagtccatttggagtttattttttgtatggtagaaggtattgatcctattttttcccaaatagttgttacccagttgtcccaaaacaagttattgaaaagtccatctttgtcccagatagactggaacaaaatgaattaaagacttaaatatgaagatttttacttgtgtatcctttcttcctagaaagaaaacataggcgtaaagcttcatgacgttgaatacttcatgccattggtctggcaataatattactattatgaaaggtggaaaaagctaacccaagtaacttttgaacacagtacttgaaatatatactttcagtctaggggccaaaaaaagagctgccaataaatcttgaactcatttcagcaagtttacttttcttagtggtttggctgccacttttctgaaagtagtttttatacatcatacaattgggcaaatgggcagatgccttgttgttgggagccacagttcttaatatggtagaaaggatacaccaatagaaatatttatatttaagtctggcaatcatttttaagatgtgaacttgaacaggcaacaaaagcaaaaataggtacgttggattacatcaaacccaaaagctcttcacagcaaagggaacagtcagttgagtgaagagacaacctatggaatgggagaaaatatttctaagccacacatctgacagagggttaatatccaaggtatataaagaactgcaacaactcaatagcaagaaaacaaataacatgaataaaaaatgagcaaaggatctgaatagacatttctcgaaagaagacataccaatggacaacatgaaaaaatactcagcatcactaacaatcagggaaatgcaaattaaaaccacagtgagatatcgcctcacacttgttagaatggctgttatcagaaagataaaagataagtattggtggggtgtggagaaaaaggaactctagcccactgttagtgacagtgtaaattagtatagctgtgatggaaaagagaatggaggttcctcaaacagtttaaagtagaactaccatatgatccagcaattccacgactgggaatatatccaaaggaaatcagtatattgaagagaactgtattttagtgattattgcagcattgttcccaatagccaagataagggatcaatctgagtatctatcaatggacaagtgataaagaaaatatggtgtgtatacacaatgggataccattcagcctttgaagagaaggaaatcctgtcatttgccacaacgtggttgaacctggaggacattagctgagtgtaataagccagccaccaaaagaaaaataccacatgatctttcctatatgtggaattttaaaagttgaactcaaggaagtagaatagaatggtagtgaccaggggtatgcgataggctgagggatcaaggagatgttggtcacgggatacaggatttcagttagataggaggaagaagttcaagaggtctattgtataccatggtgagtatagttaattataaagtatacttgaaaattgttaagagtagattttctgttcataccacaaaatgataagtatgtgagataatgcatatgtaaattggctcaatttagccatttcacaatgtatatatatttcaaaacaacatgatgtacatgataaatatacagtttatttttaattaaaaattttaaactctctaattggtcttcaacatatagtacacaagtcttttcacgactctttataatggaacatatgttcttggaatgctaaaaattattttttttggaggccctgcaaataactaaaaatttatcttaaaagccacacctaattacttacatatgatccagaaaggatactttgaaaaagctttttaattgataaaatcattaaggtaaaacatattcataaaagtgttctctaataattttataattttctagttcatgaaggattaaatatacaactatcatttgaattggattttttatgaggttaattgtatttaaatgctaattattttaactaattttgtggttgacttctatgtagagtagggaaaaagaatttcctaaagccagttacgtatatctctttttagtctggatttttaattaggaaaagtgatatagttaaataggtctactctatagcatcttctaaaatgagtaaaaattcattatatcaggataaaaaatgataaagatatatggatgacacatttggctgaatttttcttcttcgctgttctcttgctctctatttaaatagtcttagctcttttatcatttaaattctgaagtattgaggtgattattccggcagcaggtgattctgctaattactgttcagtcagttttagctattagaaacagagatatgtttacattgctgggctgcatgtaaatttagaagttacatggctttgtttttactttgacttacggcattaaaattattttcatctgtgtatgtaaagatctgcatctataagcttttgtggataataaggtgaaattgatgcattttaatataaattgccaatataaaatatctctaactcagacctctactggaaagttgtcaaatcttatgtaggaaaggcttttaccatcactgttacacattaactgggcatagtttaatattaatagctcctgagacttgtggttaactgaggtttctatttcctgtgtttgggttttatctttgcaacaacttggttgcttttctgtgtaaaatagtggtgaatatacacaagagtatgacaaggttctgggctcttaactttgatgaacaccatgccatttccatcatgctgcactcaaaacagcacagatgtgagtctgggagtggcgtccctgccgctctcatgagcctttgtttggagaacaccctgattaacccccacccttcacggttcattgactcactgatagatcaagtttaaactagtatatattagcacatttgttaccaacagaggaacagttggccattctgttttacattgctggttcattgcaaactggcgtgctaaaaaggtctgtactctagagtatgaattgggaagttaccaaaggactgagaaccaagtcagttgcatattaatgttgaattatacctatattttaatcttggattgtctacttgggggatgcttacactgttgtcaagttatgaataagtgataattaccactttgaaattcatctttttttttcaaggagtttaggggatttaggtgtctcaatatagctttcatattaaacagtttgtcataattggatgagagcagagcaaggtcatgactacctgatgccttgtgttggagcattttaaaaatgttttccagagagttatttgtacctaatgactttacataagtccttacattatactttatttctaggtcacctaaaaatgttaattgtttagtcaagagggttaggatgtgtgtctgttttctcatgaaaaaaattaagctgttccctttttatcaattttcttgcaatctaaaggcttttttttcttaccttcctaacctagtgactaaggtcatcttattgttacagttcctttcatgggagataggtttactgcatcatttggcagtttcatagggtgaattttgtcttggcttcatctttccttactggttgtcatcccctgggccacctgcttttttgcattttcctttctcttgtgagatgatgaagctctgtgccccgatggggatgagagacagcactctgagttcaagtctaggataaggcaatgggcttgcttttcaaaacaaactagtgtcatacgggctgctgctttcaggtccactgtctgattttatcactgatgacttgtttctggaaggcaaactgatttaagttctgagcaaaagggtcggtgtttattttcaatgctactattaatttagagttttaatttagaaaagattttttaccagttctcaaatatgatttttctattgactttaagtttgtagatataaggagtagacatgagatagagactgaattgcttttttgtttttaaaacttggcagtaataaggggttgcttgttttttcatgctaaatattttttctaagggatctagatacctatcagaaaacttaactttgataactctggttctttattaagtatttttgtcttattttaggaattaatagaaatagttgtaattttagacttcctttataaaataccaatttaaagagaagctttttgcttaaatgattgttttgcagtgttgtgcttttgttttctttaatgcagttgaaatcgcagctttataacttattttttaatttggggtttttaaaagaatattagttatttatttatatttattgggcacctactgtgtgccagacactattctaggaactagtaaacatagcagagagcagaatcatgaagttcttgacctcaaggagcttaaatcctagtggtagagggggaattcaaaaaaatcaaataaatgtatttctattatgtcaagtgatggtatgtactaccaggcaatcagatgaaaatatttcctcttctatacacagtgggcaaggaaggcttcattgactgtggagttttagaagaaagctgaaagtaatggggaaagagagccatatcgatatatgaaggaaaacatggtccaagcagaggaaacgaaaagtgcaaagaattgagcaagaaagtcatgttcaagtggagtcagcaggggaaagagtaggtcacaaatgcggctgagggtgggtcatgaagggccttacaagctttgtatgagtttttacttttattctgaaaaaaacaaaaacaaaaacaaaaaaaaccggggagctatttggggattttaatagaaaagtaacataatttccttttaaaatggatatgtggccactaagtggagagagtggtgtatatatgagtggatggaataattgatacaggcaagcaggagacaggttaaatgaaaaatggattaatccaggcaaaagatggtgacttaaattaagctgggagtgggagagatggtgagacatgcttagactttggattcatttttccagatagaactggctgacagagacatgtcatttaccaacatagacatggcagattttttttttcttttctgagacaaggtcttgctctgttgtccaggctggagtgcaatggtgtgaccatagctcatggaagcctcagactcttgatatcaagtgatcctcccacctcaacctccctagtagttgagattacaggcatatgccactgtatccagccaactttttttttttctgtagagacaatatctctctgtgttgcctagggtagcctttaactcctggcctcaagcattcctcctacctcagcctctcaaagtgctgggattataggagtgagccaccatgcctggccaatatggcggttattaagaggataagtcaaagattacatgaatattctgttatgaaaagtgtcaaacatatagaaaatataaacagtattccagtgggcacccatatttttatcaccttgattctacagatcttaacatttttctgtatctgcttcaaacattttattctgccaatgtgttctaaagtaaattgttgatattgtgatagttctctccaaaatgctgcagtgtgtagctctaaaaatagatatttttcagataaccaaatatcattaacctgccaaatcaatgaatgataattgcttattaacatttaatacttggtccatagtcaaattctccatattttccataatgtcttttatagttaacttttaccaactagtgtctgatcaagaatcattcatttaactaattacatttaaactgtaacattacaacatgttttttcgtatgttttattctctctgacattgacttatggaagagactagattatttgtcctgtagacattttatcatacataagagttactaggagagctctgattactagtccccactctcagaaattttgattcagttgctctttccagtgagctgctggtgatgctggactttcattctgaagaccatactttgagcactactgctgtaccactatccgatggcttctttgtgatatcgtttaacttgttgttctgttgcctgtatttcctctaaactgaattttcaatctaaaggcttactgagattcatgtttgatactttgggcaagaatacttcataagttctagtgcttaatgttaggtagcacttaattctgactatttcactattcatgaggctaagctaaggaggtgacagcctgatccttctattgtaatgtttcatgtgaaactactagataatttgttgagttggggggtgggtagggaagagatatctagttttcaataaatatttcacctaatggttttaacacacattgatcatccttgcctgaactaattatttaattagggatggcaacatggagactttctaattcaatctttttttttttttctaaatgaatggccttgtttttatttttaaatggatgttacttcgcaactggggttatttgattacccagaaatatagcgcatattaaaaaggtaggataaatgcttagttaactaattaagcaatttttaattaccagttttcacagtaaggcactaaagtttctgacttgagcaaagataaagtggaaagataaagtggtcgtttagtgagatgggcaagactgtggataggtagactaggtttggtgggaaagtcagaatatcagttttgaatatgttaagtttgagatgtctattagaaacatatgttgacgaggccaggtgcaatggctcatgcctgtaatctcagtactttaggaggctgaggtgggcggatcacctgaagtcaggagttcaagacgagcctggccaacatgtgaaaccctgtgtttactaaaaatacaaaaattagctgggcttggtggcatgcacctgtaatcccagtaatcccagctacttgggaggctgaggcgggagaatcacttgaacccagggggcggaggttggagtgagccaagatcccgccagccactgcacttcagcctgggtgacagagcgagactccatctcaaaaaaaaaaaacatatatatatatatatatatgttgacaatatttcagttgaataaaataaaatattctagctattttaggtagaaaggcattttataccgatactactactaaagggtaagaagatatgactgtagtacattaaatatgctgatggcctacaactgttgctgtgttgctttttcctcttcaccacacatatgcagcctcatgaaacattttccatgaccagcacactgaaggaaataaaaggaacctagtttagagatggttctgcatgatacaacaaaaatgagctgctaaagcattacaatcccactcaagagtattcccccatcaaatagtggggctggtattttaatcagttgatactaattgtcaaggtgtgatggccaagggattgatgtttatcagtgtatggacagtggttcagagtttggtgaattagtcgagttgaaagagaaagattggtgacaaagatgtatgaggtggaaagtatactttcacagaataagaacagaaaatgagatttatgtttttttgtaaacgttcaacaaagaaaattcattcagaggaggaaataggtaggcaagatgccctattctacagatgttagtcagcatcactgcaaagcaacctcagggcttatgcagtggacacttaaaatagcactggtgcagggatgggagaaataaatggatttaataagcactgctgcttaccaaggttgattgaattgccactattgccaagtgttctacctgcaaacagatcaaccttgagccctggatatggcaccatgtcccagagcaaccagccagccacctggtggcaggttgattgcattggatttgctccattatggaaggtcagtggtttgtcactgctgcgatgaatgcttactgtacgtttggatttgcattccctgcccaccatgtttctgtcagcaataacatggccttattaaagccttattcaataatatgacatcctatataatattgcttttgatcaggagactcattcacatcaaaataagtgaggcaattggctgtcaactacaggattcactggtcttaccatgttcctgttgtagcatattgtattctacctggaagatgaaaccttgtgacattaaagtagtttttagttccataaacataatacaggggtctatgaatcaagaagtggaggtagaagtgttgtcttttacttcacatctaatcacatgttcaaaatattttttcatcttgcctctgcaactttgaactttgctgacacactgaggttttagtgtgaggaaacaatactttcacatgggaacatgatagtcgttcaattgaactggacatttagaataacctggccacattactgaactgtataactgaaacaacaaatgaaaaaaatgaagatgctacgctggcaaagatgattaattttgattattgggagaaatagtattgctactgttaggaggaagactatatgtctagaaactaggaggaaacctgggttgcctccttgtagcagggtaaaatgagtgagtaccttgtctaagaaagggaacatgaccaaactgaacccagaagacataggaaatctaaacagatcaattaacaccaaagaaacgggcattttttggtacttctaaaaaagtaccagactgatattttcacagagatgttcgttatacccttaaggaacaggaacagaaaacttctatactatttaaactattttagaggatagaaaaggaaagaaaactccagattttatttatagaacttgcatgaaattgataccaaattctgacaatgcaagttcaaaaaggaaaactagagatcagtgttacttatgtcaaacagctcttaatagaatagatggatatggttatcaacatgataaatatgtttatcacattttaaagcctacatggagaaacatttgaggttttcttattctagaactgacaggaatgtcctttattatgagcactattagtcaaatttttctggtggaactaatgtaagtagactgctgaagaaaatgaatggtatgaacattggaaaggggaaattaaatgattattatttacagataaaataattgttaagctggaaaatccaagtgaataaagggaaggcctacaattaagcagttaaggaaagggctaggtatagaaatcaatagttttgatatatgcaggctatagccagttaggagatcagttaggggaaaaacacgttgacagcagcaacgaaaagctgataaacctagaattgttcaccacttatcttaaaatgtttaacatggtactgagggacacaggagattatttatgtggaaaaacataccatgtttctatacagaaaaattgaacatcacaaaagtattatttgatcttaagataatttatatttaatgcaatctcagtgaaataccaggagaatgtttttaagctagacaaacttatttcaaagatcatatgtaaaaataagcaaaaatagatgtgaaaaattctttaaagtaatgagagaccagtcttattgactattaagtcattataaaactataatgtttaaaagatggtactgacatatgaatagatcagtggatctcagatgggcagtgcagaaagagatccaaacacatacaaaaatttagtacctctaaaggtggcatttaaaatctgtggggaaagatggattttccaatgaataatgttgggataggtagatagccatctggaaaaaatgaaagtcaaatcccaactttttaccttttatcaaaatgaacttcagatacaattgaaaatataaaattgagaccataaaagtattagaagaaaaatgcagtttttaagtctcaaaaggggactcttaaatatcatacaaagcccagaggccataaaagagatgattgataaattcaaatataggtccgtgtaagcgaaaactttcagtatggagaaaacataagttattaaggcaaatgacacactaggaaaagcatttgtaactcataacaagcctagttttcttactgtgtaaagtactgccataattgacaaagaaaatatgaagaattggcaagtgacatacatagaaagttcatggaaaaaataactcttaaacatttacaaaattttacaacctctcatgaaaagagaaatggaaattgaaattagagtcacatacagtatttcacttttcatttgtcaaagatcaaaaagtttgaacatactgtgggtttatgtttataaggatgtaagaaaacaggcaatctaaattccttgtagagtgtaaattggtagtaataagagaaaaatttactgaatactttgtgccaggtgcttttctaagcactttacatttaattatctcaattaacttatccagaaagtaccattatttctgtattacacgtgaggaatttgaagaaaagttagacaagtaattcaaagtcacacagttaataaatgacagagtgaagatttgagaccatttcctttttctcaagtgtccacttttggtcgcaactctgctgtttctgtagtgagtgatttaacactatatgataaaaccttaagagtacgtactctttgatccagtgattctacttccagaagtttgtccattttgcatcaaatagatggagaatagcattcattgcattgttatttgcagtaaaggaagattggaaacaacctgaacatttatcctcaaggactcatccatacaaaagaattgaagtaaattcatccagatgaatatgaggcagctttagatagagtgagatggcatcctatgtagtgatatggagtcatctttaaaatacagtaaaaggaaaaagcaagatacagaatagcatgtagggaagctgctgtctatgtgaaaagctgtagaatatacgtgcatttttgtatatgcatagaatattcctagacaaggacaaacatggtggttcatacctgtaatcctagcactttgggagactgaggcaggtgattcacttgactccaagttcaggatgagcctggccaacatggcaaaaccccatctctagaaaaaatataaaaattagctgggtctggtggtgtatgcctgtggtcccagctacttgggaggctgaggcaagaggattgcttgagcctgggaggcaaaggttgtagtgagccaagatcatgccactgcactccagcttgggtgacagagcaagacaccattcatctctctatctcttttctctctctctctttctctgtctacacacatacacatacccccccacacacatatatatacacacatatatgtgtgtgtgtatatatatgtgtgtatatatatacgtgtgtgtatatatatgcgtgtatatagatacatttctagaaggattctcaaagtgatatcagtgattgttgtgcaagaaggaaactagatatcagtgaatgcgctaaataaggtgattttgaattctgtagcatgtgtatgatttacctatagagaaagcagtctagcatgagcgtgggtttctcaaatatagaatgtttgcagtgaggtcacttggtgaaaagtatagccatgtcagacagatgtaggttcagattccaggacttccaggactgctgaaagggaaaggggctttggatctccttcagctccaggcagcattgctcctttcccagctttgacattagctggagggaagacaagttcttagagctctatgtgcttgggacaagaccccttccccctactgccttactcgccaaccataactgctgcaaacaattcttacctcttccaccccatgtcactgcctaaaacccttcatcacctggcctcccatgcctctaagtctctgtacatcccctagcctgatactgtccccaaccctcctcaactccagacaccattttactctaccctctggaattgtccattattagcaaaatctcctttattttcaacctcctttctaagtatttcccccacattcttgttgtaatagagacacagctttcccaggactgtatagctttccttgcagtcctctaaagtggtaactggtttctctgccatacatttcataccactggtcctggagatattgtcaatatcttaatgtcttccttccatctcacttaaattttgagaccataattcctttttcctctcttaaaagttctcagtgttgaagctcaatccattagatacctctagctggcactactagttgcagtcctgtgcagactactgagtcattttctttactccctgaagacttaaactctatcttactctcactctctctgacattactcctattaaaatgttatgtttctttagctattctttcagtttttggtctcctctccttcaacgaggatgatttctagaatgttggttctcaaaatgtggcccctttgcagacatcgtcagcacctgggaacctgttataaatatgaatctgcagaccacaccccagactactaagcccaaaattctgggggctggagcccagaatctatgttttaagaagcacgtcaggtaattctgatgaatatgccagttccttagatcttgttattgtcattactgacaactttctctgagaccacaatttgaatctaccaatttttcactagtactcacccatcttaagtccttactttccccttaccagccagacatttgaatattccttgactcttctctttcacatactatatccaaagagtcaacaaatgctgtcagctataccttcaaaatacatgtagaatctaacttttaacctccactgcagtcacttcagtccaagcacaaccatttcccacctggagtattgcaactgttcttgtttggtggcccttggccctactttatctactttccgcaaagcagccagagtgtttctttcaacacctaaggttatatggcttcattgattgaaattcaccgtgcttcacctctttctctacaaaagccaaagtccttgtaaatgcctgtaaggctcgagggtgatctgaccttccctggcctgtcgtgtttcggtaaaagtaagctgagtctttcatagttaaaggacagcaatattgtcctgcatgatattttaaaaacccaatcaagaatcacacattgcatttaattttcatgcctttagtctccattaaaagtgtgccctttgtattaataattggagtgatgagggacagagtttaagaatatataaatattttgtccccaactgactgtcactggatggctttggcacccattggtgattcttacctgaatcagtaattattgtgatgactgaaaatagtgatttttctcactgtataattcttctatatttattaattaccttaatattatcctatagaacagaatgttcccttctcatcttttgtttgtttagtgtcagtattactcatgaagttgggtgtttagaaaattcaatgttgtataatactgttattattcaatattgtattttctcagtttgagtcttccatctgcgtcctttcatgtaaatagtataaagatcagtaatagaggaacatagagtaaagtgtgagcagagaagccttactctgagacaaacttcagagaggtgaactctgttgctgattaagaaaggcttcactgaggaagtgttgtttgaagtgagctttgaaaagtcataaaattttgacaaaagtggggatggggtggagcttaaaggaaaaactgtctgaacaaaggaaggcccggcagactaggaatttggcaataatacagtggttttggaccttgatgaggaagttgaaatggaacataaaaaccctctgcatttagctccatttatttgctcaggcagctctcactgcctaaaattttcacccctgctgttttgctcaggggtgggatgaggggtaatgagggaggaaattttagggggtgaaaacagcacaagccaaaaaccctgctcagatactcccttctcttgaagccttttccagatccctaataagaattaaccaccctctctcacacactctgttgtactttgtccttctctgttaaccagcctctgtgttttgtgctgtctgtatttgtggatacatcttcctcctttaaagcacgaatcatatcttaatcccttggcccttcttcccagtacttagcacaagtgctcaatacatgtttctttaacgcgtgtaacagaggaaggcgaggagagtgagtgggattgggagcaggaggattctgaatgtcattttaaggggtttgggctcgctcttcaggcagcaatgagccatagccgcctttgaactgtgcagcactgaccagagctgtgatgccaaaggatgcagtggaaggggaggacagccagcatgcctgggcatggtccccaagtcagaggacatcagtgggagaagggagaaggcatggaagcaagtggctaccatcttatgaatctgagcactcattcaaaggtggcaaggaaaaaggaaggcattgagcacggttttgaggtttccagcctgggtgattggaggctgatgcaggcttcttaccaaaaagggccctaggcagtttcaccaggaatgtttaaggagtttatcatgaccctatctcttcctcgtctaaaactctccctaaaatcaaaacagtatgtcctgttgaaatactttattgtatcaaatataatgagaagtaaaatattctctctacttgatgtatgaaacactgacttcttgtagtggacaattttcacttgtctttttagtaatggtttttattaaaaatagatgttaataactgcttgtttaatctttaaacgtggccctctgagagcagcttaccgtaaaagaaacggttgtcagctttctttttgctcctcagtccctcctgccccttcctaacaacagaaaatttgctttgcacctgctccaactgggttcgaagagataagcatcttgcaagcccagaaaattgtagtatcaaatctcagccccaactgtgaggcagcactatcattgaatccctgctgagaggcgttgctttcccaattcccaaaagagttctttctcccctggccccttttcaggcttgaactctgaccgaaaccctctttttaactcccagcatgcactgcacttggtactgacactgacccatccctgcttcctctgttctgcactggactcatcagtaggtcaggcgttggtagccctggggtcactggggtgcccaattccaataatgagcacatttagctaaggagaggaaatgtacccttctatttgttacagtccattgctttttttccagaaacaaatgctaaaagaacatttgatatattgtggtttggtaaatacacatagcactgcctaatattcacaaagttgcctcttttttttgcatcttccttcataaattaaatatattgttctaactcatgatttattttaagagggatatacctatttcacagctaggaaaatgttttcaaataaagttatattcagaatactcttgcaagaatttcaaataaaaatagcaaatactatttaaatgcatataacattctaacagacttgtgtgtcattttaaagggaaagaaaaaaaatgatgacaaggactttacaactttgtctttaaaatttcttcttaggctttccaaacagaccgaagtcattaaaaatactccttaacccccaaagtcacaaaaaagaagctacccaggtttattatgagaaggttgaacctctgttgaagcttgcaggaataaaaactgatgtaacaagtaagtaattttcagaatataatttcaccatctacaaaaacatacaaaagcaaaataatctgaatttgtccttaatgcaaacttgggaaactacttgtaatatctatagcatttttacgtcttcataacctactgcagccagctcgagggttataatttaattatttttgttatttttattagaatattaatattttctctttagaattttttcagatattttttcagacttaaacaattgttagatataattacaaaggaagctgtatacttgtttacatcttcatggagatgtttgctacttacacgttaattttgcagttaggcaagaaattgattttttgctcacttatatagttgatgtctttccatggaattcttccttgggttgttttcgttctgactctgacccctggtggttaggtcaaaactaagcactgaactgctggttttattaatagatgaatttagagatgctagaagcttaaatttgttgtctaaactaagaaatgtacttaggtttgtgccaaggaaaatagaaacttgttaatgctaaacttaatagatgattagtaatatcctttttgatttttttaatttggtagtcacatttctttgtttctttgagacttattttcgtatggtggggaactgagtagaagagtcgatgctatggagaatcgcaaccttcctagctttatttctatgtggcttcgctaacagtggaaatttgcaataaattttaattgatgaaaagtattataaaataagcctactcaggggacaagcccagagtgcaattggaacttcctagtcccagttatagattcctagggaagggattcacagtgatgtggctttactcagctgtaaacaaaggagataagtttcaagatgttaataatatcattgaaacctacacctagtgatctgatggattgaggtagaagaaagttcaaaaaaaaaaaaaaagcaagttttgtaggaaggtcagcccccatgaaatgtgcctataactatagaggttcgagagaaactaccatgaaaaactcaagaggaatttttgaattaaaataaagttatagtgaagaagttaacctttatgtttgtgaccttcggcttatttagaggtgatttacaagtaaaagagaaaattcagatttatgttttctttctactgaagatttccaaagattggctgaaggaaaagtttgagatttgtattagggtgagacaattaaaagttgaataaacatattggcatactcaatgactattttgttcattgcttttacatgtgaatactacaaagcagcttaacatggatattgctatatagcattcacttcaggaatctcattgtatgcttgctctgtgttcaacatagtgcaggatgcgagatgaataagctatcatacttggatgactttctacattattagagattcaaaaaaatgcttaaaaccattataactggggtatacataaaagaactttgatgtctcagaggtgatattttgatcggaagattcaagaaaagcatttgaactaggcagtttttaagaggcagacaaaaaatgagggaaggaagtcaggctaacaggcatgtactgtaaaagttgggagggggggcggagagagagagtgtgtgtatgtgagagagtccatgtgtgttacacccatacatctggagagtttgtgccataactttgctctactttcctcagtttttacattatctgaaatcttactctatcatcataaaatagctgccagtgaatttcatcctttcttattaatatccagtgggatggggagaggtgtgcatatgtgtgcaagagagacccaacatgctttaatcctgaagatgaattaaaatttccttttttaagtttgggcacagatactgtattagcgcagtcaatctggaataatcatttatttaaccatcaagactcttcccaggggctgaggacagatccccttttcctgatgactgaaatgcctcagctgaatctggattctgttagggagaagaaagggcaaaatgacttctaggaaggctctcaacaatgtatactacaggaggtataattccaggttatggatggatccttaagctgcactcagcagtttactcatcgtgtattgatccacagttggtgtaaatttttttttatcatactgttgcaatctggtttggcaaagatgactccaccagcagaattaaaattaaaaaggaagagagaaaaagagattggagacaagaaaactgatatacaaggcctgaactaaggcagaggaaatcatctaaatgtgctttccttcttaattgtattggagacaaaactattatgttctaggatttttttctctaaatttgtaaatattactaagtaccatatttaaacataaaacaatagaatattccgtaaagcaaatttagaatttacttacatttgtgcagaatggctaattattagctgcctaacactcctcctacaggcaaatttataaaattacatcatttgcttataaaaccattttagtatgcatattggctcaatatttatgaaaaatatttcttgaataaacctgtgaatatttgaaaagttttagtcttcctgcctatcttacagtgttatttttgtagttgaaataatatatttgaaactttgtatattatactacagaaaggtggtcataatactgttagtttcagtttcaaaaattatgtcatagtaagatcgaattcgtactttatttgaaagtatatggaagagtaaagcagaaagaggacatatcttctgcatgtccagtgggacattgttttaatgtatccttgtgtgaatgggtgagtccaaatggaattggaattacaaaataaaccctatatgatgagttaattaggaaatagtgctatataaatatgaagtataatatgaagaattacagctagatatatacactataaggtactgtaattttttcataaatttattttaaaaatggatcttaccacattaataaaaacacacttctttcattttgggttgtgctgaaatcctaactacttctgaatatagatcagcatcttttgaaatatttgtgctaaagttgcatccccactctgctaccaccaccaaggtagtatcttatctaatagcatcagaaaaacttccgggagaacctggaaagaattattttttcctaattacctattcgtacacaaatcaaagaagagtatgaacgataagcccatgctggcatatgatatcatttctcttgcttctgaaacaaagcaagttttagagattgtaccattaaaggtgtgacagatattttgaggatcagagatccataggataattcatagtacaatagagtgaaaaagttaaggcagcagagaaatcagactgaaaagaactttcgaggccatatggttcaatttttctccttgtgggtggagcacaggtgtgtggcactcaactttggcttggccacctacactagaggcagagtacgttgttactggacaatactgtttgacattcttatgaatgttcagagttactgtacctttgggcagattagaaaaggcacctcctctgtgctgacttacaaaaaggtgccctttcttccagactaattcatcctttgcttataaaaccatttcagtatgcatattggctcaatatttatgaaaaaaatatttcatactttcaaaatattcatatttcaaaaatattcagcccaaggtcactagattcagcctaaagtcatttgttagattgcaaatccgtcattcccgttagccaagtacctttgtgctaggcataaactgtacaaaatgagaacttgtcagctgacattcgcctctttgtaatttttatgtactagagttaatgttatctcttgtagtaatatgaaataaatgtgccccatctattgtataggagtcattgagatatttgaagagagatatcctgtctgcccctcatctcttgttcacgataggtacttccatcgccttcagttactttttgcattaacagagctgctagaccttatcatggtcattatcattatcatactcaaagacatttatctgaaggaaaccttgatctctgccagctcagggctcttgggagtgcctagtcaccagataattttacctcctgggcagagttgtcaagaaagtggtgtttgttatcattttccccttctttctcctaaaatcacgcttctaacatggctgttaacaagcctcttcatagtgtttctctggttgtttatggctctacttgaagccttccatttcttggaaatgcctcttgcctttctaaatctcacccagcagaaagctaggccatctaatgaaactgtgtcacaaaagattccagtagcctgaggcatcactccttccaattttacctgcattttaatacaaaatctgaaaagtaaatgttcatgcatcatatctagctagagagaaagataattctgtgtaaaagattctttttgttacctcttaaataattgtgggtgtatatggccagtcctgttcccagcattcagatgtgagttaggaagttggaactttatacctggggacgatgaagactcactaatggggtatatacaaaaaagtgatatgattaaatatgtatctgaaaatggttattctggctagagtgggggagaggtttgagggagacaagataaaaggctattgtagtacaggtggagtatcccttatctgaaaggcttgggaccagaactgttacagatttaggatgtttttagcttttggaatatttgcattatacttaaccacttcagcatctctctaatttgaaaatcatggacacaggaaggggaatatcacactctggggacagttgtggggtggtgggaggggggagggatagcatcgggagatatacctaatgctagatgacgagttagtgggtgcagcgcaccagcatggcacatgtatacatatgtaactaacctgcacaatgtgcacatgtaccctaaaacttaaaagtataataaaaaaaaattaaaaaaaaaaaaaaagaaaatactccaatgagcatttactttgaacgccatgtcattgctccaaaatttttagatgttgaagcgttttggattttagatattctggttacagatacttaacttgtctacacatgaaagatatttagtgatcagatcaatcagctaatttagggaattagctgggagaaatggaggaatgctatggcataatttaaagacagaaacaactggccttggccatggagtggttctggagagtggaggaaagggacactctagaaagaagtcattttcctgtcttggggtagatgatggaacacaaaaagaacaatatatttgagagagaatatatttgaaggtatacataatggattctgttttgagcttactaactttaaagtacctacaggacaggaaagaaaatgacatttcagtatcatatcccacactagaattttatcaccaaaccaagaaatgtttccttatgtccaaatcaaatctcacctgattttatttcaggtgattttctcatcaacattgaatatcaaccttaagactttcttgtcttcctgaggaagttgcatttgcaccaaagaggggagggggaaattcccagcagtgagaattgtgttcaaagacctgtaaactgtgaaggcttcacatctcctatttagaaagagcacaggttggcaatctcataggaaaaggcaaatagatgaaagaagaggctgggttacattttttgaaattacatttatctagcaatcctttctttgtttgtttgtagggggatgatttgaatctggctgtcactgattccagggcccacaatagcctgtctaaatacatatttggtcctttctactatatttaaatagtaatccagatcactctttatccttttgcctaacattgttttgtataaccacctattacttcatattataattcattatttcattagcatatattgtctatctccagaatgcaaattcctgaggccaaagactaattcattttgttcattttgctaatatattttatagatgtagatagtcaggttcttttcattttgtttctttgttctagatctttgattttattggacttttgcaatgttacttaaaaaattgctattttcaggcaggttgcattagtgtataatcaaattccacccacaatatcaaaaaaagactattacaaattaaaaaaataaaaatagcattcaataataacacagttctaaagctcattattggatctgaaaaactttaccaatgtaagctttggtataaaagtaaggcttggtgaactgattcttagcataaatattttttcatgatattcttatttttaatgtgtatatgtaagatgttttattttgcattttaaggttgtaagtacttgctgtagttataaatgaatgatcagcacacatcttctttgataacctttcaactttattaatattaatgtttcatatgtagttttattatggctttcttctgattggaatttaatatagagaggttttattcatgtgagtgttaatggcattttgaataagctatgggagaattacaatgtaacactgctggatacagaatgattcttttagacaccaagactaataatttttaacaatatcgaaaaacattgtaggaaaagcttgaaccatgctggcaccagggacagacaagcatgaaagattaatgtaatcttgcatataatgacacacattcttacacaaaaaatccatctgcaatgtcatgtcagtcagcagaaatctttgatgggtggatacagctgggctgtctcttctggcagagctgccctggaaaatgctaaatgtggttgtgatgcttggtgccatctgcagtgtgcccgtttatcctgtcttcactggcatttacgatactgcatagggcatcagtgactgtggagacagcgatacagagtgacagattcatttcctcggagggtctgagctctggtgggcctgtgtgccaccctccttcttgggtctgggtctcttataattggtgttggctttactttgtattttcacatccaactcttcctctttttagtctaacagttccagtacacattcttctggtttgtaaatcttacactaaccttttgactaatttattcatgtaaggttgccaaaccgatttaagattgactgttcaatgccagctaatatgccttatttccaaaatactgctcctcctaagcctctgatttaaaggacatgtgtcttatttagggaatactaaacaggcaccaggacaaattgggtaaccactatgcgtgggatattcccaaatgactttatgtagttgaaacaaatatatgaccttctcttacataaagctataaaacatcaggccagtaacacttagtcctcttgcccatgattaaaatataaatattcaagaataaatgctgttttatgacttgaccatatgtttatcatattattttgccagaacaagttaaaaagtgtgatcattgtttaaaactgtcactttgtgtatgtgtgtgtgtttttttaatagtaatggaatatgaagggcacgctctgtcactgcttaaggaatgtgaactccagggatttgatgggtaggttatattattaatcaatatatgttatatcatttatgtattaaatgccttcactagttttagctacatatttggaacctaacatttaaaaatatttgtagtgtatgtactttggctctatcttgttcatatctatgtaataataattaatgataatatgacatggtcatctatctctcaggatctggcataggaaagcaaaaagaggaatctaattattaaaatactgggaaatgacagtgtactactctatacttactaatgtgcatacatttgcatctataattatttgcttttaccatatatctagagaagcactaatggaagatgttatactggtcacatggcataactatatgatgatcttcttttgcaaattaattgataggtttaatagctacccattggttaacttgtctgtgatagattgagggaagatattttataaatacaagtaaataaatacattatttccagaaacaataagaaataattttaattatctcataatgtagtgactacaatttaggtatgttattcacagtgggcatcggaaaccattgttcgcaatacattggagtgtacagagattgttcactggcatgcaaacgttagaaccaaggcaagtgatataaatttcattgccattttttaaaattaggtgaaccaatttgctaaagtgttggactgatgtgtaagactaaaacatattatattcctttagggaagttctttttacgtgagtagatatttgagaatttaaaaagttgacaagtgtgtgaattatttgtgttacatggtgatgggcagggggcaaagacccataaggtcaggaaagggagttaggtctgtactttcaccaaagtgaaaggcattaaccttcccaaagactgatttgaatgtgctggggagggaagtgatgcaatcaaaatggagtattggcagggctgtttttcagaaatgcttatttatttatttattttttggatgaggagaaaacaatagctgttgagaaagaaaatgtggtaagtaaaacatgatttttccaaaaggaatctaattgagggaagtaaatctagatagcaatattatataaacattgggaatcaaaaatatggggtaggagattacttcagaactttatacttagaggtagacaaaaacattaataggcttcatttagaaaattgtcttacaagtatacaatttaagaaaagtccttgtgggaatcatgcataccaactacctatttgaatatgctgcatagtccctcactagacctcatgagtacatgaaggtagctgcattgcaaatgagtacctgcttcaaaacttgattaaagaatgagaataaagatatcacagatattaaacttgttcttacacagcagcattacagaatgttctgctgaatgcagtatctatcaatatgttttactggtatttgtactgggtaaagggatgaaaagaactttgcagaatgaagaaagacgattgctgaagtgtagtacaataatatttttctctttacctgaacatatttaatccttatttatttttcatggcaggtgttgttatttttcagtgtagagctaaaagatgtatagatttttcagttattatattttataaaccaaatagtttggcctaaccattatatgaattgagttatgtaagtgtttctaaactctatggcatgctgatttatttcagacttacaataatttcaaatttctactgaaagtcatcttccgtgttctaagactctttaaatcaggggtccccaactccgagactgcagatgaatatcagtcagtggccttttaggaactgggaggcacagtaggaggtgagtggcaggagagggatcatttccgcctgagctccacctcctgtcaggtcagcagcagcattagattctcacaggagtgcgaaccctattgtgaactgggcacgcgagggatataactggtcatgcgagggatctaggttgcgtgctcttgatgagaatctaatgcttgatgatctgaggtggaacagtttcatcctgaaaccatccgtctcccaccccaccctgcagtccatggaaaaattatcttcccacaaaaaagtccttggtaccaaaaaggttggggaccactttaaatagcttatttatttttgtggggtcagttttcccagtagaagctgatatggtagttggagtaattatcttaataaactggcaattttaagtcactgtacttagaattacatagagagatatatgaggagaataatagaaacatagtttcttcaggtacttcaaaggaacaattctcttgcaagtaaaattgtttgaaaatggaatattctacattggtgagttttctattcctgaacctgttctaaagagtggctaaaggaaaattttgggggaaatttatagaaaaggtgcagagatgagagaaggttaaccccaaaatgctatggcattttgatgagagacagactcaaatttctttaagaactttggcctgaagcacctccgtctgacactagtggaactattaatagggagtgattaggaaatcacctaacagtttggtttctagatacaggctgaagaagttaagagccaagaaagattctatgtatagtatttagtaaagcaaaacaatttggtaagtaatgtttaagaaatgctatttcctaagattttggagttgtatttattttttttaatgaattacatatgtttctatgagacatcttgtgacatttctaaacccaacagaaacagtgtatcagcacttatgacagctagttctccactgcagtgtgtcctaggaaacactctaagatccactgttaaaccttatgagagcttcagattctatattgctccctattttactgggcatgagtaggaagttttaggaaggaaaataaaagaatatcagctgcatagacttgaagcagtaacacttgcatttataagtgtgagtatagttttaaaaatctatagattttatgcaattgtaaatatatgaattcctcgctattaatatttgtttcagaatttttaaaaaaattgttgagttacttttcttttgttcatttcaccattaattagacccataatgttgtagacattatttggattatattgacattttatcagattgaacatatctgtattacttagtaaggtaaaaagcaaaaacaaaaacaaacttttccagaaagaaaaaaaactgtgaatcaaaactacaacaatatattgaacatttcatagatgatgggttcatagataagtataaaaacattcattaaaaaaatctttatcactctttgaaaaaggatatattatcacccagtgtttcttttctagacagaataattctgtttggagccatggcaaggagtttacttattttaaaaacaagatttgtcacatgcaaaggattagttactctaaggtttatgttttagagtgacacaagtgtgattaactcactataaatgattgaatactttgctttttgcctttcttgtatatttagactcttgtgatatttttgtaagaagctgttgatgaaaaaaaccaaactgtaaaatatttaaagaggtttattttgagccaaatatgagtgctcatggcctatgataaccccaggggggtcctgagaacatgtgcccacagtagttgggttacaacttggttttatacattttggggatacagaagttatagccaaagacataaatcgataaatgtagggtattcattggtttggcccagagaggcgggatatcatggagctggtgggaaggggagctcacagatgaattcaatgattttctgattgtcagttggttgataagctttgctgaaagattagaagtcagcagaaagaaatgcttgagttaagataaatggggtggtgtaggctgggtgcagtggcttagcagtggctcacacctgtaatcccagctctttagaaggctgaagaggggagatcacctgaggtcaggagtttgagatcagcctggccaacatggcaaaaccccatctctagtaaaaatgcaaaaattagccgggtgtgatggtgtgtgcctgtagtctcagctacttgggaggctgaagcaggagaatcacttgaacccaggagggagaggttgcagtgagctgagatcacaccattgttctccagcctgggcaacagagcgagactctgtctcaaaaataaaataaaataaaataaaaaattataaaaataaagataaatgaagttgtggaagcacaggttcttgttatgtagatgaagcctccagatatcaggcttcagagagaatagatggtcaatatctcttatcagaccttaaaaggtatcaaactcttagttaaatctctcctggatcaggaaaagacctggaaagggaaggagattctctatagaatgcaaatttctcctgcaaatgatagctttgcagggccatttcaaaatatgtcaacaaaatacattttgggataaaatactttgatttcctctagggcctgctatttgttatttaatgctataccagagtcaggttggagttggggatcttattgctaccaagtctgttttgtcagtcttatgatctattttttttttttttttgagataaattctcaccctgtcacccaggctggagtgcagtggtgcaatctcagctcagtgcaacctctgtctcccaggttcaagcaattctcctgccccagcctcctgagtagctgggattacaggcatgcaccaccatgctcagctaattttttgtttctttaatagagatggggtttcaccatgttggccaggatgatcttgaactcctgacctcgtgatccacccttggcctcccaaagtgctggaattgcatgcatgagcctggccaatgatttacatcttaatgccagtgctggccatttgcgcctaaactccaaaagacaagagggtataaggaggcatatccaacctcccttcctgttatgacctgaatagtttttcagattttctttgtgaccttcatggccaaaaggggaggatccattcagttagttggcgacttagaattttatttttgttttacaaaacttatttcctaggttgagtcactttacctgaacatgatcttaatgattgaatagttgttaacataaataaatacatattttttctaactcacttaatttcacactggttctactggtaaactgtttttcaaaataataagattctcataaggctatttttattaggtttcatatatagaaaaggtatctaatatattgaataatattgtagcttctaagaccaaaatgtcttatttcaaatccctgttctattacttactagtggtacaatcttgaaaaagttactttatctttctatgttttagtttcctaatctgcaaattgaaggtaatattacctattgcatacagttatttctccacttaaatgagttaatacatggagagtgcttaggaaaatgtctgatatatatatatagtaattattcactaaatatttctttattgttataattgtcatttgtattagtttcaaaagatttaacacagaatgtattatgacaaaatttcagatgtttcagaacatgctcatagggaggccacctctaataactctagcaatatgttaacatatgcatgacgctataattgtatgcaacattctaggagttaagtgttcgcatcctatgtatgtaagggtcaagttatttggtgctaaattagatttttttgggtatgactccacatagtctttttggtcacacccatatgtcagcatttagacagccatggattgagggttacgtttaagttcacagattagaaatctcatagagatttttgaaatcaggtaagtttcaagtcaaaccttggtttttttcattcataaagatgggactgtggcctattttgcagacttctgaggatttaatagaaattagtaaacacattacctgatatatagtttgtccttagtaaacatcattccttttctctgaataggtggtcatattgcgaacctctggaatcagtttagacataagaataaaacacacctaatcaaacatgacctgggtcatatcttgagtcttctaaccagagtagccttggattgcccaggctatgtggagctagtgggatgaggaagatggggactagagggaatagatggccgagagaaagatggtgggaactgactggaaagacactttcagcctttggtcaccaccctccagagcttcctaaacttagagaaccagtaactactgctgactgtggcccatagacagttttgtttgaaatagtgtttttaaatatattgaatgctagttgcttagtatttacaaattaggagactcagccttaaatcagaatctctggcttctgtagaaaaaccagatctgggtccattaggcctcacacgtgatgtgagtgggccacagcaaagaagtggctgcgcctttagattgagcctactcttccattcctgctgggcccttgtagcccttgagttgtgacacctgctttcactgaggcaaaatccactttccattgggttaactggtgacattttgatacgtaagaatattttgcttcttttgaacataaatgattatgaaatgaatttctggtacttctgtgttattttaatggattctgcccccatagtctacttgatataaagtcttaaaaaatatactagtagtactatctaggatcaaaggctaatagtattacatctagaagcaccgtatagcaataatgtcaaggagatgaaattcaggtcaggtttgtaattactacattcatatagtaatgataattagcagtttcttaaagcttcatattttatatgatttttattgctatctgtcttttcagagctttattgagaattagcaggattttatgactttggttggtgttagttaaatgaattgcagatgacagtattattaacaagaaatgagaatgatatgcttttggatgttaacagagcaaaacgctggtcagatgtgaattaacatgttcaaaagttttcatatctcttaacacacttaaagctattttgtctatggggaattatctagttattatatttgtgaagtaaacttacctgtgttgtgtttgtgttgtcttacccattgacacatattaacatgtttaaaggtacatgtgagcagttatgcacatagactacaaattagtaaactattttgaagtctagatttcatgacttattaccaatcattctgaagttttgccttctttgcttgatttgtatttttctagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggcaagggagtggctacagattcattaaactgacccttctccctcttttcctttcttacttgctaatctagacagcacaacacagaattaatgaacagactttgaaagatccagacttctggcatccccactagcaaatgtgagacttttgacaagtcatttaatctctttgagccttatttttctaatctatagaatagggatcacagatatattattcactttattacaaggttattgtagtactaacgtttggtttagtaaagggtttaatatatagttaaaccatcagtatatggaatggttattattctcccttcgcataaaaaatctgttgattacacagtaccaggtaagaagtttcaaaacagggccactccagtctagctgcttacaattccatatgaggtgaatatggtaacttgcataattgatgtataaccagataaccttgagaatgccaaaattacttgtgactggaagggaggataaggtttggaagggtgagattcttaagggcaaggctttttaatctttctactcactgccatttttcagcatctagaatagactatgccacagtgatgctcagtgaagcctattaagtgaatgcatgtaaagaagactttatatagtaaatgacacttggattaggtcttaaaatgggttggagctggcctgaaaaggtgagaatgagttattttcttggctgcaaaagtaataaagcaaaggcaaaacccaggagtgtttgaggaatagtgaaaaggccattcagtggaagataatggtatcaaaataggcccaaccatggaggctcctacatgccacagtaaggtctctgaattgtatttgataagcagtagggaataatgggatgtttcagagcaagggggcaacctgattggagcttgttccaggaggattcattttgcctcaccgtgtggaatgattagaggttgggagcaggagaaagtagaggtcagagacacggagaaccgttagagcaacactgtgatccagaaaagagggaaacatcattcaaaagctgattgtattacacaatcactcatccctatttaacgaacggtgctgggaaaactggctagccatatgcagaaagctgaaacaggatcccttccttacaccttacacaaaaattaattcaagatggattaaagacttaaacattagacttaaaaccataaaaaccctagaagaaaacctaggcaataccattcaggacataggcatgggcaaggacttcgtgtctaaaacaccaaaagcaatggcaacaaaagccaaaattgacaaatgggatctaattaaactcaagagcttctgcacagcaaaagaaactaccatcagagtgaacaggcaacctacagaaagggagaaaatttttgcaatctactcatctaacaaagggctaatatcctgaatctacaaagaactcaaaagaatttacaagaaaaaaacaaccccatcaacaagtgggcgaaggatatgaacagacacttctcaaaagaagacatttatgcagccaaaagacacatgaaaaaatgctcatcatcactggccatcagagaaatgcaaatcaaaaccacaatgagatatcatctcaccccaggtagaatggtgatcattaaaaagtcaggaaacaacaggtgctggagaggatgtggagaaataggaacacttttacactattggtgggactgtaaactagttcaaccattgtggaagacagtgtggcaattcctcagggatctagaactagaaataccatttgatccagccatcccattactgggtatatacccaaaggaatataaatcatactgctataaaggcacatacacacatatgtttattgtggcactactcacaatagcaaagacttggaaccaacctaaatgtccaacaatgatagactggattaagaaaatgtggcatatatacaccatggaatactatgcagccataaaaaatgatgagttcatatcctttgtagggacatggatgaagctggaaaccatcattctcagcaaaccatcacaaggacaaaaaacgaaacaccgcatgttctcactcataggtgggaaatgaacaatgagaacacttggacacaggaaggggaacatcacacactggggcctgttgtggggtgggggaaggtggggagggataacattaggagaaatacctaatgtaaatgacgagttaatgggtgcagcacaccaacatggcacatgtatacatatgtaacaaacctgcacattgtgcacatgtaccctagaatttaaagtattatatatatatataatatacagccttatgaacatatatatatataaaggaaaattaggcaaaatagcattacttgaggtactcaatagcctggcagagcagacattaagggtaagagagactggacttgaatttcagtttggtacttgactttgggtgggtaattagcctttattagtcttgattacacatttaaaaggtttaataaggccgggtgcagtggcttatacctgtaatcccagcactttgggaggccgaggtagtggatcacctgaggtcaggagttgaagaccagcctggccaacatggtgaaaccctatctctactaaaaatacaaaaatgagctgggcatggtggtgtgcgcctgtgatcccagctactggggaagctggggcagaagaataacttgaacctgggaggcagaggttgcagtgagctgagattgtgccactgtactccagcctgggcgacagagcgaggctgtctcaaaaaaaaaaaaaaaaaaaagtttaataatgtccatccccatagggccattacaagaatcaacttttaaaaagtcacacattatcactaaaaaagcaaaatatttttccctatgattatagaaaataatgcacattgttgaaaaaaattcatattttgataaccctattcatttagtatggattttagaatacttagtattgttgataagttgacagagcataagatattcaaatgcccttttagagtgtaaagtctttcagaaagtcagaatttaaaaggagagagatattcagatataatctgataattctagagtatataggaaaacctaaaatggtttctaagtagaagacaccaagatgattttgactcaaagagaaaaatgatgcattttgggccatcttttcatggcattttatttcttgacctttttgctttactttagtagttctgactataatggtggaaactttccaacatttccttccatgcaaagtggatgtgcttaggacacttcattagtacttaaattcctgaggtcattcattgactgccatacatcagaaatagaaagatgggtgtccctacaggtatgcctttgacataaatttggtggttggctataaaaactggtggttattcttatgttttagtatgtaattcagattttataaagaaatagcatttagttttatcactattataattttgaagagtatttctgatttggggagcattttatgtattctttggatatttgtagtaatgccattttaacctgtcttgtttagaagacacagtatgctgccaaaattctggtcattgcataggagttctagcattctaattccatctaataggaggggaaagtcatgtgtggggtatatttaatatgatgactgtatgcctagtcagggcttttgatagagaatgggaactagaactaggcaggaagttttcaagctgaacatgaggagacagtgtgcctttgaagccatttgcctcctggagagagacacccagagggagagtgtttagtaaattaatccactgagccaacagactaagctgctgaattatggtcagactcaaatggatcagatgtggagaagcctgtatttgaactgctggccattaggaatggtgtttgttgctatgggaactggtgctaaggaactatactgagagactctgattaaaagggggagggggaatggagaaaaaagcctgagaggacataaaaataaaaaagcaatccagttgttgtaaaacaaggctcaagccacatactgatggctgtgaaccatatattcctatagagtttgcataaataaattcatgctttccaattaatttgaggagaataaaatattgccgagggactgttaatttctatgatatttcaggcaaagaaccaaagtgtaggtgccgttttcatgagaattttagatatgcttgactaggaagtcattacatcacatttatctgtttggatgtgggagacattaacagccttatgaatattcatggtatctggttaattaagttaattgttctgcagaagtgcttgcacttccaaggacattttttttttttttttttttttgcctccatagtttctccctggtatttcatcagtaattctttacatgaactgctacttctgtccttacttttttgtatttggaacattttagcagctctcaggaggaagtggtaggcaaagtttctggtagtgttaagaaaaataactttcaggctaattaaaatgtttaccttgaggtagaacatttatagcttttgtgagaacattaaaattacgccattgttatttatgtgagcagcatgttcttttggcatgtagacatcttttcaaatagagtacagtttcctgaaacaaaatgtaatccatctttcagattatcccaacaaaatatagaacaagctatcgttttgcaattttacatatactttctcataaactttccttttttcttcagagtgtcaaaaaccacatttaaagactaagatacagattaatgagtagtcaatgactaaaataattttctgacttctagtcatgtctgttatcactgccaacttctacagaattagagaaaagttgcaaagcctgagaagacataaacaatttttaaagccatctctagcattctaaaaaaattttgtacttgggcatacccaccgtacttcaaactcacagggaataaatggtctttattttcttaagtcatgatatgtgtcattctctattgcacatgacattacattatgttttttaatagcctttctagaggaatgcttttacggtctactcataattaaccatggtaatggaggaaatgtgtttcatggagtactgtaatccatcgataatcctaaatatctgactctaattatgtggcctcctccaaaatctttaccacaaatctgattgggaagcacaatggattgacttgtttcttccttttctcctgatccattccagatttattagcaattagatggtcaaagggcaggctgtagagggccacaagatcattggaaagaccttgataaagatccactgagtaacaggtttctacactacttgttctcaaaacttagggtccatagactcaccttgtgaacttgctaaaacagagatacctgggtcctccctcctccaaacacattctgagtccatgagttggaggtagaacccaggaatgtacgtttttaacaagctcccaggtaatgatgctgcttggaccatgcattccagaggagtttctcaccaagtcactgtgcatacaaaccacctggggatctaataaattgcagactctgaatcagtgtgtctggaatggggcctgagaggcaacattttaaaaataatatattttttacttccattaatactgctattactgttttaatacctattatccttatttttaaatggacaaaaattgtatgtatttattgtgtacaatgtgatgttttgaaacatgtatacattgtgaaatggctaaataaagataaacatgcataaaattgacataatgatcacatactgattttacattgagaacacttaaaatctcccttagaaatttccaagtatataatgcattgttactaactattgttttagcctgttctcatgctgcaataaggaaatacccaagactgggtaatttataaaggaaagaggtttaattgacttgcagttcagcatggctggggaggcctcaggaaacttacaaccatggtggaaggcaaaggagaagcaaggcacattcttcacaaggtggcaggaaggagaaatgctgagtgaagtggggaagagtcccttataaaaccatcagatctcatgagaactcactcactatcacaagaacagcatgggggaaaccacccccgtgattcaattactcctacctggtctctcccttgacatgtggggattatggggattaaaattcaagatgagatttcggtagggacacaaagcctaaccgtatcaactgtagtcactaggttgtataacagatctcttgaatttattccttttacctgaaattttatatcctggaccagtatctccccagtccttcccacccattagccccagtaaccactattttactcttcgcttttatgagtttaagtttttcagattctacataaaagtaagtatttgcctttctgtgcctgtcttatttcacctagcataatgtcctccaggtttatccacgtgttgtaaatgacaggacctctttaatgccaaatagtattccattgtgtatataaacaggctgattgtccctaatctgaagacttaaaatccaaaatgctacaaaattagaaatgtttgagtgccagcatgatgccacaactggaaaattccacacctcatgtgacaggtagcagtcaaagtgcagtcaaacctttgtttcatatagaaaaatattttaaatattatataaaattatcttcaggctatgtgtataagatgtataaaacttttatgtttagacttgggtcccaccccccagatatctcattacaccaacagtgtaaaagtattcccatttctccacagccttaccagcatctattgtttattgactttttaataatcgccattctgactggtgtgagtgtggttttgatttgcatttctctgatgatcagtgatatttagctttttttttatatgtttgttggccacataaatgtcttcttttgagaagtgtctgttcgtatcctttgcccactttttgatggaatttttttttcttataaatatgtttaagttccttgtagattctggatgttagacctttgtcagatgggtacattgcaaaaattttctcccattctgtaggttgcctgttcactctgatgatggtttattttgctgtgcagggattgttttcttgatttctttttcagatagttgtaagtgtacagaaatgctactgatttttgtgtgttgattttgtgtcctgcaacttaactgagtttgtttattagctctgacaattcattcatggagcctttagggtttcctaaataaataagatcatgcctacaaacaaaggcaatttagcttccgtatttatgatttgcaagccttttatttctttctcttgcctaattgctctggctagaacttccagtactattttaatgacagtggtgagaatgggtattattgtcttcttgaggaacaagacattgtttctcaactcatgagagtaattttaataagcactcaagtattgtcattcctgtttgacagtaggccgtattttgagtaacaagggtcacagcataacttgccttttggtgaatcagttggaaccagtttgccatttagttaaaataaacttttctttgcactggtattactagaagtaattgtgcttatttataattaataataattaaatatgcttattcttagttacctaaaaaattatgatattaatgacctcttggttgataatggctaagctgcctcagcttctccaatttagcaacccaagtacatatcagttcaaagtaacacaaattgaagcaattatgtatgatcacataggaatgcttctgattaacaaaatccagaggactggtctttgccttcataaccggaacacaccacatgcatggtttcacagctcttggctattattggacttacttattatattctttaattcaagaaaaattgtagcttcattcattctgttcttaataattttaaattctctttagcctcctgggaatgggaagggctagctggtatagtcccctgtatctcagatttcagttacacataaacattaaaggggcctgacttagggcgctctttgcctctgtggactggtggggaaaatccaggtgtgtcttaaattctaataatcatgaaaatcagaaatcataatgtttcaaatacaaatcttcatacatgggaaatacaattgaattaaacattttcttcaatgtaggagacatttgtcagataacagaggggattctcatttggctaagagcttacctctaagattcattaaatgtgtttagagcatattttttgtagtttgtagttattttatttttctgagttattatttggattattttctcttttatttatgtatgcatttgtcactgctccccagaggcacctcattttggcattgaagctaaaaacccattcattaaggttgggatggagtgggctttgatatagctagcatttgggaggtagaaaatagacattcgtgatcaaaaaagctgtaagcggttactataaactatttttaaatttctaagtattttaaatattgaacaaatgtgtagacatttgatgtgcatctatactgtgaataagaacttaaacttctaatattcacattaactttcctgattttataaattctcgtttatttttcatctgaacattgaagaatgacatctacataaagtaaaagcaaatgttagtttgaacacattctaccctaatagtgcatgttttaaaattgctttggcaggatctaccaatgtattggcacattctcttcatggagttcctcatgtgataactgcaacattgcacattataatgggtaagaattcttccaaagcagttcatattttataaggaaatgttgatttatataaggaaggccatcttatttccatcagactttaagaaaaggcaggttctttgtctcttagagtagagaaatgtttgactaaaaaaccaaaaggcaatgctttactatgtggattgcctgtcttttcaaaatacttgctttgtaaagagcagtaaatgaagttttattgtaatctgtacagaaaaaaaatattgtagtgtgctcaaaattataattttataaccagatgaagaacattaatgaatactccttaagtatatccaacactgatgtaggactgtaccaagactctaggactaggattatgttattaatgaaaaaacataaccagaaaaaaatttcagccagtagatgtctatagatattttattatccctattggtaaaaagcatataagctcaggtatatgtaacactaaactactgttaaatctgtgtttaccttgcctatctactttaacttcgtttctttgaccatgttttataggaaatagcaataagctgaaaaatttagtactctgtgtttcttcactagtacctgaacaagttaaaaatggtaattattgtagttataggtaaagggaactgaagagaaagtgaggatgttcatggtctacagtacctttagatattctcctataagccaataaatatgctctcttatgtttgctgttttgatacaagtcctactgtactcactgattaatatttaatgtaatattcaagggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaagtaagtctttttcttaaaccaaaaattgtatcccaggttcaatgactgttaataacaaatttcattacattttagggcagaagactgtgaaatatcatttttaccatttaacagctctgatgatgtgcaagaaaggtaggtaaaaactcaatgtaatacagataacctgtatctttaaagcataaaacattctgacaaacaattgatcagacttaggatctttggttatttttctaacatagtagtaaagaatatagaatcacagactcttacaggtcctagtaagcaaacaactactcactcagcctttttctctttttccttccttctttcctcccttccttccccctgtctctccctccctccttccgttctctttttcccttcccttcccctttctttcctttcctttgtttttttccctttctttccttttccctttcccttttcttttgagtgcctactatatgccaggcactttgaatacaacaatgcaccaaaaaatgaacaaaacacacagttttgtccctcgtgataattttggtctagtgtgtaatacaaatattaaagccatattaaagaagggttatagtctttaaagaaatagtacattattattccttataatactagtttacctttaaatgaatcaacacattatgttggcagcaacaaaattgtacgtttttacttactatctaattgaagaaagtatttaacatatataatgatgagttctctaattttctcatatttaatagatttgtgtgtgtctgtgtgtctgtgcgcgcgttatctgttttatgtctttgttttgttttctttcttttaggagggcacagggatctcccaaatctggtgagtcgaaaagtatctccttgagaactgtgccaggttctgttgacattttgttctggtgagggaaaataaccaatcactttcattacctttagactgtaatgatcaatggcaaatgatccagggtcagttcttgaatgtcagcattatggcaattccttgcctgtgttcagtggcacctagaggcttggcacctaataccaggttagtaagcatttttattgaattgttgatacatttcttatagaccattttttttccagggtatccaattaactgttggttagctagaaacttaacaggtagtttatctttgtatattagagattctaagggatttgtcatcacagtaggttgagaacaactgttgaactggaataattatcagataatcattgactatttaacgtcactgaggctaaaataatatttcctaagttttattgatagaattttatgcctactttacttgatttattcatttagttgtggagaacattatattaaatactgatatttcttgtgaatgtctttgctttccaactttaatgcaaacataaatatccttagcatgaaaatcacacatatgtatatttgatactgtattagtctgttttcatgctgctgataaagacatacccgagactgggtaatttacaaaagaaagaggtttaatggacttacagttccacgttgctggggaggctccacaatcatggtggaagatgaaagtcacatctcacatggcggcagacaagagagcttgtgcagggaaactcctatttttaaaaccattagatctcatgagacttattcattaccatgagagcagcacaggaaagacccacccccatgattcagttatctcccaccaggtctctcccacaacacatgggaattatgagagctacaagatgagatttgagtgggaacacaaagccaaaccatatcagatacttttagtcaaaagaaacatttcagttctatttaatgtgaatagtagtgcatatcaatctcctgcccacattttcaattgaataaaatatgagacatcttatatatatctttttatccatgggatatagacattccttctcttgcacattcttcttaatcagctgtccattatggggctgaaaatatttctttcctgaatccaatcctgtagagtgtaggagaaaggatcgtgagtgttgtgaaatataggcaataaacggggaaatattcaaagttagagaagaaaaaagagaaactgcaaacttcgatattgaaaacccagatggcaaggtcctcattaattacatctagtgctaaaacttcaaaggagtattttgaaccttgtgtgatttagaaattgagcctggtggttttccccgacaccttcagaaatcctagatagctgtgtgctttcataatgtagtttccctgactaaacttgaagacgtggctagctgaccaaggagctatgtttggcaggacttgagacaatgtttatctaaccctgtttgtttaaggaccttcttgggagggtagacctgctcttctgggaacaatcgattcatagctccttcaaagccactccataaatgttctgcttgactagaattccactgttgactctgcaggcttaatcagtattaatgaatttttcagagaaggatgactaattagagatttcttctgtggtttataatcacaacatgccatctttgcaaagaccttttgatcaagactcatttgaccggagatttttcagagatgtagcttctgatgattcaggatgattgaacaggagatttcactttcttctttttcccccaccatgataaataataatttatgttagaatatctcagtgcaaattgccagtaggaactaatattcttatattctaagtattctaagattaaatgtgttcatatatgtgagacatttaaagcagtgccagccatgtaagttgtgtttctatttcaagtaaatattgcaaagcaggcataggatagtgcttttaatgtttataaattatgcaattaaagatgcacagtaacactaccatgaacgttttggtgctgtttatttttaattgggaagaagaagcatgatggaaagcatactgagcacctggagtattggtgctgatgaccattttttctctgtgtgcctttgaacaaatcacttaaacttggagttgtcttttccctctacatgaaatgagcgaatgatgagataatctctaaggtcccttacagctctgacttgagctttcataagatactaagagctctttttttattttgttgttattcttaaattaacttcatgtttgcactgaaatcaagctagaagtcatttgtatgtatttctgcaaactgcattctatagcttgatgcatttgtgagtggctgttttggcactaaatcacacctctgaattttcactctcttatattggatggaacagttatgcaagattaaaatgttcagtcatttaactgaacatgtgtggcagcatttgttcactccatttcatccatccaaaggccactttgatttatttcatttcctatgtcacttagaccttctgtctataaataaatatttaaatcacactttagattttagaaaatgttgagctatttgttacacaacttgtgcatattaactcttctataatacatcttttaacaacatagtttcacatttagaatttctaattacattgtattttaaattatgtcttgatatgtgagtaggacgcttgatggtttgctttgtaaaatgctctaatgtaagagcttattgagaaggaagccagtgatttaataaaactcatttgaaagcctgcatcatttaaaaaatagcaagatacggtttatgaattttaggtaaacgtaacatggtgatttatctatcttgtccaatactttcagtaaacagtatacttgttataaggaacagtatgtcataatttttggtataatctcttagtaaatttcttgatgtctaatagaaatatttaatttcagattaaataatggaagtatggctcttataattgcccgaaacacttctcggccagaatttataaaacacctgaaaagatatgccagtgtaaaaaatcaggtatagtaaattctttttgttacttatttgcaaagctattaatcatgtagaaaaagatgctgcaagaattgacatcgaatcctgcctcataagaaggttttattttcttctgaatatattaatcttctttttcccaatctatttcatccaaattttgaaaagcatccgccaggattaatatagattggccttttttgaatgatgaattagtggttatgtatctgtaaccacaaagataaaataggaaatgtagtgttatattgcaatgtgaaataaattaaggataaaattccatactcaggctgttcttcagaatgaaaagaagtgaaatttgagagtttagccttcttgatattatggcagcagactttctaaagttatgatctttagatcttcctgacatttgtttgcatatctgcattgattgaaatagatctgtagatatgtatttaaaaatatgacagttttatacaaatattcattcaaaatgagaatatgtgaagatatacatttccacttaagtgatttgctttaaagagaaacagtaactattacaagccatattattttggcagctgttttgacctgattattaggaaaatgatccttgaactatgtgaatttctgaaattgtgagtctttgaagtacataggtatggttgtaaaaccctatagtttcacactttttctttttctttctttttttttttttttttgagttagagccttgctgtgtcacccaggctggagtgcagtggcgtgatgtctgctcactgcaacctccacctcccacgttcaagcgattctcctgcctcagcctcccgagtaggtgggattacaggctcacacctccatgcccagctaatttttatatttttggtagagacagggtttcaccatgttggtcaggctggtctcgaaactcctgacctcgtgatgtgtccacctcggcctcccaaagtgctgggattacaggcgtgagccaccacgtccggcccacacattcttaaaggtataaaatggtgcttggatagagttgggagataacagacgggaggaggaggagagtaaacccagccaatgactggcagctgaaccttgcttatgtaccttagccatagcaagtctctccatttttgcctcattatattttaaaactttcttaggccatcttcatgaagtttgatctgtcagtaacattatttgatcctcatgtattgaacaactaactgggctgcttaggaacttaaatcataaaaaattacagtcccactttctttatatgtcaaagtagatcagcaggtataatgtaggttgtgagcctacataacagttttatgtatgtgtttgggtggaatatggagatttattgattttcaaaggaatatatgccctttcacattttaataaatttctaaacattaaaaccaatttttaaaaaacccaaagcactatatattcattgctgtttttaagtcagaaaatagaaacaagaaaatgattttaaagcactcaaaattccatgttcctcaagattagtgtcattaccttggtagaattttttccgaatccttttttattaaataaatgagaagtaaagtaagtattaacctcattcatgtacctctatttgagaacttaaatagtattaacctattaatgtacccctgagaagttctgtatttattttggggaggtgtatgttgcacaaattgtttatggaaggtctcttttgaaattgcctatggggcaagtctctcaggcaatttttgtaaacattcttcttcttcatttttttaaatcaatatacctttcttctgattttaaaagcaatggttaccttacacataaagacagacatacagaaaataataaaaatctgtatcgataggaagacgttttctaagagataatattatgcaggatttatcatattttctcatgtactctacgaggcatatcttgcttttgacacaagaaacagttgcctgtgtgtgattcactggccttaactctgatttatttatcaactttcaaaaattaaaatccatgctattttttttttttttgcaaagaattctaaaatattttgcatagtgtatatagtaagaaagattgattcccagggtgactgctttcaagcaatgttaatttgatttgttaattatccacacaggtgtgtttatttaggctctttccttcatggtgacattaaaaatgtgaatttatataaattttgtaagattatgaaaatcagatctatgtaaaaatcatgtctactgcataattcatagcagtgctggtattcaggaaggaaaatgtggcaattcagtttaaggagagtaacatctgcttctctgaaccatttttaccaggttgaataagcgaatgttactgtataacactgtaaaatagattgaaaccaccatgtgcggagtggctcctgttccttccccatctctgtgtaaaattagatagaggctgaacactacccttcaaagtccttgcagctccatcctattgctttgccccccttctcactgtccacacttttctctttcattgtgaccatttttggtagggagtttaaaaccttaaatgtgagtgcttcccccaggatttctttgcagccctctcatcttctcaggatgccgtctcctggatggcctcattgcccctcacttttgaactgtctgaacatcatgcactcccaagggttctgtcatctcgtcttatctgcaggacctctgtcttcttgtatgctgaagaggttctgaaattcaccggcatctggaggccaacatgtctacagccgaccttatcttttcccctaaagttgttccttctgcgttgctctgtgcgggtcaatggcaccactttctacccatccaggttaccctgaactgttccttcttcctcattcctcactaccagtcccctaacttgttctgttggtctcctcttaaatgtttctaaaatttctccctcaccttaattcaaactttaatcctttcttgcttacagtagcctccttttggccttcaggttctctggtcttgtcttccatacctctttttagagaaacttttttctaagacacacattggatttctctcctgcttaattcttcagtgcctttctcttgttgtcagaataatatggaatatcctcagtctggaacacgtggcctttgtatccaggtccctgcctgtgttgcaaccccacctcttattaccaccctccaccacattcccagtgttttggcattttattcgttggctaaggttgccataacaaataccacagaaaagatggcttaaacaaacagaaatgtatttctttcatggttctggaggctagagctgcaagacaatgtcagcaggtttggtttgtcctgagtcttctctctctggctggcacatggctgctttctcacagcacccacaagtgagtggtctttcctctgttcatccccgatgccttttcctatgtccaaatttcctcttcttataaggacaccagtcgtattggatgagggcctaaagacatcattttagcttaatcgtctctttaaagatcttatctccaaatatagttatgttctgaggtatacagagcgaggatttcaatacaggaatttgagggccaaggggcatgatgttgagcacctaggagtcacactgaattctgtgtagttgcttgaccatggtttgcctctagttttgtaaatgcttcctctctccagactttcttctccaggctaaatcttatatgttctttaaggctcaattcaaatgggaagctttcccaacatccatagcctgtttgcctcctcttgtttcctctgttgaactccacacttgcaccatcatggcactcccctgtatcaaaattgtaactgtttacttctcctccccgtgccccaaacataccctcacacaggatactaagctcttggctcccgaaagtcccacttaacagcgtctgtggcttcacagttaaagcatttgaaggatggctagatcttcattttgtgaggagtgcacatgacaactgctgatttaagataatagacttactggtggtggctgtcaattcttgacattccttggcttacagctgcatccctccagtctctgactctgccatccttggcattcttctctcataaggacatcagtcatattggattaggtcccgccctaatgacttcatcttaagttgattctacctgcaaagaccctatttctaaacaggggacattcacaggtaccaggggttaggacttgaacatagttggggtggtggagggaaatataatttagatcataacaggcagttgtgtgttttaaatgaattatcaactaacatgaatgattatgtagataattctacaaggatgaggcatgtagccaaggctttatacccgaggtaggaggtctaacgcagttactgtcaaacagttttgcttggggccctctaattctgtacctcagtcacaacagctgatgccatcatatcatctactgtttaactgtgtttacagtataaactggaaagttggctggaccttggtatctacatatgtaaaatatgggtgttggggaaaatattagttttctgtcaacttttaaaactgtttcattgaggtttacatgtggaaaaggggaaaaactatgtagatgatgtttaattaggaatgtatctcatgtcatttttctgaaaactgaaatgagtagttatacatttctgctcaagttatttggctatattttcttaattatgtcagaaaatacatagtgctttttcagtatagtttccttaggcaaacaagaaaaaacgcaagttgaagtttaccttgcaccattctatagtggtaagtaaacagtgatcttgcagcttgtgtccattgttaaagtgggaatggggcaggcaaacaccttttaaaatccatatttgattggctttctcttttaaaagaagacatacatcccattttatcttcagaagtttagacttgcgttcttccaaattaaattccaagtgtgaaacttgtactagtttgctttatgtcagctaaactaattgacaagttgataatggattatatgtcttctgtatctacaggccagtattaaagattatctttaattgaaaaatctacagtatcactattttatgtaacttctcacagatatgtactatttgtcataaaacaagatttctaggtgctagatctaaaagaacccaaaaggctttggataagagattccttcttccaaaaaaacttggagatccctgttcatagtctcaaagctattaaaatgtcagcatacatgctgatatttacttgtgagagagggctcagtgaactttgattcgcgttagtagctagagataaaccaagtataatgattatttgtatttatttttagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattaggtaagtctatttatttcaccgcttattgtcaaccagtaaacataaatctaatattacaacgaaagctctcttctctgaactatcaaagcaggcagttggttagtttttaaaaaatcagtaaatcagggaagcataaagagacatgcacaaatttcaataaataaaaagcaactttacatttattcaactgttatgtagacccaaggcattttctttggttatgcgtgtctacattggctttctaatttattgttgtgcataaactacagataatgtctacaacttccattttggatttttaaaaatggatcaagatcttaaatcttttagtggagccatctgaatagtaaagtgttagatttttatccttccatcttagtttcctctcactcataattactgtaacatgttttgttcagtaatttgcttttattaggcctttacagagcattcaacttcccttgggaacaattttacatagcaactggtataaacaggtttaggaacctgcaaacgcattcttggtaggcattgtgacactcagtggttagaagaagcatgcaggggtgcccactagacatgggtgttctagaggcataactgactgttttacagaggtaatggagagcattggacaatcaaggaagtcagttaaggaggttttagagcaattattgttgttgatgatttatcaatcagaccttctcagttttctagattacagctctgttgggaatgctgtgtttgttatcaatttgtatttggcattggcattgtgtaccatacttattaggtgtatgtgaaaaacaacaaaataagttgatgaaataatgtattttctttacagattgcatccaagacttatcagtctttatggaggaagcatggaagaaatgattccaaagtaacatgtaattgtttctaaaagaaatgtacaaactagaattttaatataaagaaatgtggccatgctttaaacctgtggtccccaccctttttgggaccagtttcatggaagacaatttttccgtggatgggggaatggtttcaggatgaactgttccacctcagatcatcaggcattagattctcttgaggaacatggcactctagatccctcacataccagttcaccatatggttcgcacttctatgagaatctaatgctgctgctgatctgacagggggaggaactcagtaatgctccattgctctaacctcctgctgtgtggccaaacggatatcctaatagaaattgatgttactaacaattagcctctagggctttaaaagtcaagatgaaatatcaattcaaattctgtttttagatatcaattcaaattcttttttttacaatgtgtttattggacacacaaaaaaactttgcaaccatcataatacatcaatatttaacctagataattctgaaataatttggattctttcatttttcaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttcttaaagtggtagggttttaaaattcatgatacaagtaacaaagtaagttgataacaaatactattttgaactgggcaaaatctagcccaatatgtaattgtgttccccttgtatctgagaggcctgtgttggacaaccatagtactctgctttcactgtgctcagataacctgaaatatatagttgtttctgagtagttctgagtaggaaagaaccaaatgtaaatttccttagagaccatcctggagaagacagttctaaatcggggcttgatttttcatctatgatcctagatgttctcctgaaagaatgactagcctttttataacgatacaaagttttttaaaaatacataaatgtcataaagtttattcctgtgtatacacactctgggttcaggaggttttgtgcttacatttcactactcaaatgccttcgcaaatctcagaacattcctcaccatcactgcaggcctgtgaacagataactttcatcaattaggatggctggctagtggcagggacttcatataaagaaatctttcccagaattgtttttccacattgccttctaatttgatcactccctataacagatgttcaaaattcggccacagctctcttatgaaggcagagtcagataaaatgatattctgcaattatctagatcataagcataaaataaatattacaaaaatgattgtatttaaagaaattttttaaaatccagaaagtcatttaaaatagaacctcatatagtatgaacaaactataaaaatattttacatttca

SEQ ID NO: 18 - DNA, 145347 bp, Homo sapiens
  mutation 26643: c/t SNP in reverse strand
attgctatttgggcaacaatatggctccttcagaactggtcgagaatttctgtggtctttgcttgaccttcaagttgggagtttcaaatcagaggctttgaagtctggaggagttcgcagccattaatccttccggggttgtgctaaaggcgtttctagaaagagatcggaaagacccgttcagcacaggcccattgcatcttctctttgaaaacgcttgtctgaatcaagtatcttatacagacccgagactgaggggagcaagagcgcaggtccggctgtggcgaggtgtccaccaccgtacttgtggtcaatgcctggactagagagccgaggccgtccagggcgggctggccagggaaccagaagcgtccctggactggctgagtgagggtgccctttccagcaacccagtggccatggttaaaaggcagaatacaaccgtcaaagaagtccccagctcccacataagagagcgcaaaggccaatggaaccaaggcctcctcgcgagaactagctcgctttgaggacaagatcctggggatggaggtggggactgacgtagtgagagggtctggaggaacagtcgtagctgaaggtcaggacatgaagaattgcacgtatggtagggatagaatggcaggtacaacttttctgtactgaaggaactgggagaggacgatccggttagggaggttggggaactaatctcaacgctgcgtttacagatgaagccgcttttatatggcgtatatgtttgcttagaggggccgacggagattaggagaagccatcctttggcgccaatgatcaaagcgtctgccaaggagaagaagccaagggatgggcctttcagagagggcaaggagtcatgctgctctggatgccagtgtcaggacaagaaatcgaaaggagcgaggactcttcactgcgtgcctcagtctccccgcttctgcctctttcacctctgtcctacttccggcgcgaaagcaggccactcgctctgatctagacctagttaacattagcttttcccttccttccctcaaatcccctcccccctctatccccgtcccttctgccgcctgaaagggttaatctctcctgcgggtaaaaacaggtccgcggagtctctaactggcgacagatgggccactttcttctggccacaaaggggccggaatggagcgctccgcggcatacaaatgggcaggtcacgtggttccaggctcttggctggaccgggaagaccatatggcgcatgccggggaggaaggaggaggggcgggggtaggggtggagggtgaggggagcggttgtcggaggagggcgggagacgagcaaggcgtggggagaagtggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaaggtaattacagttctttcatttttttgccccagaatagaagcaataactgaagactgatgaacctacatattctgtatgtgtgcgtttgcgagagtgtgtatgtgtattgagaccagcatccccctccataattgcccataagtactcacacataatgagtcgtgtcactcaagtaccccctgcaggctttctaatttaaattttaaaaatttgggtttcttttgtggatagcataggagcttcttggattttttaaaagaatgcacggtaactatgattatctgctagtgctgattttaaagtcccaaaagcaataatgacttcactttctcacttcttacagtaagaaaaaaaaatctatgttatcaatatatattttgtgtgcatgtattttacgcacattgggagtgtcaagctgtgttttcagtgaatgaaagggacatggataccttgagtattcacaccatggaaaataaatcaggttcagagatagtttagttgagaggggggaaagtggagaaagggagagggactcactcctgctacctgttaccgctccagaggcggccaagtccccagcagccactactggagccagaaattcagttgttttactaaaggctttttattttccttactagaagcggcaacttcgcggttgccaatcgctgaccattataattactcaatcttttaaagggaggtttgaggcgaactttgaaaagccccaataaagagcgggcggccctttcaatgggctgtttattagagaggagccttccgcacctgatccccggcgcgtgggagagcgctctgcgccgcgcccccagccctcgccctgcagctagcgcttttgtacaaggtggaaatttagcggtgggccagagatggaaggcaagaaaagaaaggcgagggaggggtggaagaccctgtccacttttgttgccaaatgttacattgatggtgaaacaatttggtggaaactatttttcctcctttctgcatttgcttttcagtatcccgtcgatgtaatcttcttaaaaatcgctgccagtattagtaaattacgcaatggctgttcaacttaaatcgctaagtatctggaagccaggacagaaatggaagtagaatgtgtgattttacagcttttttttttttttatggagttgtgagtaactttgaacacatttggataaacatgaagtcgctgaaatgtacagtcatttccacacacattatcctgtcgggcaaccaccataaacacatttaagttaatcactaggatacaaacacatatgcgtgagtggtgtacacatatacatattcactaccctcccccagtcctgtcctcactcctacgtactagcggggcacacgcacgcgccattataaaacactgcatttaactttttctcagaggcattcattttgtaatgggcaggtacttttcgcaagcatttgtacaggtttagggagtggaagctgaaggcgtatctggcttttgaatatagcgtttttctgcttttctttctgtttgcctctcccttgttgaatgtaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaaaccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtgagagcaattgttgcatttcttcttaaagggattctgtttttatttttggggaaagtagttgcttttttgctgagttaaaaaatactaaacactatatgtagaataaaagaaaagaaaaaagtttaccttggcatatgctcttgtctgtttatcttgcacagggagtcaccagttctatgtagataatgaaaagacctaactgatatttcattatttggaatatgggactggacggcagtacaaacagtgtgtttttttctttgttttaagtggcttagcctttaggttttttatttccatttttaaaaatgattgttacatgttttcttctatttctttttttaaaaggtggattttaataattattaacaagcaagacataaacaagtatcctagcttagtttgtctatacatttaagatgtataaaacattactattttcttggtcttctgttatctgtacatttttctgaactaaacagttttatcttgcaaactagtactgtcccagaaaaatttatacacctttaggaagtaccaaagggaaatgagttaattaatttaaagaatccaagagaagtaacattttataattgttctattaacatcttgtgatgatttccatcatttttccaagaaaaagcataatggattatttgtactgaagaacacactatttgtactgtatttaggaaggtgtaattatttcctccccccaccctttggggcactattctgttgtttcatgaacacaactcactggaaaaacttatggatgattctgtctattgttaagtccacttcaaaaaaaaaaaaacagtttggcatttcttttcctctggatgtattgactgacagtcatgattcctagggaatatcattttggcacttgtgccctggctctactgtggtgctctgattactgtcattagtaactccattgtttctactctgattcgggtgccacattggatgactaccccccttcccaagcttgttcctttaatctccttctcattggtgatttaggggttccagaaagctgacctcatttagcaagctgctccagaaaaatgtgagtaatgtaatggacaggaacaattagccatactaataacattgccaatgaggctgcgtcaagctgtgacagaagcagtaaggaatacttcgacgttaaaaaaatgtttgagagcaatttaaaatatattattttaacatgttttctatcagccttcatcacatgacagaaatacttttaagttagtcccaactttatctaaaatgcagcaatctcattccaagtgaatcagagttgttattttggaatcaagctgttgctttctatatcctggattgttctcactgttcttactttaagagacataatactgatatgatacttgaatactaccagccttccagtgtaggaggtaatgaagtgagcattcagatctgatctaacctattaagtagctcaatttcacctgcaattaaaattagacatcttcatgcaaactaaaatctgttgctgtagtgaagagaagaaataaaagaatgccattttgagaattccagcttccaaaatagcaaacagggaaatctagactgtgttcttttgtaaggtagaaatgaagactaaaagttaggttttttttttttttcttcccattttgccaatacaacttcattctaaaacatagggattctttcagtcagtcaaggagtaactcacatgccaccatcttttattcaaaggcaggcacagatgttccttctgcaggggaggatttaatttatgaaaatgatattgtttatgcatgaatgaactgcatgcactctgcataacacatagcacttccatctgatcagagaaataccacagaaccagtgccaatgtcagaaacatattctacaaatttactcacttaaatgtttaatgaatatttggaaggcattttcaaaccataagaaacattttaaattatcttcttttatgaattcctacccatatttaaaagagactcttacagtttttgtaattggctaatgcttatacccagtttgtaagaaaagaacatattttactaaatgaaaaccaaccaaaaaaaaatgctggcaagtttggcttcactggaaaaaatatttcgtttagttttgctgtttaatgcttgtcatgaataatatttgggattctatctgtttcttcatcttgagccacgactattcctatcaaataagatgcttaggtatacttgtttaatgtgaaaatcctatgaatagttatttctagaaaaagctggtatgtaaaatcagggggaaatttcataaagatgaaattgggctaaatattgtaacatgcataattactattgaataggaacacttcacataacatattttactttatataaccaattgcagctatatagtatgatctatctacttttaatcattaaaacaattatatataaattaaaatgaaagattataatatcaagagtgttctactaattttaggtttataatatgttacagtaaaataccatttgaaataaattttgtgttctaatttatcttaaaatctctctgtttttacatttgaaagtccttacattcttacaaaattaatgcattttctgaaagaagctagcaattactaaaatgatatatggatcattagctaacagtttgaatcaagctgttttagttctataattatacaagaaatttaaagtgaaaatacctattaagcaattaataaaactaggtttcaaaatattggctaattttctcctaatgggaaatgtaaaatagcaaaactgcttcttaaactacacaaaaacctcctcacttctccttttctctctctctaacaccacttatttcctgaaaatcatctaaataaaatatttaattccagggtctgatgaagaataaaagagccaatgcaacatcttgtggaacaccaggactgagaactcttgttgttaccattgcaaagaggcgttctggcgtcagatgcacagtgatttgtatggtggcataatcattggctcctggccaggcattatgtttcagaggacactattgtcaagaaccattcaactagaaatctgcactgtatgcactcaaaagttgagatcatctgccttcctatgacaggaagaattctgtgctggcaattgactcatggactctcttcacatacactaaggcttggtccagtggctctgatggaattaactgtgcagccaaactagtggcattgacaagacagggccacagtctctggggacttcaggagaaattgctaattttaaaatgcagagtattatgttaatgctggattaaatcttcagatacattaaatgtggatttggccatctaagcattattatgttatttgcccagttaatttagaggtagatggatggtgacaataaccatctctacagatccacaattctaagagatggatccaattgtgaaatgatatggagagatagagtaagttcaatctagcatatatgaagtaatttggtaactgacttttcttttaacaagatcaaaagctaacctgctttacactttcatgtctaaggacagccaaccagagagatggcttcacacactagcccactgctaagtgcttttcattcactttcatatttcatcatcaaagcaccctcctgccttatttatagatggggaaacttcaggaagttgagatacctagatatttgcattcctgtcttcctttcttcattcaggtttttctttcattgccacttcctcaaagaagcttttactgattcccatttaaaatagcaactgacttcaactccaccaaaatcactgtattgcccctccctctttccagagcatttgcctatcaaatgttatcttatgtatttacttgtatagcttaattttaaactatctatctctaggtcttctgagcacctgagaaacagagacaaagttgtctcttctgtgtgttgctgttcctctggtgcttagaagacctagaggatcctcaataaatattaactttccaagggaactgaagagcactaatgtgatgctaaagcctgttgccttaaccactatgctataagtcaaatcagttgagaatggagaggaccacaaattattttcagtccagcaagtgttataaacattaattctataaaaagaaaacaattgaaactaatttcttattatattgcatggcaccaaactccccccacttcctttttgaggatcatgagttgtctgtcattgtttctttttattgatatcaattggttaaatataatctggaattggaataaaagaaaaactattataggctttttccagaccatgtatttcaatgcatattattttttcctttctgttcattattctttcagtaattgcacttgttctatttttagtgttatgtaaaattactgtagctcataatttctattttgaagggttcagtgtataaacttagcacatcaatactatctttttagtgttcgcgctcaatggtgtcagttaagagatcaccatcacttttggtgacgtcaatgaaggggtattgcaatgcttaagagaactgttaatccctttccactggtgtcactaacaattgtagtgcttgtttattcatagcaggtacgtgactaagtaatgttaacatcaaagcagaaagaggataatagagtgttctaaaaagaaaattcggtggttgggtgcagtggctcacacctgtaatcccagcacttttgagaggccaatgggggtggatagtttgagcctaggagttcaagaccagtctgggcaatatggtgaaacctcgtgtctacaaaaaatacaaaaactagtggtgcatgatggcatgcatctatagtcccagctactcgggaggctcaggtgggaggatcacctgagcctggggaggtcaaggctgcagtgagacgtgattgtaccactgtactccagcctgggtgacaaagtgagaccctgtctcaaaaaaaaaatgatttgagataacatcacttgtcattgtttgttaactgaataatctttattctagccagtgcctaaatacataataaatgatagtacaaatggatataaattataactaaacctaagtagtgatatttatcacaatatttctttactagaagaatttctttgttaatagaggcaaggctacttgtttagataccttaaaataacataagatttttggataaataaattaatgattctttgattctgactggcatattaaaaatattaagcgaagagatctttgcttcccaggttttattttttgtctaattaactactggtgcatttatattaaaacatattgtcaagggaaaacgtatatatatatatgtgtatatatggtgtgtgtgtgtgtgtgtgtgtgtgtgtgtgcacacatatgctatacttggttgagtagtatccccttcccttgcccacctctctcccaaatttatgtccatccagaacctcaaaatgtggcctcatttgaaatattgtctttccagatttaattaagatataagatgtaaattgatacaagttcatgctggattacggtgggccctaaatccaatcactgatgtcctgataagaagcagacagaacacacagacacacagcatacaggaagaatggcatgtgaaggcaaagacagagactggagtgatgtgtctacaaatcaaggggccccaaggatttggggcccacatcagaagctgggaaagagacaggaattctcagcttctccttctgaatccctaagaaggaatcaaccctgctgacaccttgattttaaacttcttgtctccagaactgtaatataatacatttctgttgtcttaagctacccagttgctggtgatttgttatggcagccctaggaaactgataggtatactaaaatctctaatgaattgatgttaaatatatataagtataggagagttcatttaaattcttctgaaaatgtcttcttaaacttttaatgatacagtatataacaaccagtatacgtagttggtatcgggtttgacatttaaacaagctgacaaaaaacagctgtttaataaacatctgaattatataaaagttttattgtttattattcatgtgaatgacttaaactgacatctacatttagtgaagtgtgaatgggcctagccaataaactatgggtaatttttttaaagtctcatctttgaactcacaaaaaattatcaaatatcagctattatgtattcttcatgtgaagaaaatgtcatatttatttgatttgtggattagcatatatattaatagagcttttgaaagaacaaatgtagcactttcccgatttcatagacactcatttaacacacaagttcatattttaaagtacataattttaaaaaaattctagtccaaatgaatttaagtgccatgacttctaaaaattctgtctctatttttgggttttataggaccttgagccagtactcttctggtgagcttaagaggctaagacttcacctttagttatatggggctttcatctgattatttgtctattttgattgctctaaatacaagttagtgtgtatttcatctgaatgtatttcattataagttttggttttatgtagatctggggatctgtcttgtttttaatcttgattggtctgtttgttttgggatagttggtactttcatttcttatgcttgctttctttttcattttgtgcccacctttagtcaggtgaacatcagtaaggaataaaattttatttttttaagccactgaaaaaatttaaaaaccacatcataactctgcctctgctgactgataaaaatgctaacttattaagacaaaatgttatgcaagaagactttattggaatagagaaacatcctttttatgtaagaaatatcaacagagacatgtgcctttcttgtgacaaatgtggtatgtgtgtggattagaggtctggaatgtggcagcatttcagtacttggaggggagaattagagtagggtagaaagatagacggggagcagaggatgattctcacccagtagaaagcagagtgaagaaagaaaggggaattgttttttgcattatattatttgaactgtggattaagtctttccataagccatccctacgcctctaagtaggttttattaacttaagctggtttgagatgggtttttggtcacacacaagaattgcctgatacaagagaggctttgattttgttgttgcttgctcatttttatacactaagatggagaaaaccctggacatagtgaagacgaaattgaggaaggtgttgggtagagtggagggtagaagacctgtaacataggtacagaattacattaaactggaaggacttatatccagatataggagtcagggtagaaagagagaatgttagcagtaagggtaacagagtagcagaagtttattcttaccaggtcctgttatgtgacagtggaggcatgttgaccttctgactaggggagttaaaggagaacactgaaggtttagaataatgtctctaaggatagaaagagaaagtttcatcaagactcatcaataatagggcagcagggcttagggccaagcaaattcagagaccatgatattatagtagtttgtagtggtcttaatccatctaatttttcagcattttctcaatggccaatacttagcagtggtagtgttttatggcatttggacaacagaagtgaaagcactggtaagagagacgttgaagtgaaacaccatggggctcagaaaagcagagttgatccatctggtacatgggcaaggatggtcctgaacaattctgcagtaagttggaagatagaaaaaatacctaacgaacttgtagatctgggtaaggagatttttggcagaatattgtaaggctaattggcttctcttaactatatgagatagggttttacaagggagagataagcgagcataatttagaagaactatagggggtcccaggcagactctctggctggaaaattattctgatagcaagaaattagccccaaagcaaagatgaaaagtagggtacttccaattaaacatgtcataagggcaagcctcaatcaagagtgtggctagaaggcacagctcacctggacaaaagtgcttctaagcatattaggagcatataccacaataacctgacttggacccaaagttgagagaggccagtctcaaaaaaatttgagggaattgcttttgcataatatgatactttatatacatatctgttacatatcatatatatcatattaaaaagaaaaaaaaccctgtttttccttccgttctttcatataacccttctgacaacaaatgtggagtttttcacacactaagcaattctttagttcttgctggacacttcctggatgtcctacaattcaactcgattctcacacaactgcccagagtcagtgcagacccgcagattaaaggcttagccccaaaagactaccccccactttagatgtcaatcacaagtctcaacttcatttacttctgaaggacgagctatacattggaggaaacccctctttctttcaataatttgctagaatggctcacaaaactctgggaaacatttacttatggttaccaatttattataaaggatataactcagaaacagccaaatggaatagattcatagggtgaaaaatgggggagaggcatggagcacaactctctcagcacctccatgtgttcaccaacccagaagctctcagaactccttcatttagggcttttatggagctttatcaagtaggaatgattcatgaaatactggcattggtgattaacttaacctccagcccctttcccctccctcaacattgggggtgaagctaaaagttccaactctgtaatcacagggtgagcttccctggcaactagtcccctgatccttagggggcttctgaaagtcacctcattatcataaactcaggtgtggttgaaagggatgttttgaataacaaaagatgcgcctttttcctttatctttctgagttgtttcaggagctagggacaaaagactaatactataacaacaacaacaaaaaattcaatttttgcttttatctcttgggaattacaaggattttaggagctctgtccagaagccagtgatgaagatcaaaatacatatttcttattatatcacaattcacacatgtacatgatatccgtaagataagtgaactacataaagtaagctcacaaagtttctgtaggagttttgtccatttacaaacagtttgtaagctaaaagtatctgtgacaagcctcagtcaatttagaagttcatttttccaatgttaaggacatgcctgtgacacagcctcagaaggtcctgatgacatgtgcccaaggtgatcaggctacagcttggctttatacatttagggagacataagacatcaatcgatacatgtaagatgaatattagctcagtccagagaagcaggactactgaaagtggaggcttgcaggtcacaggcagattcaaaggttttctgattgggaattggttgagttattatcttaagacctggaattaataaaagggaatttatcatgcagatgaagctttaggtagcaggcttcagagacattagattgtaaaggtttcttatcagacttaaaagagtctgttctaacagtctttaggtctcagtgttgatgttaatgctggtcagctgtgcctgaattccaaaagggaggagagtataatgaggcatgtctgagtcccttttcccatcatggcatgaactagtttttcaggttaactttggaatgtccttggctgagaggaggggtccattgagatggttgggtggcttggaattttatgtttggtttacaagtttaacattaaaagcctctgtacctccaatgttttatggacaaaaagaaggctgaaaaagctacttggctgtaatcatgggccatttcttgctgaaaagaagaataaaatggaggcagaaccaaaagcccagaggctagagccaagagctgctgagaatgatgaattagggaaccactctcagagagcagatctggatgtgagataggaacattttctttctcagggtctatgaaactggcaacatatgctctcctgaatttcagaattgctatggaccagtgactgtgatatgctttctatatttttcccttttgaatgggtgcatctatcttgattatcctctgtctcattattgtatgttggatttgtgtgggacgataacatgtgtttttagttcctaggttcccagaataagaggagcacactcaaagagcgacatttatgagatactggatttttcacttgatatcataattgggtgagacttgaaagaaagtgaacatattttgcaaatgggagggatgttaaccactgacaaccacacccacagggtccactgtattagcctatctgcaaagacggctgccaaaaattccttctgtccatatatacattcccttttttaatgtgactgtttcacctgccagcaactgaagggctttatttccatttccccttgtgacttgtttgactaacagcaagaagcaaaagtaatgctattccaattctagacctgggccttaagaggcatgacagcttctgcttttactctcttgaaactcaatgtcattttttaaaagctcaggctagactactcatcatgagggaccacatgaaaagagataggcccagctagtttccacccattccagccgctccagatgagatgccagacatgcaaatgaagccatcttggatatttcagccccagctgagcttccagctaaatgtaagtacattcagttgatacctcatagagcggaactactgagctgacttcatccaactcacagaatcataatgaataacaaatcattgttgctttaagtcaatacatttaaagtttttttgttatccagttgtagatgaattatacagcctggggggaaaaaggagatagcacactgttagttgcctcatcaatattcatccccaaattctttttcctttttagtaggtctcacctcccacctggaagctgaaaacacctttcccagtctctctggaagctacagcacaggcatgttgcccaattctaaacaataggacatgataggaggtctgctgggtgggatttttgaaaatatttttttttctggttaagaaaaaagaaatgcccaaggaaaacctacaaatgccccttccattcttgcttttggacattttttgggagagggtatgatgcttagcactcctgcagccatctcggggccaacaatagaatccttgttgctacctggtgatagtgaagtagaaagctacaaagctcttgatttcttttcttttttttttttttttaaattttattattatactttaagttttagggtacatgtgcacattgtgcaggttagttacatatgtatacatgtgctatgctggtgcgctgcacccactaactcgtcgtctagcattaggtatatctcctaatgctatccctcccccctccccccaccccacaacagtccccagagtgtgatgttccccttcctgtgtccatgtgatctcattgttcaattcccacctatgagtgagaatatgcagtgtttggttttttgttcttgtgatagtttactgagaatgatgatttccaatttcatccatgtccctacaagggacatgaactcatcattttttatggctgcatagtattccatgctgtatatgtgccacattttcttaatccagtctatcattgttggacatttgggttggttccaagtctttgctattgtgaatagtgccgcaataaacatacgtgtgcatgcgtctttatagcagcatgatttatagtcctttgggtatatacccagtgatgggatggctgggtcaaatggtatttctacttctagatccctgaggaatcgccacactgacttccacaatggttgaactagttcacagtccaacagtgtaaaagtgttcctatttctccacatcctctccagcacctgttgtttcctcactttttaatgattgccattctaactggtgtgagatggtatctcattgtggttttgatttgcatttctctgatggtcagtggtgatgagcattttttcatgtgttttttgactgcataaatgtcttcttttgagaagtgtctgttcatgtcctttgcccactttttgatggggttgttttttttttcttgtaaatttgtttgagttcattgtagattctggatattagccctttgtcagatgagtaggttgcaaaaattttctcccatgctcgtgggtaggaagaatcaatatcgtgaaaatggccatactgcccaaggtaatttacagattcaatgccatccccatcaagctaccaatgactttcttcacagaattggaaaaaactactttaaaattcatatggaaccaaaaaagagcccgcatcgccaagtcaatcctaagccaaaagaacaaagcttggaggcatcacactacctgacttcaaactatactacaaggcttcagtaaccaaaacagcatggtactggtaccaaaacagagatatagatcaatggaacacagcagagccctcagaaataacgccgcatatctacaactatctgatctttgacaaacctgagaaaaacaagcaatggggaaaggattccctatttaataaatggtgctgggaaaactggttagccatatgtagaaagctgaaactggatcccttccttacaccttatacaaaaatcaattcaagatggattaaagacttaaacgttagacctaaaaccataaaaaccctagaagaaaacctaggcaataccattcaggacataggcatgggcaaggacttcatgtctaaaacacgaaaagcaatggcaacaaaagacaaaattgacaaatgggatctaattaaactaaagagcttctgtacggcaaaagaaactaccatcagagtgaacaggcaacctacaaaagctcttgatttctaatgacatcatatgggatgaaccaacccaggaacagcctgactctggacctcttttaatgtcagaaataaaatcttatttgtaaaccactcttagttgttcaggttgttgacacaggcactgaagtgcctccaaatggtgatgaataatgaggcaaaagtcaaagacagcaagtctagtgtcaaattttttgatgcctatgggtaagaagttcaagaaagtgagctattttctttctttttaaaatttatttttatttttgtgggtatatagatgtatacattagtcagctattttcaatagtgagaagggatgttgccacttagtataatgcctttttcatagctatcatagaaaccatatatacatatagtatagaaaatgaggatagatttctgacttaaactgcctatttcatttgtgtgcctggttacacctaattcaagactctacaatacagcattgctagcaattactgtgagaatatttcaagctccctatttgctggaaatacatttcatttttttgttccaagtttatgaatattagaacctatctaaaaaggagcttttaaaaacttgaggaaaggaaaagggagggcctacttttcttgcctgtgttatttcttgttactgctgattgagatgctagagatcatattgggtgagatgtgtcttagaatacagctgagcaattcacttttaacagtttccatctgagtacaaaaaactggtatgtgcagaaaacttgatattctgacttggcgggattctaggatttgttctatttttttctgtaattgttgtagggacatatggccctgtaccttttgggcagcaggagccagaatagcaggaacattctgacaaaattcccactcagcatgagagggaagcagtccccttgatacactgatgatgtgcccacttagcattacaagtgtttgagaggtggacacaactaaaactcacctcactcaaaatatatattgacacggagaaagtaaatacaatttgctgttattaacctttcttctcaccattgagacatgttaaatatctgaaattaataaaggaattaaatttaaaaagtttacttatcatgcatttaacacatttattgagcatctgttatataaatgcactgtttcaggcacaagagatagagccataaataagcagattaaatcactattctcaactgaggtactaatctgatataagagaggagacagaaataagtaaacattataaatcaactacatacttttacatggtgtaaagtgcaattaagaaaatattattgaatagaggtcaattttggaatggttgggcagggaagaccttctgaggtgacaagaagttggcctgggcaccatggggagctctaccatggtgaaaagtgttccagacagagtagacagcaacagcagaggccctaaatgagaatgcacttggcttatctggagagtagaatgaaggccagtgtggtaggacacatactaataataggagaaaactgatagaaaagagggtttgagcaggtgggcaggaattggacaacatggtgtctcatatgtcataatagaagtttggattttattctacctgcagtgagaagttcttaataaaaaaaaaattctataaactggagtttgagaaagaactatgttgatgatagcataagccctcaatcacttgtcacataaactccaaacttcagcagagactcagggagatcaaagggactaccacaggattacccactggctaaaattcagatccatggcagttggtcctgactggaattagacttccttgtctgttgccctcattgcagtgggtctgaatgtctctgtcggctgtgaatttttctccctctatctgtggcactgagaaggtggcccagacttccagagtctgtctcattggcctattacttggggatttgctgcccttcttctggaagtttgggtatttgttttcagagcatacttaaaggcctcctgaaagcaatgttaacaatagcaggatatattttacagtcttctactcagacttggatttttaagaaccagggatggagactgtgtttccagatctagtcaaatcccttccaaacataaagcaacaaagtgccttttaaactaggacctgtactgtttaatgctctggaaacaaatacccaagcttcagccaaaggagggaaagctatgttcaggaagcttcctgaaagttttttgaaagcaattttcatgcattagtattttacatatatatatatatatatatacacacacacacacacacacatatatataaacatatatatatatacacatgaatcactaatgagacaattgatcttcaggaactaacgtgaaataattggggtatcttggtattattgttatagataaatgttgaagaagttcattctttcagatattaattgagcacttactgtgtactaagaactgtgatagatactggggatttaatggtgaacaagataaattctctgccatcagggggcttatattctaacaaacttaaaatttactgagtgttctctgtatttcagtattgttactaagtacactaacttagtggggaagctagacaataaacaaagaagtatgtaataagaattaatagtaagtgctgtaaagaatactaaagcaggttatggtagagagattaatggcagcgtgaagatgtccatgtttcaatccccagaacctgtgaatatgttaccttacatagcaaaagaggctttgaaaacataattaagggttatctgggcaggcccaatgtaatcataagagtccttatctaagacgggggacaaaggtcaaagacagaggaaaagagacgatttaaggatagaagcaaagaggagagatgttagactgctggctttgaagttggaaaaagtgaacatgagccaaaacaaacaaaacagaacaaaacaaaatccacaggtgacctttagaaaaggggtccccagtctctgggccatggaccagtacctgtctgtggcctgtttggaaccaggctgcccagcaggcggtgagtggtgactggtggacaagcaagttttaccacctgagccctgtctcctgtcaggtcagtggcagcatcagattctcatagcagcctgaatcctactgtgaactgcacatgcaagggatctagtttgtgctccttatgagaatctaatgcctccaaaatgctcaccccttcaaactgcccccatccgtggaaaaactgtcttccacaaaaccagtccctggtgccaaaaaggttggggactgctgctctagaagccagaaaagaggagatatattttcctctagagcctacagaaggaatatataggcctgctggcaccttgattttagtcctgtgaaactgattttggatttctgacctccagaaatgtaaaacaatgcattggttttgtttcaagtcactaaatttgtggtaattagatacagcagcagtaagaaatgaatacacaggtttacaggatggtgaattatggagggtgctcaggaatggcctctttgaggtggtggcctttaaacagaaaaatgagcaaagtgaaagaatgaaccatctggtggggagaaaagcattccagtcagagggaacagcaaaagcgaatgctctgagaagggattattcttctcaatgtgtttgaggactggcaagaaggctttgtgtgaatgagcaaggggaaaaagttagtaggtgatctcggagacatagccagggtccagattataaaggacctctcgccttgctaagcattttgactttattccaagaataatgggaagtcaatggaaggctgtgagcagggttatatgctctcgttattttttaaaggcacaatgtaactccaaaatggaaaattggctctgggctggaggtgccagcacaggggaaaccgaaagcagagagctgggttgggagagcggagactgaagttgtccagctgaggggtgcagaagtgcagactgcaatgacagcaggcagaaaggactatatgttctagacagaatggacaggatttgctggtagattggattgaaggcatgagacaaaggagacatggatgatatcaaggattttgatactacagatttgaaacattctgagagggacaggtttgtgatggaaaatcatgagtctggttttagatatgttttagaagcttattggacagccaagtagagatgtcaggtagggagctggacataatacctaaagttcaggagagtggttggagctggtgacatcatttgcagaaccctggatggtacataaagcacgggacagtgtgtggatagatcctaaagagagccctagggcactccagccctggaagaaggcagcttatcaaaggaaaaagaaagaaagaaggaaacacaatccttattacttccatcttcaggacaattcaaagccagtgtttttgacttcctggcttgagtgaagcttgaaaaatggcaacttgcccctttgcaaagctcctaaggagtagccattggcttggcctgtttgcactggctctgggtgagcttttaaaatgccagtgagctctaattgtgttgattgcctaacagctgtgaatacaagatgctgactccagaactgcaactcattctgcgaagggcaccgtccttttccctctaatgactgctgaacagagccacctgaagcctgcatggggtttagcagcagctgcacttctgctctaagaaatagctcactgcagtcagatcaaactgaagctcttccttgcttttcctcgaagcttgggtacttattgtcggagcattaaacagtaagagtcctagcttaactggtgcacagtgctttatgtttggtagggatttggttaggcctacaaaccgtctgagctaagaaccttgagaaactcctgctatagttagctctttctgtgactctgcagtgtgaccaggaatgaggacagaattaagaatttgctgcctctatgatagaactgtttaggcactagaacactggaactagatctacaaccctatgaatttaatttccttttcaactcccctactccttcttttcaatatgatgataatgatcttgtttaaaaaaaaaaaaagccttctgctttacttcccactctgctcctcttcccagggactcactttcttcttgactgcttccccattacaagtactcagctccctgttttatcaccctgcttagagcagccattatcagccttggctgaacattggaattacctgggaacttttaaaaatccggaagtctgggtctcgcctccagagattccagcttagttgtcttgagcgtggcctggacatttgggttttcaaaagttccctatgtaactttaatgtgcaaccacaattgagaatcactagcctccagactctctgtgttatcaaaattaatgagcagctgattttagaaatctcagttatcaggagaaaagggtgaacccccccagggctcttctccttttccaggtgacacttctttatggcagtgcgtgaaagtgaagccctgctgcttgtaatctccctcaagggagtgcaagatccaggcaaagacaagactgcagaggcgctaccttgggggaaagtaggaccctaaatacttacacctggaggcacttacctttaatactgaatttgtcagatgcaaatttgtctatgcaaaccagggccttatctctagcttcccctcaggggttttgggaagtgcgctactactctgaaacagggttgtaaagcgtcacctgtgctctccagggaaccctctggaaaggaggtggaaaaacagaggcttccacccttgcaactctaagtgtgttccttggccagtgggatccatcacctagtattttcttagatatgtggtatctgggggccagtcccacacctatgcaataagaatctccatttgaacaagatgcccaagcgattatatgcaagtttaagattgaggagggctggtttaactcgagggtaacgaaaagtacgaaatcgtactttacaggagaagctaggcggagggagccacttattcttcctcttgcagctgggtctttttgtggtgagtggcgaagcggcgaggctggcaggccagggtgctggactgggtcaggcgcggccccgcctccctcctgggtccctgccctgcgcgccgttgctgtggcagcgctggacgcggctagagctggggctgccgcgccctccacctccttctccaaaggcctccccggacccctggctcgggcccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgagtgcccggccccaagcgtcttcgcctccctccgcgcttcctccctctccccggcccaaggcctacacccacgagcttttgctccaccctccccttttctcgcctcccctccccgtgctcgcctcactgcccggacaggttaccgagtccccaagtcgccgcctcctccttcccaactgggaactcacgcctctcgccccatcccagaacccccagggattctttcgctacctagccttttcccgcctccgagaccttccccgggcaaacgtcacaagcagcttttgctcagagtctcagcagaaaatcttgagccccaaaggggaggtaatttacaaatgtgagaaggtcaactactcctcccctccaagttgaaaaagttttaatccattaactttgatggtacattgaaactataaacatctcacagattatgcctacacaagagttctgaatccaactctcattttgctgacttgaaaatgtaactccagagctttgggagtgtttctgggtttttttctgcccctcaccttccttgccattgtctagaattaagacttcttcaggctcggtctagaaacttttgatttttaatattgaccctagattattggatcacagttttgcgatgcttagttacgtcaagcggtttgcttaacgtttgccttttattgacttaaaattttagttacctaaaaaagttataatgctgtagtttacaacaaatacttcgagtctattttcacgtcttagtcaaatagccttatagacttaacagatattttataaagaccattttgcaagtcttataagtagactttcatatagtcttatttctaagtccaaactcgagaaatactccccattgttgaattagcttagatgtgagcggtgaaagacagatgaaatgggggaggaactacatcaaggttactctacttgcgaggagatgacttgggggagatggaatttggtattcaacctcttttagctaaatacaaatttatgaaattaaaaaaattgccttcccctgttggaaaacaagacacagtgtggtatttatgttacagaatagactcactgtcttaaagtcttgctcaaaagtctaacaaaatgaaaccaactagccagggattcagcactggttgcgattgtgaattctgcctgtgctgcatgtgccatgctcgctcgcttcacgaaaacagtctttgaccttaaagtgttttcaggtgttttaaaaaccaaggtgtagtattttcttgaaccttttaagttaaaagctagggatatagctatggaattatttgtaagtctttcaggcaattcgagttatgcaatatagaagtttataattacagtttggattagcccaaagagccartttaacctacagtgcagctgaaatgctatagaattaaaatgagacattgtgcaatgagaggtcatacaaaccaatgttgcagtatttgtgtacaaaaaaagcaaacaatgacatgagaaaagaaatgctgttttatattgagtggtgattaaggtaaaataggtttaattagtgcacccctggcagtagagtttaaaatacatcttgacagatttgtaactttaaaggttgcaagtactgattctttgtttaattatgccctaaaaccatttggtggtcttttccttcatacaggtgtaccctttttctttgtaattaatacctggtattcaaaccactttgggcctctaaaattgggggcacagaagcctagagccttagtaagtacttctgtttatggaagaaaccaagagatgttttatttaggtaaaatatagccaggcgtggtgtgtccctgtaatcccagctacttgggaggctgaggcaggtgaattgcttgaacctgggagttggaggttgctgtgagcggagatcacaccactgcactccagcctgggcaacaagagtgaatctccatctcaaaaagcacaacaaacaaacaaaaacaaacactgggaaataagaaggagatattaagagatgatatatttaaatgttagaaatgctctgttgttgaataagcttagatgtgagtggtaaaagattaaatggaagagggagctacatcaaagttactgtacttgggaggacatgatatggtaggatgtggtggggggagagcatgtccattgctggttggcaagtgactggctgcctcagaaaaggatgagggtgggtaggggagatcactggagattattagaacatacgtatgttttcaagattgcttagtttttaaacctcatagtactttgttttcactgatgaaataaaatactatgtgatctttttctaattttccatcttgagtaataagcaaagacattaatgtattttatgaaggctctgactgccaaaattgggacaaattgatggtcttgttggcagggtaaatgagcataaccgtagtaattgtagttctttttattgggttcagggatgacctggaataatggatgtgttattacccttccctgtagaagtgaggctttcgaaaagaggctataagtcaatttgggaggcacaaagtatcagcgctttttggggattttttttttttttaagtagagaaatattttaaatgtgtgatataaagttatgcatgtgcttcttaagcacattaactcaaccagatccaacagctggtctaataactttttaattgtttaaaaaaatttaattgacacattgtaattgtatatatttatgagatactatttgatgttttgatatttacgttgtacaattatccaatcaaagtagttagttatccttcacctcacactttcattatttccttgtgggttagaacattcaaaagactctcttctagttattttgtaatatatagtattttactgttaaccatagtcaccatactatgcaacaaaacaccagaatttattcttcctacctagttgtaactttgtgtcttttgactaacctctctccatccttccttctcccctccccttcccagtctctggtaactattctaatctctgccttatctatatcaaccttttataatagaaaaagattctacatgtgagtgacatgtggtatttgtctttctgtgtctgggttacttctcttaacacgatgtcctccaggcttagcattcacaattgacaggactttattttttaatggctgactagtattccattatgtttctgtatcacattttctttattcatccattgttgtacgcttaggttgattccatatcttggccattgtgaatagtgctgcagtaaatatgggattgcagatctcttcaacatactcattttatttcctttggatgcatacctggtagtgggattgctggatcatatgatacttctatttttaattgttttaggaacttccatgctgttttccatattgactgtactagtttacaatcataccaccggtgtgtaagtgttcccttttctccatatctgtgtcagtacttattttcttttgtctttttggcaatagccattctaactggagtgaggtgtatctaattgtggttttgatttgcatttccctgatgattagtgatgtcaagtatcttttaaatgcacctgttgatcatttatatgtcttcttttgagacctatcaattaaagtcgtttgcccatttaaaaaatcaagttggccaggcacagtggctcacgcctgtaatcccagcactttgggaggccgaggcgggcagatcacgaggtcagaagatcgagaccatcctagccaacatgatgaaaccccgtctgtactaaaaatacaaaaattagccgggtgtggtggcacatgcctgtagtcacagctacttgggaggctgaggcaggagaattgcttgaacccaggaggtggagattgcagtgagccgagatagtgccactgcactccagcctggtaacagagtgagacttcatctcaaaaaaaaaaaaaagtcattattattttatctgttgaattaattttcttatatattttggattttatccctttgtcgcatgtatagattgcaaatatttttctcccattctgcagctgttttcactttgttaatagttttcttcaaggtgcaaagttttttagtttgatgtaatcttattttgtctatgcttttgaggtcttattttaaaaatccttgctcaggtcagtgtcgagaataatttcccttttttcttgtaatttcatagttttcaagttttacattttaaatctttaatctatttttatttttgtatatggtgagagggaggggtttaatctcattcttctgcatgtgaatatctgattttcctagtaccatttgttgaagagactgtctttttcccagtgcatgttcttgacatcttaaaaattcagttggctgttgtaggtgcaaaaatttatttctgggctttccattttatttcatgggtctgtctggttttatgctagtaccatgctgtgttgatatagttttatcgtatatttcgaagtcaggtagtatgatacttccagttttgttctttttgctcagggttgctttggctatttggggttttttttgtggttctgcatgaattttcagattgtaacatttctgtaaagaatggtgttggtattctgatagcaattgcattaaatccatagatcactttgggtagtatggccattttaacaatataattatttcaatccatgaacatgtactatcttcccatttattgatgtgggaagataatttctttcatcaaagttttatacttttcagtgtagagattctttcacttccttggttgtttatttctaggtatctttttttttaaaaaagtactataaatggaattgttttcttgatttttcacatagtacaatattagtgtatagaaatgctactgatttttatatgttgattttgtgtcttgcaactttactgaattctaacagttcttttgtggagcattttgggttttctatctataagatcatatcttctgcaaacagggacagtttgacatgcttctttctaatttggatgctcgttacttctttctcttgcccagtttatctggctagaactttcagtagtatgttgaatagaaattgtgtaagtggccatcctttccttgttattgatcttagaattgatctcgttattggtcttttcccattcagtatgatgttagctgtggatttgtcatatgtggcctttgtgttgaagtacaaactttccatacctaatttgttgggtttttaatcatgaaattatgccacattttgtcaaaggcttttaatgcatctattaaaatgatcatacagtttttgtctttgttaatgtgtatcacatttactgctttgtgtatgttaaaccattcttgcatgcctctgatcccagtgatgaatcgcacttgaatgtagcaagttatctttctaatgtgctgttggatttggtttgctaatatcttgagaatttttgcacctatgttcatcagggatattgtactatagtttcctgtgttgtattgttatctgattttggaattagggtgatgcttgactcatgaaatgagtttggaagtattccctttgcttcagttttctgaaatattttgagaggaattgatattggtttgttaaatgtttggttgagttcagcagtgaagccattcgtttctgggcctttctttgatgaaagactttattactgattcaatttcctcacttattattggtctggtcagattttatgtcttcctaacttaatcttgataggttgtatgtgtcggggacttcgttttttctatgttatcaaatttgatgaaacttgttgaaaaccaactctaaattttgttcatcttttgaaattatttttagtctctatttcatttatttctcctctgagttgaattacttccttacttctaccaactttgggattagtttgttctgttcttttttttctttctttctttttttttgagatggagtttcgctcttgttgcccaggctggagtgcaatggtgtgatctcggctcaccgcaacctctgcctcctgggttcaagcaattctactgcctcagccttcctgagtagctgggattataggcatgtgccaccacacctagctaattttgtatttttagtagagacggggtttctccatgttggtcaggctggtctcgaactcccgacctcaggtgttctgcctgccgtggcctcccaaagtgctgggattacaggcatgagccacaatgcctggccgattagtttgttcttaattttgtagtgccttgaggttcatcattaggctgtttgtcagaaatctgttgtcttttttgatatgggcatttaatactataaacttacctcttaaaactgcttgtgctatgtttcgtaggttttgttatggtatattttcattctcacttgtctcaagaaaaattttaatttcctttttaatttcttcactgacccattggttgtttaggagcattttgtctccatgatttgtgaagttgtcagtttttctcattgttgatttctagtttatttcttttctttctccttccttctttccttccttccttccttccttccttccttccttccttccttccttccttcctccctccctccctccctccctccctccctcccttctgtattgctttgtctcccaggcccaagtgcagaggcacgatcttggcttactgcaatctctgcctcctgggctcaagcaatcctctcacctcagcctcccaagtagctgggactacaggtgtgtgtcactgtgcctacaggtgtgtgtcactgtgcctggttaaatttgttttttgtttttgtttgttttgttttgtatgtttagtagagatggctttcgccgttttgccatgttgcccaggctgttctcaaattgctgggctcaagcaacctgcccaccttggcttcccaaagtgctgggattacagccatgagccactgcacctggcctgatttctagtattataacgctgtggtcagtaaagatacttgatattatcttaatcttttaaaatttgttaagacttgttttgtggcctaacatgtgatctctcctcaagaatgttccatgtgcatttgagaagaatgtgtatctgcagctgttggacggaatgttctgtaagtgtctgctaggtgcatttggtctatggttcagcttaagtccaatatttcttgatctctctgtgtgtgtttgtgtatgtatgtctagataatttattcattattgaaagtgggctgttaaagtctcttactattattgtattggagtttatctctttaggttgaatatttgctgtatgtatctgggtacttaggtattaggtacatgtatgtttataattgttatatcctgttgttgaattgatccctttatcatattatgaccttctttgtctctttttacagtttttgacttaaagtctattttgtctgatatgagtattgctactcctgctcacttttggattctgattgcatggaatatctttttccatttcttcactttcagtctgtctttaacggtgaggtaagcctcttttaggcagcatgtagctgagttttttttccagtcctgcagctactttatatcttttcattagataatttatttacattcaaggtttttattgataagaacttatttctcccattttgttacttgttttctggttgtcttgtagattctcagttcttctttctctcttgtttacctctgtggtttggtcattttctgtggtcctaagctttgttttccttctatctcttgtttatgtatctgttgtaattgctttctttgtgggtaccatggggctaacataaaaagtcttgtagttataataaactattttaagctgatagcaagttaactttggtcacataaaaatactctagacttttttcctccgccatccctaatttatatttttgttgcctttatttctttagtatgtgttccctagccattgtagctgttgttgtttttgaccagttgtactttaaaccttcatctagaggatcgacaggtttacatagtaacatgatatcactggggaattctgagttggatttatacatttacctctattggtgaggtttatattctcacatgtgttcatgatagttatcattttttcatttacagctgtagcactcctgtaaacattgcttgtaaggctggtgtaggagtgaattccctcagcttttgtttgtctgggaaggcctttattctcctccaggatagttttgctggatatagtatcttttgtccttggccgagactcgtttttttttgttcttttagcatcttgaataaattatccctttctctcctggcatacatcagtaatttaatgttactgatgagaaatctactgatagtctaattaggattcccttacatgtaacttgatgcttttctcttgcagattttagaattctctgtcttcaacttttgacagtttgactataatgtgccacagagagaatctttttgggtttaatctaattgggaatctttgtggttccttcatctggatgtctatatctcccccaatatttgggaagtttttagctattatttcattaaataggttttctgtgcctttcttcaacttttctccatctgccagttctataatgcaaaaatttctttgcttagttttttttaaactttgggttatttcacaaaacctattttcagattttgaaattctttcttctgcttgatctggtctattcttgaagctctcgattgtgtcttttattcactgcattcttcagatttctgtgttttaaatgatagatcttgttttaatttctcattttataactttcctgatttcattgggttgtttgtattctcttgtagcctgctgaatttttttaagatcattatttttaattttgtttcaggcattttataaacacccttttctttggggtctgttactagagactcactgtgttcctttggcagtgtcgtgtgtccttgctttttcatgtttcttgtgacatctgcacatctagtggaatagtcacattttccagttgtatgcagtagctttcacagggagagacttttcctgtagatgggtcctagagtgttggttgggtatggtacattggctttggtttggggtggattcagtaccatggtctctgtgtagtttcgtcagctgtaatcttcacagcaatgtctgatttcctcagtggcctaggctgcaggagtttttgatggtggtatagttttgctagggacaggcatgtcatgctagttgtcaggctggacacttgcaggctcggagggctgacaagctgtcttttgggctccccagggaagagaaagtatgattttccagcttttcttctatgtttatttaaaactttgttgtctggctcacagtgttctttatctaaagtctagccagtggtggtggtcatattgcaatcattattacagcttcagactttctagaccttttccattttagtgaccttcagccttcattcgcttccattcatgaccacagaatagatgtagtcatctctattgaaggcaaacccatcccatctcttcagcttcatctagaaatttgtttcatctgttacactttctttctttggtttttagccttcattctctaccagctctttcacttaagcagagatatgttcaagactctcccattctaacagttccctgccttgatcctacaagcttttctctttagctgctaccttgctttttatttttatttttttctcacttgctctgataatctcctagaaaaattggcttactctgaccatctccattagttcacctcttaattattcttcaaccatctgagacctggctttgttctttctctactgaaactcttcaggcagagattagcagaagtcttctaattgctcaatgaagtggaaattttcagtccttattttctgtatttctccttcatttgactttgacttaactctcttggtttttgtaataccaccagcacctagtttatcagtctctcatgggaacttcattctatctgcctgccaaatggtggagtcccaaggactgtggtctgatctgctgttcctcattacatgctttctggtcagtattgcacactgtggttctcatctaccatcatctacctccagaagtgccatatatttagtaagtttacaagaaaagcaactttccttgctccgtagactaactctgatcttttgttccctatcatggttatggaactcactaattattcagcatcagctgtcagaatgtttaactttgctatttaggtttgtgtaagttatgggacaataactaggataactagaattagcttgtagcttatgtgggttagataatacaattgcatatgtaagtagtgaatattttggcttaataagtgaaggagtatttaggaagctatctggaatgttatctaagtcaggattctgaaggtaactctagcctcactgtcccttactcactatttctaaacacccaccaatcctgcctactttatttacttggtatttctccaatctgccatccttctctgtccgaccaatcactaccctagctcaggccttcaaagtctctcacttgacctactccttcacctcctttgaacctgtgcacaaatgttagcttcttagtaaggctttctctggtcacctgtataaaattcccatctgctacatacttcctggttccctgtattgccttatattcctcagtggcatttatctccttgtatactatataatttctgatctctgtcctttctattaccaccccacttcaagatggcaaggatttgtctgttatattagtgactgtcctaataggaaaaaaaatggcacatttatattagagtaacttgagaagaatttttaaaagtcagtatttataaagctgtagatatagagatagtgaagtactcttgggactagtaatcattgggcaggtgataccatttttaagcccaaaagggcatagtgaaagagcaggtgcctgaacctggattcagagagactatgtagaggaggccactaggcaggagctgtggcctttgcctcagcttggctgattacctcactaatcctcactaatcctaaattacccaagttccttcttttctggcccatttcacagtccaaagccaactttaagccagagggcaaggggagcacttgatgcagtccatgcagtatggcctcccagtgaacagggcaggtggaggatagaaactaaatctagatggaggagagggaagatattcagaatatgttttttctttactgtcagcaccttgaagagtgcctggcatatagataatatttattgaatgaatgaatttgttactggtttactggcctcatgaactttagttttgcctattctattataacttggtgactacattcctatatacttgataccaactcctcattaactacaaaggcagtattcccctctccccctttttaaacatcaaaactcttttttaaaaaaaattcttaaatgaatcgccagtatataacacataaaagtatgggtgccttgattggagtggtgggtaaatgatcctgagtctgtctgtttgggttccctctttgcctagcaggaatgtgactgtcttgtttaaagcccactgaagtagaaaacaggatgagagacacactcttcaacatggcataagatttccatgcttggctcctgcctatctctgcatcctcatttctcagtagtttcctcatattttaccatcctgtaattgaaagaattacaaaactagttctctacacaagctttcttgctgttccagctgctgggaattagcttcctttgtgcttttttttatttgaatgattcatgtttacattcattaaaattaatgaagattcattacagttgttttctctttaggcataattggatctcctatactgagacattgaatgcaactttgattgtttttttcccccattatatgttaagctccttgaggttcttttcaactttgcgttattccaggatttctatcgtaagagttaaggttcatccacttctctgatgtgaggttcatggcaggaaggttccatgttgctcagctgcagagtagaaaatactgagcagggcttaaatagattaggatgctgccattataatataaactgtgtttacgaaagagcatcatcaattcagaaaatatctttttcattgactacagtggtgcctgatgatctttctattacaatcttaaattatggtcattttaattatagaatcatacatgggtttatttatgttaaaataaggtaattatcaagctagctgtgacctatgagaaaaatcctgaagaaatgatgaagggatcaggtgactgtttttgaagtcaagtgtgaaaggtcagaccactctgggtcatgggaccctgccaaggcagagcaggtcaagtgctgtgcccagtggggccaacccccagtatggtgccagggactgggtgtgagaagtcaaaaattaagaatacacctcagaaaggggacatggacagatgccacagacttatttgcgtatttcatgatttagcccttagcttgtgctgatactggatcagatattttcagagttcagtattttcaaaagcatcgctgatcacctgttggcattgttttacatctcaaccaaggaaaaacttttgggacatctgtttaacaaggggtaagcttttatttgaaatgttcgattaaagcagaagagtcaggcatttttttgtgcctccccaaagaaagatttgtttactgtcctgtgtgaataaatataatgtcattatttcccgtaaaggaaaagctgatggggagagtaagtaatgggtaagattaggcaatgttaagctcatatattagtatgtttaagagtgatcaatttagggatctctgtgacagagatgccaaatgctcacagtgctatctcatgttggaaacatgtgtctcctccacttttcctcagtcctctgaaatgacggccctttagggattgacagatactatacagatttctgtgctgatatgtgatttgtctaaaacaaaagtttcacaaaacaattcttaccattgccatttaagagtcactctgatatgctctgtttccattgcaaacaaatgctcattatgatttgtgaaattaacttcacaatttcctaatggataacaccttgaagtatgaaaagcactacaggatcttttatagcttccctcctccagctctctataatctgctcccatctgtggtgtaggaaagatttcagcagtggccgctgaaggccctaagatcttgtctcaacagatagcaaggtgcataacagactttggacaggttgtttaacatgtctgagttactgtttattcactggcaaaatgaagggcttatattatattgtctctaagtactatcagttctgaccacctatgaactttcattttaaagaaaatacctatttctatggcctttaggcattagggaattttgtcaaattaaataaatctcagtaaggtttgatggtcaatggggcccactgtctggtgtgtgtggaggggtgttgtattttacatcaggaacttcagagccctcatgaatttctaattagaggaaccacctgggaaatataagtcaaagccctttgctcgccttactcagctttagggcacagtgactagaggtgggcaatcgctttggtgtaggtattgtcattggaaaggaagaaaccattttctggaggaaaagaattggttgaggctagctttaagcagctatttcatgatggacaaaaggactagctcatccattcttcattcgtttctctgtatcctctatcaaatttctgagtaaagattttatacaatgcttgattagcattcaaatagtatgtttcaaagattttaaaaaaaataaaactaggcctttgaatcataattatggcttataactctatttttcatatacttactatctcaagttacaaatttcatgttatgtttttttcaaaagagtattcctgccacaactcagagctcagctgaattagagcagtgactagaaaatctgagaaggctgagcttcaaaataaggtctggaaagtgtttcttattgttacaagagagtcaaaatgattttcttgagctttaagtttatgtaagtatttacttgacacttagcagtttaaaagataatgtgcaaaaatatgaaaatgagaaaaaacaatttcaaaacaagagttggtgattacgtgagacttagtagagcaaagtatattctaagtattaatctgtctaagctgtttgggaacagatgtacgtgaaatggataccgggtgttctgttgtgtacaccccaagtgagacatctgttggtagactgtgtggtcagaaataatggaagcaggggttaaaccccaatatgacctattactcatgtgaattattgaaggactaattactcagtaaaacatgatgctttgattcatcagtctacacgttaagaaaaaagcctctttagaaaaaaatttagttctgtttctaagctgtcaaatttgaggaaatttttaagatgtatgcaaagactcaaatttccatagtaactgcaaatactatctgcttataaagttttaaaatgttttgacaggtctactaatttatcataaaaatagcctcaaaagttttagctttttgttagggtaggttgggtctcacagaaaacaaatgtagagtgaattttctaaagcagggctgtccagttagacttcctgaaatgatgggagtgcactatatctgaagtgttcaatacagttaccaccagctacatgtggctattgaacagaaacatggctagtgtgactgagaaactgaatttttaattatatttaatttttattaatttgaattcaataactgcatgtagcaagtggcaactgcattgtacaacacagctctgacacatggagagttgaaaatgtttgtttactttcttcccaagttttcattttagtctttgtttctacatagaaaggaagatatagcttttgaaaaatgaacctgaatgtagaactgatatggttatgcaatttgagctgcctatttaaagataaagcaactgagtttagagatttcaaagtggcagagtcctttaacatatttcgtgggctggccacggtagctcatacctgtaatcctagtactttgggaggctgagatgggaggattgcttgagcccaggagttcgaggccagcctgggcaacatagcaagaccccatctcagggaaaaaaatatgtgtatatatatgtatatatatatatatatatatatatatatatatatatatatatgcatacacatatatacatatatacacacatatattaacatattttgtgtgtacaaaaaatatttttattatgtgtagattagttggttactagtaaagttgaagtcttgtctatagaaatcattgtatttttcatggtcattgtgatacattgtttgaactgaaatttggcaaattcaatctgtttcttactacaagaatagtacatagatttgaaatggtaactctcttagtctgtgtactctgaccctgtgaacgtctggagactaatgttattcctaaatatgctatgtccacatggcagcatctgaaggcaaacactttttaaaactgatctacttttgtggacccttcctctctctctttcctgcatcccggatggggccctctggggctggaactggcacagaactattcccctaggagtgggttcattgaagccaagggacacacaaattgagaatcagatagactggaccaaggtcattaaaccagagagggcaatccagatggggttgtccaaagtaggaagttctgaagtgaattgcagaaatccaaacatggcaaagctaaaggaatagagaaccagggcaatggatatagagaacagagcaattgggtatgcaggaagatgctattgcctagactggatgtttttgtaccctctgtaatttgagaaaatggaccgtccttgttgaaatggtcagggatgtagtagataaattcattgcagttgtgtaatctcagcactagaatactgatcataaccatatcacttgttatcccacctagcctgccacttgattgggttattagattacatttcagacattgacaagtctacaagcatcattaaaatcctaaacacagacttctgaccgtattcctacccaagttttagaagcactatgccaatgacgggggtagtatatgctgagcaggtgagttttgattgtgtgtgtctacatgtgtacgtgggtgtggtgagcaacaggaaggaactctcagccatgactctaaatgctcttgtgttggccaaaattggtataagctaggaggagaaacacaaaggagagagaggcatgaagttgaaggacattaaaccatttgcaaacttttggcatgcaaaccagaatatgaggaaacttagtgtaatgggtgactgaattcagaggtagacaggcaatcaggaaggtataggcaccaaaaatagttaccattggtgagcgtttttgtttttgtcattggcatggtgttatgaacttatgttaagcctaagggtaagtctaaaataatgtaccagctggcatcagggaattcccatgtacattcctagattttcattagaaacagtgttctggaaactaccactgctgctacacagcagtgcccagtgcttgactgaaaatagtgaacacttagatttgtttactctgccaggttctgtgctaagtatcttatcttgtttaaccttagcaaagaaactatgtagtctagatagaatttttatccctagggcccagaggtgttaaataacttgcccaaggtcataccagtaatttcagttgctggggttcaaagctaggcagtctgactccagagcctgcactgtccccatttggttatgttgcttccccagttaagcaagcaagagtctatctgacatctgagttggtggtagtaaagcatcatggtctgaaccaaaataataaaaacctttgaaacaacattatctgacttctttcaggcttttaagacagttccatcatcaacagcttattccatttctctggccacttccagtttctgaacaaatgaagaaaatgggagtgataaattggagtttttaacaagtttttttaaatctaattttttttatggaaaccaccaaacatacccaaatgtaggaataattatgtaataagtcctcatgttcaaccctaagaggggtgaagctctatgtgacccattactgagtttaaacagttttcaatttatggccagtcttatttcatctatactctacccacatcccttcttcccctggaatgattgaagtaattcctaggcatcatataatttcatctgtaagcatctcagcatgtatctctaggagataaagattttctaaaaaatcatattactactcttcaaatttaaaataatctttatagttttacatatccagttagtgtccagattttcctgatattttctctattttttaaatatgtcaaccttgaaatgaggtccatattatagctgatggctatgccttttaaattttctcatccacagattcttcttccttttttttcctttcaatttatgttttgaacaaactagtttggcctatagtttctcatgggcaagaataaccttcagactgggatggccatcactctgatacccgtaaaggggatgaggcaggttggggaagggagagcctcagaccatgatcagatgtcacaagatttttgcttacctagggtgaggacttgggaaaaagattgcccattaggagtcctgccttgggcaaaagtggccaaacttcagctgtgctgtcacaggctgtgggctgccttggaaatgtaggacctcaactcctctgaagttgaggtggagcttgagggtacgaatccctggtggccattataatgactacactcattgggatggcatggcaagttcatcctcaaagatggatcctagcatccaccatgaccaatgaggtttttttattgttatgatcactataaactcaaggatttaaacctattaaatgtttttcaattcacagcaatgattatttttactgatcttcaaattgtcacattttggatttttagaccaatgggagccccttcatcttgacttctgagttcttttgacattcactcagctgtctgatagcttccctgctttctggaatggcaagatattccaggttcatcttgaacatttcatgcttgagatatggaatcaagctcatcatcagagggtcctggttccttttactggatagtggtattagagacctcaatttgagaactaagcaacatcattgctaaaacttcccctatgtgtaccttgttacttaggtttttcaaagaacagagctagaaaatatgttgggtttttttgttttgtttttaaagaaaaaatgtatcataggattatgctgatacttccaattcaagtgcaggcctaagcttttcacattgtctcttttctcctacccttaaagtcctgattcctaactataacaacatcattactcatttgctttatcctgcattatgtagacacaatagagtaacaacaccaatgctgccaatcaaaagtataattactgaaacccacttaagatagtcctgcaatttttttttttgttcatagagtgtacactactagggaggtgtagtcaaattactatgttttaaagacacttggaataattcatatctgtgaagttatacccccaacttatttgttttttgtattattgtttcattttgcttttgatgtttaggcatttcttttttaaaaatcaattttataattacgtgaaatacttatatggttccaaaatcaaatctactaaacaaactatattctaggaagtatagcttttatgtttcccttctatgcttttccttccttcctgtaggtaggaaagcttatttgttcctcaaagctctgggttgttcttttattttatataaataaacatgtgcatatattcttttcattacccccacagtacccaccgtcttaaacacatgtacaatatatgtgtttttctaccttgatttctttcttacttagcaatatgcccagaagttcactctgtagcgctttacatcagcatcaaaatccattatgtactatcgtttattgacctctctgttggagaaatttggattgtttctagtcatttttgttatcgcaaatagtggtttaataaaaaactttactttccgttttttgtttttcaatgtgcttttaggatagatgcctagaagtgagattgttgagtcaaagaataaatgtgttaataattttgctcaatattaccaaattctttcaaaagggttgtgcaattttgctttttaaaatcattattgtataagggcatgtatttcctgaaaatttctccagaagagtttattgccaaactttaaaaaaacagcctgatacataataaatgatatctcagcatagtttaaatttgcatttttcttgttaaatcattcatgtttttactgtagtcctcctaacatttagggagcaccaattatggggtctctagaaggttccaggattctgtaatcaatttgacatgatttctgtcttcagatattcacaatcttcaggaagatatattgacaaaagaataactacatgatctattttgtgtgcaacttagtacttacagagcattataaatgcacatggaaaaataggtaaaggagaaaatcattctctgttgggcgggctgagggggaagtcaggaaaagctacagagaggttcgagggtaaactttaatgtgggccttgaagtatgatttggagttagcaagacagacaaaggagcaaggaaaccattctagaaaaagaaaattttgaaaaatctccagaaaaggatgctttggcctatttggaaaataacattgtcttatttatgggggagatgacagtgctttgtttttagtcagtagtttatacaggactttgaatagcatgcaaggaagttggcgtctcaacctgaaaattgaggaaggtgtgacaaaggctgggcattaggtgagatcaagtatttctgtttttttttttggtaaattaggtagcaggatagattataaatgggctccacactgaggagcccagtgtgatggctgatccagcagatcagggggcagtggctgcaaagctgggagaatggcaaggtaagcctggatgcaagggatattgtcaaagacaaaatttgggggatgtgaggcttaaaagggaaataaataatggtgatggtgagatttctagcttgggcagtgggatagatagtagacgctgcgcaaattcgtttttaaatcagcagaatgagaagcatcttatttgaaatatattctaccaaatcttagcatcaaatgtgctagtgactagcaaaatatgtaaacagaagggaagtagcttgaaaagtacacaaactggagaaattgctcctgaaggactgtaagttgaacccttttaagcctaagatctgtatttcctatgagccctaggctctttccttgtgtatcctgtttcttattagagtagaggctacttaaaaataatcatagtttaaagcgctctattttcagaaaacattattcattagatgttagtaaataatgtaatctttatacattcataatatttctgcattattggagtgtaaaaagtcagtgaaatagtcatttgtaaagatgtcagtttttatctgtggaaaatagctgttcataccattttaagcttaaaagttcttcatttacttcttaaaatatccatgttggtattattttgtctaatacaagtaattaatatttaccccaaattaagcttttaagtttactaaatgttacaaacataattcaaagcactgtttagtgtccatctgtgcaggaaaaataagatcaatacaattgagcagctgttagcatgtattggtttccttatattttaagtatgttttcatgttttgaaggtgtaaagggatgacagtatgttttgttgtggttttcatcatacagataaaaacttattacagttgaaatcttggtgaacataatacattttaaaatttccattcctcacccatttatctagatatttagacacagtaaaataaataacatggatacatttttgtcatgtgatttatgttttttaaaaagtagaaataaatttctctaaaagttatttttattttttaaatttagcatttttcatatttgaggaaaaaacaatatgtcttggtaccctagcttctgaactaataacacacctgtcattttacaggttattttaatgtttttcattgggatcaaacctactctggaaatatctcatgggtgagctttatttttatgaaatgttcttggcacttgaagacctttgtaggtacatgccagactcatcttacatccagttcttctgcatggaaaatatgtgcattgaaattctaagtgccttttcaaatttgaccttcttagagaataatatgagtcccaacaattaggaaaactatggaatgccttttggcctttacttttcaaagattttcagtcagtaatgtttaattagcattcattgtgtacattgtccttttttgtgtgatatggctagttccaaaggaatattctagaagatctcagccttctgctattgaaggtgataatacactactaagttatgtgttgctttacattaaaataatgttgcagcagttacttattgcttaactagcgggtataggacatcaggttgaaataactgattttgaagtgaagagttcttgtttatatcttaaactaaccaagtatgttcattaactttgagaataacaatgatctttttcattattcttgagtagactggataaatcagaaaacccatgttagaggtccctgtaaaaacttcagtcttatttggtaagtccctttataagagtttcaataaaatcaggtaaatttaaactctgaaaattctacgtactgtctatcatgttcaatttactgttaaccagtactatgcactggaaaaaatttttttcaccttaatgagaccactggtcattactgctgctactgatgctcttttgtctgcacatactgttgcaacataatgtgttgtgcatttgatacggatattatcatattgccataaggagctgctattattttagacaccaactgattccatgatagtgtcagatttctttaacatatgcttatgtttttgtacaaatgaccccaagaaacatctgctagttttgtggtggtatctactgtttcttttttagaatttgacctgtcagtcactttttaacgtgaatctacaatatttgagttgtattcctttctcgtttttatgctattgatattaacaaaattgagtcagttttatggcataattcagagagaaaccgaagctgtctatggatgttattttaaaaatacctttttcatgatgattgtgcctttaaatttttgtcattgattgacactttaaaattgaaaagtgcccttttaatggatcctttaggttccaaaatcttaagttgaaaatttctgtctattggtcctgaaagtactctctgaatttgataagtatgtagtagttgtggtgtatccttggtcagtttatatcctgtgctaattgctaatcttacttagtttctttgatgcgtgtgtgaagacaggcaaagaaaaaggaagtggaatttctacaaaactgtgaaatctttactttatggagactagagaaatttctaagtaaaagaagacactcattctattgtagttaggatcccttcttttacttgcttttcatgatcttgactgaaaagcaacaattgagatttccattgcccgacgctttctcttctgcttttctttttgtttctcttgcatttttaaagacagctatttattcaaaaacaatatgaacttttatttattggacttaaacctggaacatcaacaaaacaaagaacaaacaaaactacctttccaaatttattttattagaggatgctatcaatacaattttgtattatgttcacacttgataccaaacctaaacccaagaaagtgtgtcctgtgttacagcctatccctctgtttaagataataactagaacaatttacttttattttctactcatctgctttctgtgtatcagctgttgtcctccctcagcctcgaagcatgtcatcatttccatctccgtgctcattcagtcatccttgctgctcttagtcccctttttgtcccttgggtgacttatgtcattaggacaaccttctgtccccacttggctgaaactgagctgaggcccttgccagttgcattaggtgtggcacctttcatggctcagtttgggcctctgtgatatctgtgtgccttctactccaaactccattctgccagaggtggcagggtgactggaagctttagtttcagtgacaaaacccaagcgtggctatgctgagtgtctaagtagctttcatttaggcctgaaataggagagtcaggcgcctctgtgtcccctgagaaagagagatttccctcagctctctgggcccagcactcaaccatttaagtcagctggttagtataatttccctaaattgtggtttagtttccctatgagtaggactggagtaggaccaagtaaggaaagtccctagtgacctttctgcctcctgaggagcaggccatttactttgagttgtagcttcccatctgtctgtccccactaccctatccaaggccctggaggagccacaggatgagggaggagattcatggaaaagcgccttcaggtactgggtatgtctggagtaacatttaaagtttaaaagactctttaacaattttcctctgatacttactactgcctatacttgtttggttttagtacagtaagttttgcctatcgtgggggtgaagaaaatagaaatattcccattaactttgtatggtgcttggtatgacaccctgaacaggtgcacccgtaattgtttacttgatgttctttttaataagtcaattatatcatcggaaattgaagaatagcaaagttaatttgtttaatcattctatgggaactcttgcatgctcgttcactagaggaacattgcgtttctcccttaaaggacaaggctttgttttgtttttaataagacacactctttataattaaaacaaaatcccagtgttaagggatttctgttttaaataattggatttctttcctttgttcctctaatccctctatatgagaaaaaaatctaatggtgtcttaggataaatatttttagattaaaaagttctcttaaccactgaaatttaataatacttctcaaagtttatggatgatatagaatgtaatgtaaggttgagaattttagatttggcaaaggcaaagatacaaaaactagtgaaaaacaacaaactggaaacacttttaaaatactgatgtatttatctttgcaataaattattcagaaatataaataaactcactatttacatagttttatttaaatttgtcctcaaaatactaaatttagtactatatattttcttctttcagataaatgctttcctgaaaatggtattttaatatctacagatggtttagtttaacaatggttggggtaaaaatgacatagggaaaagcaaaatgtgacagcccagcttggttacctttagagaaactcagaataaactctattcccatttccttctctttcccctttccatactcgagagcccttttctgagactcttaagtcatgtttgggccttggagaggataaatagcagggtgggtggtaaaaggggagagtgctttgcttgaggcaaagttttcctccatatgggaccttcctcaagccctcccttcaaaccctttaaatgagagcatgagctcctaggacagaggtcatgtggaaagcagcattagcatgaaggggggtgctgtggaggggtgtaaggtgcaaaaagcagcattagcatgggggaaggtggggtggaggggtgtaaagggaatgagatgtgaagtggttaaagggccatttttctagttggcctctgggctttgatgaaccttttccagtgtgcctgtttctccacttagccctgggctaatcttgactcttaactttccaggtgtgtatctatgctgatttctcctgggtttggaagctctgagaagctctggttctagttcaatcacaagacttttaaagaaccagaaaaataaaacaattttttaaaaagtaatgaagaaaagacttttaaagaaccagtgaaaacctgggagtaaaaatatagaagacttgagaaatttcatctttacctttcaagtgggcagcatgagaaattcttgtaaatggtgctttcaaatcttacacaaggttctcagttacctttatttgtactccctagactgtattgcatcccttgctatgttgactaattcccacctaaaataattcaatggcctcccaatataatctggcattctaattaataagctaagaaattatttggtttttcactcattggcgttaaatattcttcagtgcccacatttggaaatattggaacacagaaatgaaaaaagatacaatcagtttctctgcttgccatgttttccttgatatggcaatacgacaacaggtcaccctttgaagaaaattcagagatgctaaagtagaaattaaaactgaagataagtcaaggcaggatagtataggagtctgctacagctgccatagcaaaatactacagcctgggaggcttgaacagaaatttatcttctcacagttcttgaggctagaagtccaaaatcaaggtgccattggggttggtttctgaagagggttctcttcctggctttcaggtggccaccttcatacagcatcctcacgtggccttttctttttgcctgcatggatagagatctctggtgtcttccttgtaagaacaccagtcctattggattaggaccctatgctatgacctcatttaacctaattaccctatttaaggccctgtctctaaatacagtcacactgggggttagggcttaaacatattttaggggaacacaagtcagtccataacacgtgatttgctatagttttcctttacctaaatcttttccaaccttgagagtggattttggccaggtgtggtggctcacacctgtaatcccagcactttgggaggccagggaaggtagattgcttaagcccagaagttcaagatcagcctgggaaacatggcaaaaccccgactctgggggggcagggggagtgggggaattagctgggcttggtggcgttcacctctagtcccacctactcaagagggtgaggctgaggctggaggattgctacagcccaggaggcagaggtcacagtgagcagagatcacaccacttcacttcagccctgggttacagagtgagaacttgtctcaaagaaaaaaaaaagtgggttttattcttccccttaaattcctattaatagtgaggtgaggcttcttgtgttttttttttttttttccaagacaatggttaatgtgtgattacttaaaaatgatatataacactaagaaataaagaattgttaagtgagaaggaacatattaaaatggcttggaaagatgggtaattttttacattttaagtaggttttctcaactctaactctgtggaacttggtcaatctaatcagtctaaatatagcacaaataataatagttatatggacaggagaaatagtagccctcaaagatagtgaaatacatctgaatatcactaacaatgtcatgaatttgcttgttctaaagttttctgaaagtatgaattcataactgagtttttttttttttgcctatgactactaatgtttgaggagagagtagtgtcagaaccacccccccatttattacatgtttatttcatattttggtactgaaatcagtgtttattttgtgtcttcctgataaatcttgccaataagtaattaccttccatactgaaaagttcttaggattaccaggttgctgggggcaaccttaaaaggccatgcagaacattgacttaggtggctattaccctgctttattcaggtctgagcatttactttcctactacaatcagaatactgacctacatttaaaagtgcaacactgccctgttatctaaatccactgtgttcctgagaggaaataccagaaaagagggcaccaatattatttttctgctgttcttgatcataagtgattacctttttttttggttaggcattctgcttctgaaagataactgaggttgaagttaatagaactaagattcttatataaaatcataggaaagataattttcaggattattgaatcatattgaaaaatgatataattgtgttaaaagataaggactaaaatgagttaattcaatttggaaatagttaaattagaatttgcttctgtttttgatgaatactgctttttgaaaaatcttctgagtatttaagcttttactactctagtcattctctctaaagtagacatagaagcgtgttcttatcttgatttggtaaggctctgaaaatgcaaagcaacagatgttgtacccagcataattatatgtatcctggaaacacatctttattgagtgggatttgttcttggggaaacaaaaatttggcaaacaaaggacattaacttgctgatctcagcagtaattacttgggttagattataataatcttgtgtaggtggtaactgcatgcatatattacaaaatctaattctaaaatacgtacattaaaaggaaaatgaacttgcgcaaactttagatcatgtatccccttgaagagcagaaaagatctcaatttcattatttgaaagttgtttgaacagctttttggaagaggtttccaggattccaaatcctaatatgtgtattgatactgaggctttggactaatctttgggggttactgccttttttatgcccactgaaaatagagcatttcaaacaaatgaactgatctctgatctttaagcatgccagtaactctttggaacaaatccatagttatttttaccaatgactgtattaaaacagtactttctgtattatctcttccattccaaggccattttaaaacaccctctttctcttctcccaataggtaaagtacgacagagctccttaggactgggttatggagaattatctggaggtcaatttgagaaccactgtgcaaaccatttcttaaataagtagctacaaggttgtccttacaaaaatttctgaagttgatggtgttgcgttttggagtctgaagcttaaataagagtttgtcagtggtcatggtctaaatagctgattactaccaaggtcatctaatttttttttaacacaaaaaaatgttctgagcacaaatgaaaccttcaggacaagacatttatgttttgagaatgttcttaaatgattcctgtcgtgtatcttattttacatatcttaatgatcagcatgtattttttgttgttgatgatgattttataaatgtgctatcacctagtttctaattcctaacagctccttcatcagtagaatattgctgtagcacagttttgccatctgttaagaaaagatggtgactaataagagtggcacatttcagggctggtgtgctatcgcaacatctagtgttttagtactgaggacagtgatgtatgcagtgttccttacagccatggggtgtgggaatgttttcctcttcggcaaagtctgtgtatttctatagctgaactctcaggatccagaggaaaaccacaagatgatgaaaccagatgattgtcatcaaatttctattccccactacatgattattagttttcgtcaaaagaaatactcatcctatcctgggttggaattggtaaagaattttgcattgtgactaggacacctaaaagtttttaggatgagtacaaatggaatttgatagatttccccaaaatgtttgggaaaagatttattcctccctaggaacagcaagagtagcagcatcacatgaggcaactcctggtaattttttcttcttgctcttatttcaatgatatcttttcattcttttctgtatctctcaatttctatgtttctcctcttaatgtatcctgtaaatttcttagtagaacctttttactaatgagggtttcctagtttgctttaggaggcactcaggatgcccccttttgtaaggcagtaaattgaaaataagaacttggtgaaggtccacgtgacggttagtttccattctccattgtaccaaactgctacagggaaagaaccatatttaatcaacctcaaatcctcaatatttaggtcagaaaacacttggcatagaagagacactcaaattttgcagctaaatagattattgatagaaaatatgtttcttgcctctacaagcaatatgaaaccaatacaatctctaaatatcttcagactactaggggcaaatactgtattataagaataattcttcagaaaggaaaatccagctactctcatatcacctctctatgttgaaagctagggaagataaactggcttccagccagtgagagtccatgtggacctagtgctggctggagatccctaatccaaaggcaagagccagatactggttgtctgctgaaaatcagaagatgacctctctggtagtaaggccagtgactcatccctgcatcttttatcctcttctgatttgtataaggatctctcctttttccccagtacccactctcaagaattgctttcctttttaacatgatcataccaaaatgtatctaacagtaccttgatttcctttctgaggaatttagggagcatatttactttgtcagactcattagaggtttggcttcttggtcgggttcttaaatggacaacttgtttgggtgatttggcagagaataggagaagccagtcccctctgatagagcaaacctggggagctgtggttgacccacctgctaactgtcctgtacaattaggcatgtggcatcagtgggtgactgaccagagccaccatctcaatggcggctgttctttccttcctgtgccttctcagatctcttttttgttcttgttactccactatattggtttttcttgagtttttttcaagcaaatatcattattcacttctactgcagttcctctgttgttcgctttttctcttagtcttcattgttttccattttgaacattcagagatccatcaaaaaaagtaaaataacaggaagggagaggtaaacaccagtcaaatgaagtattataatagtgtattactatactctttaaagtaattgaagggtggttttttggggtcagaatatctgttagaatttggaatttgccactcttgagactggggcaagctatttaaactctaagcttatctgtccttcctcacaatctgtaaaatgggatcataataatggcacccagtttatggtgtagtgagcattcactgacacaattaatctaaacttatttgcactacatagaacagaatttttgtctattaaacaatatagcgttttaggcatgaaagaaactttagattaaattaaatatcatttttcttaccacagggtaagtttctgttttgtttgcccctgtttctctaactcctagaatagtttccagcacatagagattaaacaaatattcgttgaatgaatgaatgcatctattctaatcctcttgttttaggaatgacccgtcaggctcaaaagtgaaagcatttccctcaagattggtgacagagttggggactaaatctaaggctttctcttcctacaccagtgtcctttctgagaacacgatgccattttctcaatatttgtttatttatatggtaaattggtaggaagctgtgtggtactataagaggataaactttgataatgaggtatacttgctatcaaattctaacattctcatttaaaacatggcataccatttgtcttctacattttcatatgtaaagtgaggtgatttctaccttatagaactattgtgaggattaactgaactaatctttgtagagcacctggtcccatttattttttttttttgctcaccccaccccccaactttctagctagataacttatacattcactctgtttttcattccttcttgaatctcctgtggccagacttgacccctgtcactctacagcttactcgtcaaggtcagtcctcatctgacttgacctactaagagtctgacaagtagtcacactatgctccttgatacagctttcttcacctaccttcttggatgtcattcttttggttctcctcctaccccattgggctgctttttcccagtctccattcttgggtattctcattttcccatgtctgtcctctgacttcttattgtctctgtttctgttttctctggttggaccttctctagtttctggcttcaaatactatctaaatgctcatgtctttcaaatttgtaactctagtctagacctctcctctgaattccagttttataaatcttctacttaaatattagaggtctaataaacttctcaaacttatgttctacaacaaactccacattttctcctgcagcctctaaatatgtacctcctatagattttcccatttcagtaagtgggaacttcattattctgattgtccaaaccaaaaacacttggagacttgctacattccaccctttgtctttcattctacatccaacctatcaacaaatcctgttgcctcttccttggaaatatatccacgcttgagcagcatcattgtcaccacttggtgttatacactctcatttctcacctggagtattgtatttctcatctggagtagtgtctgtccaacgatgtcccccatcagtctgttctccatgtagcaatttcgtttttgtttgttttaagattgggtcttactttcgccttggctggaatgcactggtgatcatagctcgctgtagcctttaattcctgggctcaagtgatcctcctgccttagcttctccagtagctaggactacaggcacacaaccacacttgactaatttttttttttttttaacttttactagagatggggtctccctttgctgcccagtctagtcttgaactcctggcctgaagtaatccttctgtgccagcctcccaaagtgttgggattataggcatgagccaccatgtctggcccagatgttaattttaaagtgtacattagagcacatcgttcttctgcatgttcagcataaaatccaatgtccttaatgtagtctatattaccctacatgggctacttgtgcctgatccctctactcttatgtcttatccctctcctgctttctcactagcaccagccacatcttaccgttccttgaacacaccaagtatgcatttgccacaggaccttgatgcttactgttccctttgcccagaaacccttggaaccagctatgtgttaaaattcagatatttactgattttagagagctaaaatggggtatatataatatattacataacactcacagctggtttgtggtagcatttcataattaaataatatttctgaatgaaacattaagaatgcccatgctaagagggatgagtaaagactcaactctcattgtcagttcagctgcagaatgaggtcagctcaagatttgctgccaaatgacttaagaaaaaaatgtttttggagctttggggatttcagaattgcagatgagagattctagacccgtacctacacagcatgctcccttattttgttccaatctttgttcaacgattatttattgggtagtcaaggaagatctctgtctaaaaggcttctctgtgtggaacaagactggcatgtggaaggtttccaattaacgatattgaaagagtgaagctcaaatcatttttcactcaaatacatactatttagaagacagtggccagtttaagaataatcattattggaaacaaagtactatttgattagggatagttaacacaaacacttattagtattagggatatgtgaaatacttaatggatgagtcatgtgctgacataaaacccattatccattttagttcctggtagcctaactggttgaactctgttttattgatctattattgatttggcctgtaacttcaagttacattttaatgtaatttcatccttttctgatcaccttgtgtcttcaagcatttttaagcagttgatagatagttgaaagatattatcactatttcaatctaaaagatattatcactattttaatctacttaaaatttttactacattcattttaagtatgacttatggaacgaatcgaaaatacaagatagtgaaaaacttgtgaggatcacctgaaattttagcattcactttccttacatagaggaacttagtctctctaaagaattatgagtaataaagtatcataatgatatttgtcttagttttggttaagtgtactccacaggagaaagttaggcatgagcaggaattattgtagtcccacattctcaaacagttctccagtaagaaagattttatgtgtttccagaaatcattttcctcctcttcagagctttgggaccataattgtatttaaattgctaatctgttttaaggaatcataataaattgtttaacatttatattcaatcaactttgtaatttgtataaatttttcagggtgacatttgaacaatttttaagaaaatgggaaatacagaagtattcttagttttaatatattttaaaaagatgacatgtgatctactgactgaaatccttcaatcatttttgtttttctccccaagattagatagaatggatgtgattttatttttaatttgcattatggagagtacttttggggggttttatgaaaaagacttcatttattttgttagtggtacttcagttgcataagaaaatgttcttttaaatatagtggtcatttgtgtgcagccttcaagttagcaaacatgcctttgagtagtcactatttttgaaggtctttatatctgattgcaatggcttatattcaatagtcctcctactaaatgaaataaaaatggatgcctcttctgccacagaggcacaggtggacatgttggtagcaagccccatgcggtgtgacacatggcacagcccaacatgggggcaaagagcatgcggcttgagctaggagtcactttatggctactttagtgtagatttgtgtttttctgtggaacagccattattgaagacatttatatagtatgatgtttgtttttcattaaatgctgattgtgatttcttaaaaatagttaagacttgattagcagaacctatttagaagccagagttcccctgcttcacctcttgctatctatataaatgatatttttgactctgtcctttataatgttggcaccctgtgcatattagatgtaatcagggctgaaaggaaacttgaatccatctggaagcaataaacttttctaaaagactgcacagtgttatttaatcctgtgacttcttactgtgagtgaaattaaggtttgatgcagttgtgtcacatcgtattgatatcaaatttatctttctaaaaaaaaactgacagtattacagcacagaggagaagatggcttgctgtaatcctgtaagctattttacattgattacatgctacataatgtacctaagtatataaaatacttgatctagaatgtttatgttttctccaaaattttctcatcaggtaatactttctcaacttcacctttagttttggcttcttatcatagtactaactatgcggtagtaattgtgttatgatgaaaggcatggagaagaaattataattttaaaactattataaagtggagacacacttgtataattaccatctatgtagactgccaaggtataaacatttagcttattttagtatcagactctttgaatcaatttaaggctttttcaataaaattggcttcctctaatttctactccaaaatggttaaaattttgttttacttcaaatacgttgtagggtatcatatttcatgtgactaggagcctaaactatatcagctgactggcataatttgtgaattatatgtgtgtttattaaaatttaaagtttttattaagacttacaattttattaagacttaatttttttccttacattttgagtaagtccaactgaaaataacttagagacttaggaaatttgactacattttataagtaatttccttgtaatttttctttcttgtggaaacaattcttactgatttacttaactcttttttcaatggcaaaaatgaaaaccaaatatatttgtcaactatattcttttaattgtggaaatgaaaggttcatatcccccatttgcctagcatattaaaaataaacatgacctttgtcttgaatgttgttaacttggattttaaaaatcaaaccaattataagctatattaaaattgcttatcaccttccctttgtcttcagtaagtctgggcctaaaaatactcatcatatgaataaataaagttttacaaatactttttagaacatcttgaattatatgtgtgtttgaagcttacttttggatgttcggtcaacaaggcttctgacagtttctttttatcttccctctattccctgccactgtgcaccccaaagtgatccctgaccacagtggtcccattgctggcatcaggaaggtagactgaggagttcaggtatcctagaggctgttaggtgaatctcttctacctctttcctggtcctaggaccactggacacttcaagtaaaaataacaattactttaatctctcaggtaaagtttcttctcccttccagcaacacagatctgcctgtgccgagttcaaatactctgaactttcaacagttgttctgaatacttttttgtcatcttatgatcaaatattgagagcattgaggggataactgaatgggcatggtataaaagtcagacttttagtgtttctaagtagcagaaccctttggacaatttagagggctgtgcgatatcctcaccgtgactgctgggaagtaatgggatctgacctgcagaggtactaccttggctgacaataatgacaaaagtgagagcaaagtacatatgactatccttgaggtcctcaggaaaaaaagagtattagtgagttgaactgtatgtaagggtctttaccaataaggaagcccatgcccagacataatccttacaccctggcaatagaaaccatcattgtggtttacatctcatcctgttcctacagtccagcaagttcaggccacaaaaggtttaagcactttttcctttgttctcatagcaacagttgcccatggaggttcagttacactaatattaacattttaatatacacaaagaagtgcctcgaatgtagtaggtattcaaacttgttaaatgaaagaagtaaactttcagacttaccttgaactactacagttttattctttctctaacctctcccactactaccatcttaaaaccaccatttaattagtattttataacaagttattaaaggctttcaaagacctttgaaccttcaccctctggtaagttaataacttctgatatgcgattaaatgtcaactgagtagtagtgggccctaagagctcagagggactgagaaatgaaggttattgtttagaagagtggctcaatgtgcttcgacagttggttaatatttgaaaagactagagtcaagaaagccttccatgtgctaggaaatgaaggagcaaaggtccagaggtggaaatgtatacagtgtgattaagggattttctgattgatagtaaatacagtcaataaaaaacttttattggaagcctagcctgtgtttgaagcattaagctaggtgctgggatacagagattagagatgaagataatgatgaagatattgttgaagtgaattgctgagaagctggagaaagggccaattaccataatctgaggctcaggaggaattggtgcaaagatcatctggtatgatatatatgaactgtatatacaaactgatctgtgtagctgaactgataatgccaaaaaaaaaaagactaggtttttgattaagatgaatccattaaggtcatgttttctgttggtgccattcttggagacctcccccaaccctatacatttataaatgtttttcctgagggactgagatggaagtggacatataaaaggaaaggtctgggcaaatacataagtaggtagtaaaatcaaggaacaaatgatctcaacaaaattgcccttcttgaaatgaatgaaaatgatgaaagccaatcacattgcatgatgaacttggggtatagaatatgaaatatttaaaattgctttatttcatgatgtttcagatgtagtaggaacttgttgcatagatggtgtaaaaacaatctagtaataaaatcttaggtatttaatacaaggtgaagaaagatgcaatgcataaatcatgccattttaggcttaattttcataaggctatgcctgtctttataagactatataccaggagttctcaagctttttggtcttggaacccttttatactcttaaatcgttgaaaaccacaaagaccatttatttaagttataaccattgatatttgttgtattagaaattaaatagacattaaaaatatttactatttaaaaataaccaaaaagatgggcatggtggcccacacctgtaatctcaacactatgcgaggccgaggcgggtggatcacttgaggtcaggagttcgagaccagccaacatggtgaaaccctgtctctactaaaatacaaaaattagccaggtgtggtggtgggcgcctgtaatcccagctactcaggaggctgaggcacgagaatcacttgaacccagggagatggaggttgccgtgagccgagattgcgccactggactctagcctgggcaacagagtgagactctgtctcaaaaaaataaaaaaaataaaaataaaaataacagtaagttcattgcatattaacataaataacatatttgtattaaaaataactattttccaaaacaatcaaaaaagcagtaccactcttctattttaaattttttcaaatctcccttttctaaaaaaaaaaaaaaaatattgtgtaagtttaaggggtacaagtgcaattttgttgcacggatatattgcttagtggtgaagtctgagaatttagtgtatcttcacccaaataacatacgttgcacccattaaataatttttcaacacccacccccttctcactctcttgagtctcctttgtctatcattccacactctgttcctatgtacacattatttagtacccacttaaagtgagaacatgtggtatttgactttctgagttttttcaactctggcttaatagaagacagctgaaatctcagaatgcttcttcatccagtctgttgtgaatatgttgctttgattcaagtatctaaggaaaatacagttttacacagatgtgcagctgaaaaggaaacatcttttaatatgttcagataattgtggatattgtcctttgatactatagcaaaacttatcaagtgctaatttcttaaaggctggttataatttgaaatctgaaaacatatctatttaattgtagtttgctatttgaaaatttattggtctgtcttgtactttgaatggatattttgcccacgtatgattttataacatcctgtattggccttttggaaaatttggtttactattatacagtttctaaatgttgataatttttattataatatattttaaaaagtctaatgtcactgccagtctcatcagaaaattctttgagattagaaagctgttaagatcatcatcacacttacaagttttacaaaattttaattttactcaaaactttatattttatcattgacaaagctctcagttgctttgcttagtgactgactcactttgttcattttccagaaagtgtttaccaaatgctgctgcctcaataccagagtctgtattgtcagttgatctttcaagtaaaaagtggtgttctatgaaaaacagctagttcagctgcgactgaaatgatataagtgtttctcctggagcaaaccaccacttcgatttgtagcagaaatgctgtatgtatactttccattgttattactcataacatttttaaaaatatactcaagggtggagatttttttaaaaataagtgttattgcttcatcaagaacagttaaatgaaactggattttttaaactgagtttgagttaatgaagaatgcagcaattattagtaaaatttggtgctccaccttgattcatactgacactccaggagttttacccactatttcttttgtacctttagtgcaaatgttaatatggtaggaatggtaaatgacatctttagtattattataaaaatcgtttttaccctgtatactctttgagactacacattgagaattgctgatgaaggtgttttaatttatcataagcactgaaaagatttacttaattcaccaatttctcctgaatatttgtttatataaaacaagactatgtgtatacacctacctttttattaatggtagagatctaggaaaattaatttctaagaactagccaggatatttggaatgtgaataaatcatatatccagaaaaaagctttagaagattgtctatgattgaaagtcaaacagctctcatttctattatactgttctttttcaaagaatttaccaattttatgtggtatttatgattaaacatacaccatgtaatttaacatttttaatgtcacttttacatcataggtattaaagattagcatttttattgtctgtattttaaagctcaaagaataacatttaggctgggtgcggtggctcacacctgtaatcccaacactttgggaggccgaggcaggcggatcacgaggtcaggagattgagaccgtcctggctaacacagtgaaacaccgtctctactaaaaatacaaaaattagccgggcatggtggcgagcgcctgtggtcctagctacttgggaggctgaagcaagagaatggtgtgaacctgggaggcggagcttgcagtgagccaagatcgcaccactgcacttcagcctgggtgacagagtgagactctgtcttaaaaaaaaaaaaaaaaaaaaaaaaatttagatttttgactgtttcattgattcatcttagacttcacatgaaaatatctgtatatcctcaaatgcttacattcttaagaagtatctcagccatttacacatgatagaaacaactaaatggaaaaaaattgcagttggaaattcactattttttatttgatccgataacaatgtgacatttgcgattggactgtaattttctgtctttctctctgaaaataagttcaaaaatttccctctaattcttttactagataagaagcctacttcgttgtaactcttgatatatgtatgtatttaggaacttaagcttttctgctaataaatgttatgtcataattcttgaggatagtattatattgtgatgggttttcagtaaactacaggagcagccctatttgtttaaaccctagtttaacctgattattaacaattaaattgtgttttcttctaacaattaaagtgtgtttaaatttattggtcccttgcttcacagatttatctcagtatgtggtgtattcaaacagaattttgtatttttaattaggggattagataaccaattctgaagagccaaaaaaattgttagacatcacattgcttaaccatctaatataccataagtgtgtgtatacactatgttgtgggagccatctatcaggcaggcctgtttttcaggcagtattttaaaaagtggacatgtgcagaaactgtgagcacaattagcgccaagcagataaatccagctctaatcctgtttacggtctacatcagacagatgtgccaagattgatttagacaagcccgaggcttacagtaatatttttaaaagtgccattcgctgttctatttttgttaaacctttgctaaatattcttaagtcttgttggttttgctcttcttattaaccaccgtaagtaacctactttaagcaggtcccgctttgctctcatggtgacaaggtaacctgccaggagaggttatctttattccctgtaattaagttgacttttccccccaaaaaaatacaacaataggaagtgggtgctgaattaaataaatagcatgatacccagtagatgtatacttaagttccttgcaagaacagatggtccccagtatctctgtaagtaatgtgagaggacagttaatgttctgaaacaactagctataaccagtatgatactaatgaaccagtagatttcaaataataaaccacatgccgccaagcaaaattatatgtcattcataaggatttaattatcataacttgcaaaaaagtgtcaatagatgatttctatatttttatctactgatatcaaatatcaatttatgaatagagtttcacttcatattttttaccaataaaggtatgttttaacattaaggtagaattaaagttatatttaaaatacatgccccaaagtatgtggtgatttttttttaactcctcttttactatactgtctgtatgtattgggctgtatatggaaatgtagcttttacatacaattaggaaaacaattgcttttatttctagcagaaacttgtactataacagaagtggctagcatgggaatcagagtagttatcttgtagatgacaactgaagcagacataaaagatgtaatattttttcagcactcaaaaatttataagtaaaattttataaacaaaaagcagtatttttgtgattcatatggaaaataaaatgagtctgagtcattcttaaggtgataccgtaaaggtgtatagataagaagtccatttttaaatatacccaagacaacagttttttctctcagtatggtttgttttcccttttttctctttaattatgtttcccataagtatttgtatattctaagaatgtccaaaaaataaatgttttgcagtgggggttgaaaagaaagaaagacctttttagatttcagctgatcttatcagatgatctctagaaccttgaaccttcaaccttcactgaagttagctggagggcttttcacctggaaacctgagaaacctcagaagccttctgctttagctctctctcaagtctaggaagccagtggcctgcgaccccacagagccagctggtccactcctcatataagaacttcggtaacaatacaaagacatagcaaagcaccatctaatctgataactcattaaacaatatttagatggctcaagactttaaataaaaacattttaagcttgtttatagaatactaacaagttttattcccaaagactatattcagagtgagaaaacaattttccttaaaactaatattatatacatgttcatatatgttaggaactagttatatgcaaaatcaagtgactcttgtgattagaactggtcacatttattcatgtagcataaatggttaatattgccaaaatgagtaatagatcagattttctatgtgagatattgacacctgagagatttacagtgtttcactgttgtgaaaaatggagtgctgaagaacatttgtctattgttatacatttgtaaaagaattcacaaattactaatttcaaataagaactaaatatttcttctaagcctatagtttttctttttaatttcttctaagcctacagtttttctttttaatttcttcttgtaacattggcaaaaagaccattcgtgtgaaaacctcagattttgatctgtacacaaatgcaggagtagagattggaagcttgagctggaaaagcaggaaatactgctcagagccttacaaggattttcagaattttcactgttgggtcctcctggttgctgcagtctaacctcgcatctccttgaaggcagccccagtttctgatgaaatactcttcagttaatttatacatatgctgtcttgctgttttcctaaggactgcaggcagaactgtggttcacctactgttttaaatttggctagatttaaaaacagatgatctcacttatatgtggaatccaaaaaagtcaaacttatagaagcagagagtacaattgcggttgtcaagagctgggggaggggaagcaaggggatgatggttaaaggtataaaatttcagttagacagaatgaataagttctggatctattgtatagcattgtgactatggctaataatgtatacttgaaaattgctaatacctgaaaatcactaagagactacgtcttaaatgttcttacaacacaccaaaaaaaggtgtgaggtaatgaatatgttacttagcttgattttaatcatttcacattgtaaacgtgtatggtactgatcttgtacctcatttcattttccatatgaatcagaaaaatactgctttttctttataatatcttatacagcatagatacaatttttagtggtcaattatattgtaatatatacataaatatatatgattttcattggtcaattatactgtaataaaacagcaaaaaataaagttgtaattaaaaaataatttggaagaaaaaattagcaagtggttggagattgaggaagatgggaccaataagtcctccaaggagagtcatacattagttttttttaaaagtccattattaatcttataatatttaatatgtttaatttcttgacacttattaatccaattaagtatgagaacactgtggataaatctaaaaaccttaaagttgagtaaaataaaccagatacaaagaagcacatactttatggttacatttatatgaagttctagaaaaggcaaaacttagctatagtaaaaaaatcatggtcctgagggaataactagagagtggtatgagggagctttctataatagtgggaaaattctgtatctttattgggatagtggttatgtgagtgcatatacttaaaaaaactcatggaattatgcccttacaaatctgtaatttttgttggtaatttataccttaataaaaaacaaaacagatgacagggttagtgattgtttccttgaagaaggtctttacatgggtctgttgttaacgagttgtagtaaaaatcatccaaaatgcttggattcaaatcttagatctgttcctaccagatgtgtgaccacagacaagttacttacattccgtcttcagtttcttctcttttaggaaaaagcatctagtttttgttgtagagattaaattagataatacaaatgaagtacagagaacagcgtttggtgtgtaacacatgttcattattagctacccttattttttagagaatggaaatttttaaatttaaactaatcaaactattttaggataagcaagtgaaacaatctttttttcaatcgatcacagaaatattttcactgaagacaaattagacatttatataagcaaactacagtgtcattaccattcaaattttcatatgcatattcatgcttacatgcatatgaaagcattacacatatgtattctataaatatatacaaaacagtaatggaaatgtgctgtactattttgaacatctttctagtcagcccggcattttatttacttttgagacagggtctcactctgttgcccaggcttgagtgcagtagtgtgatctcagctcactggaggctggaggtcctgggctaaaggaatcctcctacctcagcctcctgagtagctgggaccacaggaaagcaccaccatgcccagcttatttggtttattttgtttgtttgtttattttttatttttttgtagagatgaggtctcactatgttgcccaggctggtctcaaactcctgggctcaagttatcctcctgcctcagcctcccaaaacactgcaatcacaggcattagccactacactgacctctacattttaatagctgagtagccttctgttatatgaatatacttttttttaacaaaaccaatactccattattgtacatttaggttgtttccaagtttcactcaaataatgcttgggtaagtaagtatttttatttattattattatttttttgagatggagtttcactctgttgcccaggctgaagtgcaatggtgtgatcttggctcactgcaacctccgcctcctgggttcaagcgattctcctgcctccacctcctgagtagctggggttacaggtgcacaccatcatgcctggctcatttttgtatttttagtagagatgggatttcagcatgttggtcaggctggtctcaaactcctgaccctgtgatccgcccacctcagcctcccaaagtgctgggattacaggccgtgagccaccacgtctggcctggataagtattattttagctaaattgtgcatatttattcccttagagtaaattcctggaagtaaattgctggatcaaaaccaggtatattttaaagaattttccttttctacattaaaaataattataattctgattacaagaaaggaaaattatggagcttcataagaaaaaattagtctcatatttcatacctcatattgcatatttaataggtaaccagtgttaaatttgttgtgtgttttccactgggatttctttttatctcctttaataaaagcaggatcagatccctcagattactttgtaacttgcttttattctactttttcatacctcttagcatgaatgtctttccagaccagaatacagagatttcacttactcatttatgagctgcagaagatgactatgatttattcaaccattctcctattgaagagcatgaatattgcttcagatacttttgttattataaatattagtgcaattaacattttaaagtcttttgatacatattcccaacttgttctccagcaattaccatttttgcattcccaccagcactggggctacttccctttagttgcaccatcatttagcattatttttgatcttgtgccaatctaaaaggcaaaaagtggtatcttgttgttttaatttgcatttctttgattactaattagattgaactttttcatttgttcattggtcaatttgcatttcttcttttgtgaaatgcctgcttgggtcttttatgtactttaccattaaagtgtttttcttgattaaatagattatgtaactgtcatatgttgcaaatatttctgtccatttggcctttgcttatgactttttatgagtctttaggacttttgaggtctttattaggtattcaataattttaatgttaaatatattgatgtctgtcttcctttgtgtcttacggcttttctatttaaggttacgtaaatttctaatatacaaatattggtgtatattatgaaatagggccctatttttctttacaaaagattagtcagttctaaatcatcctttgctatttctagcggcgcttagatgccaccattatcacatcagtgaatttttaaatgtgtaattgtttcctgatctattcatttctctattcctagatacttctattgtaatagctttaccaaatatatctgatagggtgtgtactccccctcattacttcatttatttatttatttatttagagacagagtttcagtcacccaggctggagtgcagtggcatgaacttggctcactgcaacctccgcctcctgggttcaagggattctcctgcctcaacctcttgagtagctgggattacaggtgtgtgccactacacctggcaaatttttttttttttttttttttttagtagagacagggtttcaccatggtggccaggctggtctcgaacttctgatctcaggtgatctgcccttctcggcctcccaaagtgctgggattacaggtgtgagccactgtgcctggccccctcattgcttttaaaacattttcttactgtaatatatttattccaagagaattttcaaatattttatgagattccttgtccattccttacatcaaaaaataccacggagattttgattgaagttctattataagtagttacttggggtggggggaggggggagggatagcattgggagatatacctaatgctagatgacgagttagtgggtgcagcacaccagcgtggcacatgtatacatatgtaactcagctgcacaatgtgcacatgtaccctgaaacttaaagtataataataaaagaaaataaagagaatactggcatggaaaatatgtaatcttggaacttgttgtatctccacttattcaatcctttgtctctcagtagattttgaatggctctttatcccacacgagtctagaatcattttgctaagtttattcctagatataatatgctaattgatatgggaattttttttatctccattataccttcttcttgggtgtagacatatttgtagccagcttcctcactgcatattttttattaggcctaatggcattaagtttattattttggattttacaaaaaaaattatgataacatctttaaatagttagtttcaactcctcctttccccttaaatccatcaattactgtcttttatttcactttccttatgtactgactagaatgcctagaataattgaatgctatgagtaataataggtattcttgccctgtttttggaaatccttctggatttcagtaagtgtgatgttggcttttggtttagtatctttaaatttgcaatttacaagatattttacattggaatagtcattgagttgttaagtaaagcacaaacatgttaaattcagactgaagtacaggacttcaatgaaaagttaaaagagtttatttcatcactttcattttttctttccctcagtggctgtttgtcccctccccccaccccgctccatcccccagcttccttcctttgtgctcttattgttctaggtttgactacataaaaagagactctcaatttatatgtgatacaagaccataactaatattataaaattagtctagaagaagttatttgcaacctatataataagggactaatttcaagattatttgaaggactttaaagattggtaagaaaaaaatagacaaccgtttagaataaggcaaagcatgtgtagaggcaactcttaaaaaaaaaaaagtgagctgggtgtgatgatgcacacctgtggtcccagttactagggaggctgaggcaggaggatcacttgagcccaggagttcagggctgtagtgcaccacagtcacacctgtgaataaccactccattctagactgggcaaacataagaagactctgtgtcttaaagaaaaagaaatgaaaagatattcagtttcattaattgtttgactagctgatttttggaaaatacccacaaatataaccaagcctacaagttattttaaggtgggtaagagatacatcttatctatatgcattcacctatgtgaagcggacacccagtaacacccccgtgtggaagacaagcttccttaaacttcacaggacagtatttcccatgtagtccatcatagggtgaggatttttcaggacctttggtaagcctgcttgctttcattcttgagggtagaggaagggtgcaagacttccctggtctctcccaagcattttggggaccctggccataagcctacttgctcaacaggtgcaaatgactggtaatatgctgaccagatgcaagtgtaccaccaatgatttgctgtgactgagtttggtttcctttgcatatactatccagctttttgtttctaatatattcttccttaagggaaccaggacttcttggggaatccagatgagcttgaaacactgtttttataagagaagggctgttttcaaaaacatctatagttcgtaacaaaggagttagattgaagggactctcactgttcagtctgtgacaagcatgagtgttaaaatggagacaagaattttagttaattgtaatgttgaatttgtaaaaggctataacttcataatatgatcaaggggaacaagcaatctaaaatgtgttaaagtagcattttcaaagtgcggtccagggactctcagggttggtgaggtcacaactgtttttataatattgctaagaatgtatatcactctccttctctccaaggatacggtggagttttccagaagctatgggatatgtggcgatagccttgccctaatggagtgtgtgctttgtgctttgcatttttgtcctttaaaaatgcttggttttaattttgaatacaataattatagatagatataacctacataaaccaaagttatttgcggccctcagtctttaagggtgcacagtggggcctgagactaaagagtttgggaattgatgttctagagaaaagtcagtcttactgatgagggttaatcaattagtatttactgaccgggacaggacaaaccattcattttataaagacacacagagcatttcactaaaatacttttactctgattaagtggtgattttagtaatagtaatgattgtttgattttctgatacctgaaggaaaaagagcctgttgaattgatactttgagggtgttgagttttaggtcactgggtgactgtagaaatggaccaggagaagaactgaaacttgagccttctaagaaatagaagaccaaaaaatgtttagtgttaccctatcccatgaccacaataattgagaaaaaggcctttccgttccctcttccctaccctcccccttctcccctaccctctcctcccccctcccctccccctcctctcccctaccctctcctcccccctcccctccccctcgtctcccctaccctctcctctcccctaccctcccctccccctcctctcccctcccctctcctcccccctcccctccccctcctctcccctcccctccccctcctctcccctcccctccccctcctctccctccccctcttctccctccccctcctctccctaacccctcccaacctttcccctccttctctgtccccctccccctccctccctgtcttcctcccaccccccactccctgtcttcctccttgtcttccatcctcccttccttcctttccttcctgtctttcttttcctttctttcctttttcttctttccttcctgtcttccctcctctccgtctgtctccttctccttgtccccttctctctgtcttgcctttcctttccttctgtctttttctttctttctctttctttttcactcttcctttttttaatttcccttttacttgccttctctctttcattccttccatgctttcttttttttagtggtatgtatactttgtgagcaatcagactatagcttgcagaatagttgggagaggccaaaaatgcccctgagaatgcaagcaaggaacttcttagtgagcatatgaacatcctcactccaatcggaggataacattgttcatacttcaaggactaaaaagctgagagagggtctctgctttctgttacttttagcactcgagtcatttctgcatgtatttctactgattactttttctcctattttggttcatatgttttctgcttctttgcttgtctagtgattttggattagatgagtgacattgtgaattttactgtgcaggatggctgaattttttttctattcctgtaaatatttttttggcattgttctaggatgtagttaagttacctggaaaaagtgacatccttttgagaggcttgcttttaagttttgttaggtggaatcacagcagtctttagccagctcactaaggaccaatactcttctaaatacttaccataatgtcatatgaatttccatgtttttccacttcagctggtaggaacacctgtgtcatctctaagcattgtactgttaattcttctagtagttcttatctggctttgtacatctgctgatcaatactttcagctaaagtctcaaggggacctctgcaaatctacagtgttcactgttcagctttctcttctgtagtaaattgcacagtgaactctagtccccttagccttcctgaacccccagttctccttaactcagggagatcaccaggccccaccaggattcctgtatctgccctgtgacctggagattctctgcaggcaataggttggggcggtcgtagggtccactttgttttcctcctcttcggcttcactgtcctgtgttacctgatgtccaatgtctgaaaactactgtttcacgtatcttgtgtgcttttgtagttttaggtgaaaggtaaaactagtttcttattattccacattggccaaagcagaagttttggaagtctttttttaaggtctaaaacacttctactttgagagtcaattgaaatggtcttttccacaataattattttctgacctatggtttaaagataagtcatgaaaattttatgccactatttttttttaagtctgattatggttaaattcagggggctatttcctcctagattgacagagtttataatgtttcctactcacaataattgtacttctgcttcctctttgcatgtgttactttaatgggaatgtatatttccttttcgttaaggctgccttcaacaatttgtcataaagtcacttctgttagtgaattctattttttctgttactttactctatccttagtaccaaagagctccttatgtgacaccaatttattactaaaatgtcgctttgtttatgttcttggaattcttcatacattgactatcctcagatgtcgaatgttgtaggcctgtgtggcagggactctcttccatttattctatttttaatctaattcttgacaaaataaacccaatttttcttttcttcccctttccatctcacgtagggactggcataaagggcaatccataaaattacaaatgatgaatttttttggttttaactattattcatacatttaagatatggtcacaatttttatttcttactagtaattcattttattttttaacttttaggttctggggtacacgtgcaggtttgttatataggtacatttgtgtcatgggggtttgttgtacagattatttcatcacccaggtattaagcccagtacccattagttatttttcttgatcctctccctttgctcactttctaccctctggtaagccccagtgtctgttgttcctttctatgaaacacaatggttttaattggaaaatttatttttttttcaggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggtaagtactcctcatgggaaattttaatcagcccagtttccttgatatacatgattaatctagacatgttttgagtaaaaacaactttagtgatgttgagatagtttccttctgttcctagtttttgtcgtgagaaagtgttgaaatttgctaaatactttttctacattaattgagataatcatatttttccctacatcctgttaatgtggtatcttatattaattgattttcatatgtttaacatccttgcattccaggaataactccccaatggccatggtgtataatcttttaaagatgctattgaatttggtttgttaatattttgttgagtatgtttgcatcaatattcataaaacatattgttctgtagtttttctgtactgtttgtctgactttggcatcagggtaatactggcctcatagaatgagttaggaagtaactcttgaatgactattttcatgaagaagcttcaataatctgaaataaaatacttaaataatttagttcacctgagagttgtttttagaagcgtatttatttttctattaatgtcttttttgaactatataagaatgtattctccttccactcacacattgatggcaagtgtgtatttgtactctgtggcctgaaaataagatttttttgaataatcttaagaggccatgctttatactctggtaattgagaattacctatttcacagtagctttttctaaaggttaatttccagagaaaagagaacatgtttattaggatatatctcttaatgaattcagtgtatctgaaatttctaaatgacattttcatattttgcatactaaataaaattcataagtacaaatataatgcaattcataagtacaaatataatgcaatttggatttctagaagttatctagttaaaatatgatcttaggatttattttttttgtcttagatttatgaatcttgcttgtttttctgttaattcatttcttcttgtttgctgcatcagtcagatcagagtagaggcagcttgtatagttgatggcacagtttagggttagatggcacaggatagaaatgggtgctagacaaagagcagtcacagaggcatgttagaaatttccagttccagcatcattgatgaagaaaaccatgaggacccaagttgatcaaaggcagccagccaataaagctatgctcatgcgagatgagctgaagtgacattacattaaaattggaagaccctcttactaagtggctccatgcttccctgctagcccctttgggacttccaagaagacttggttatttcaagaagacaagaacccacagaggctgtagtttagtttatctctctggaaacatagagaatatgtataattaaataaaagcactttaatagtgaatcctttacagtgttatttgaaatttatgtcaagtgatttaaaaagtaaaaatgaaaattaataatttcagtggaagtaaattgattaacatgaccaggaatacataaaacttgcatggtcttgtctataaaataaggatatgtcatttaattaggagagtcaaagctcattcttgcgcttaaggtctgaggaactcttctcccatggggcttatgaagggctacactgaggcaacttcctcaatatatctcagccataaaaccaagagaaagtaagaagcagaggacatcacaacaaagctcaattcagtaaaagcaattttataggagtagagggacttgtcaaaaacaaaaacaacaacaaaaaacaatgtccaaatatttattcagcttaatgagtgatgtttttgtttgatctagggttaaaatctagacaaattacagagatgaataaactacatatcctttagtctaccatcctctgaaaatgttactttttgaaactttgattttgataagagctggaggcactcagggagtcattctctggcatggtctttgagtacagagtgattttgctgattaaaagcaaatagattgacttttaaaatcaactcatacaaacaaactgttaaaatcctctaatgagagtgaagaaacctaaccaagactgactgatacattactgctccatctctgcaccaaagtggactcagggaggcctgtaggagatgccaactccttatcctactccccacaaagacagttcttggctatcttcatcagacacaaatgaatggttgaggctccaaagctctctaccaattcttgtgttacactggcacttttaaaaaattttgtttattttttatttttaaatggagtctcactctgtcaccctggctggagtacagtggcgtgatcttggctcactgcaccctttgcctcccgggtttgagcaattctccctgcctcagcctcccgagtagctgggattacaggcacccgccactacgcctggctaatttttgtattacttagtagagatggggtttcgccatgttggccaggctggtcttgaactcctgagctcaggcaatctgcccaccttggcctcccaaagtgctgggattacaggtgttagccaccgcacctggctggcacttctcttaaaactaatatctcaagaagttttttctttaagaatcttctttcaattgcaggtccatgtagttctggtattcattaaagtgcctatcccaggggttttggtatgttgtgtttcaattttcatgtttcaatttttttgatttatgcattaattttgttttttcagaattcaggtgcaggttgtttagtttccatgtatttgtgtcgttttgagaattcctcttgttcttcatttctaattttatttcattgtgacctcagaagacacttgcattgattttgattttttttatcttattgagatgtgacttacgactatgtggtcaattttagagaatgttccatgtacagatgtgaaaaatgtatattttgtgttgttgggtggaatattctgcagatgtctgtcaggtccatttggtcaagagtctgatttaagtccagtgtatacctttgttagttttctgccatggtgatctgtctggtgctgtgagtggggtgttgaagtcccccactattattgtatagctttttttccccataggtctagtagtatttgttttatgaacctgggtgctccaacattgagtgcatatttatttaggatagttaaatcttctggttgaattgaaccctttatataatgccctcctttgtctctttttgatgttgttggtttaatgtctgtttcttctcatacaagtatagcaacatctgttcttttttaattttctatttgcatgctagatctttctccatcccttcactttgagcccatggttgtcattacatgtgagatgggtctcttgaattcagcagaaggttaggtcatttaaaaaatctaatttgccactttatgtcctttaagtggagcatttaggccatttatgttctaagttaatattgatatttgaggttttgttcctatacatttgatatttgtgtattgttaagtagttgctttctagtttgaattgtgtaattgctctataagatctctgagccttgtacttttgtgtgcttatatggtagcaagtattgttcttttgtttccatgtttagaactccttggagtatttcttgtatggcaggtgtggtggtaacaaattcccttagtgttttcttgcctgggaaagactttatttctccttcatttatgaagcttaatttggcagattatgaaattcttggctggcattttcttttttctttaaggaggctaaaagtaggcccctgatctcttcttgcttgtaaggtttctgctgagaagtcctctattagtctgattggatttcctttataggtaatttggcccttttctctagatgcctttcatattttttctttggtgttgaccttgcatagtctgatggactatattccttggggatggtcatcttgtatcttgcaggtgttttctgaatttcttgtatctggatgttaacctctctggcaagattagggaaattttcctgaattattgcctcaaatatgttttccaatttgcttacttcttcctcttctccatcaagaatgccagtaagtcataggtttggttgctttacataatcccatatttatcaaaggctttgttcatttttcagattctttatgtttgtctaactgggttaatttgaaaaggtggtcttcaagctctgaaatcttgtcttctgcttggtgtagtctgttgttaaaacttccaagtgttgttttgttttgttttgttttgttttgagatggagtctcactctgttgcctaggctggagtgcagtggcatgatcttgactcactgcaacctctgcctcctgggttcaagcgattctcctgcctcaccttctggagtagctgggattacgggcgagtgccaccacccccgactaatttttgtattttttagtagagacaaggttttgccatgttggctgagctggtctcgaactcctgaactcaggtgatttacccatcttggcctcccaaagtgctgtgattacaggtgtgagccaccatgcctggcctgcttccaagtgtattttgatgttccctttagtgaatttttcaattccaaaagttctatttggttttatcttaatatggctatctcatgtttcatatcctgcattgtgtttctggtttatttgaaatggattttaaatttctcttggctctcactgagtttccttgcaatacatattttgtttttttagtctgtcatttcaaagttttcaacttggttaggatccattgctatagagctagtgcaattctttggaggtatgaagacactctttttgtagtgttggagttcttgggcagattccttcttatctgagggagctgttgattcttatttttgaatttcctattggttgggcgggacttaaactttttttttttttccccttgagggtatgactatggtgtatgttgtgtgtgatcattcaactttgtttctgggtgctttcagggggccaaggctctttatggattccttgggcgtggtagctttcttaaatgctgcttattgtagcaatgtattggatttgtgagctgacactctatctcatgtggggctgagggtgcagaagtctcaggaagcttattttgtggagtagtgctaagcctttctggtagtgggctttttatttgatagtacagttcaggctgcaatccagtagatggcacttaaaaaataagaaccagcttgccctcagttaggctgatgtccagtagaagcacctgtcctgacaggggagtgacaggaagagattctgttggtgtgtgccgaggcctttggggtcgctggttggggggagatagggggaggtgcactagctcctcatgcaggaatgtgatctgcttttctatcataccccatcagagggctcatgaccttcagttcataaagattttttccttgggttcccagccatagtctgtctgtaggttatgcatatgcccctctgaaggcaaccaccaaaatggtcttggggcagagcctcttcccccagtctagggcagacaactccatgacttgtatgtcctccattgctgggacactgctgctctgtgtagggatggggagttgggccccaccctttatgtaagcctaagtggcattctcactttcagcaggggtggagccatcttgaaaaccatgaaaaactctttcttcgagtacctgtgctggcccccagtgggaagaaccactgctgcgtcttcaacagcgtgtggggtgggagggtattgccacagatgaccccctctccatatccgttccttgacatggtgttgccccctttagcgattggcactgtgcccacctttcctttgtcccaaaggggttttggcaagttgtgtccctctcccttataggtggcctacactaggggggttagatctctagaggttccatagctccctgggaacttgctggccccctgggcttttcaaagtcagaacaggttatgaggtatgtttgctggggatctggtgctacagagactcaagggtagagaatccctgggcagagcagaggcccaccactggtgcacaagcaatatggtgaccaccatctcagtttgtgtctgaggggagtatgggaacccctgcaggagctggccacccagttctctatccctgggaaattcctaaattaccaccaataacattgccctgggtcacaagggtggggccttgaattctttgggggttgatctctgccagactctagctacttttcctttctgcaccccagcttcttcccatgggcactccaaaaggtcctggctctctttccccagttttccattagaaacttgtccatttgacagtaactttgatcttctttctaagaagagctggcatccaaggtctgtggtcagctatgttggaaaaaagaaggagaaaaaaactagtttgtattaaattctgaaagactagtggcactggttaagtctttaaaggattgttaacaaaagaaaatctttttaaaccaaactcctaattttatcagaattgtaactgaaaatataaatgtatgaaaacataggtattatgtaaaatttgctcaataaaagaataggaaaaactactatttatcttggactgatagcatgttagtttgagatttgaaccctttctactctagtaagtagtggtgggaaaaattcactgtaggagtctgcagacataacaaactatcattagactgccaagacctccacataataaagcaagcagagaatgtcaaataagtatgtgaaaaatgatcaaaaaagagaaattgaaaatataaatagggtgctattaaaaaaggatagcatttatgttatgacatatgtacacatgaatatcactttttagaatttcatccttcttaggacttattcctgagtccgaggattgagaggttctgataaaataagtctcagtgggttccaggcatgggctttctttaaaagtctctccagggattctaatgtgttgccaggaccaagtaccatggacagccaagatctcatcagcacagtttgattgaatgaacttatgtagaaccctgaatgccacacttaaccaaagaaacctttccagggattaattataggtgacagaacatgctatattcttattaaatattattaaaagttaagcaatacccattcctgattcatgtaaaattctcacttattttccaagagttttactgtatgactggtttatgggatgcttggaaaaggttgacagacatggcaaaggttcctgcagtgtttctctttgtccatcaacagccctagctcataacctctaccctttcagctaaaagcaattagctcttcagaagtgattcattctatttatacttgggataagtaacatcaggcagtcttccctagggcttctcacgggccctggtggcatttttattctaagagagggttatatttttacatgtaattggtcataattatactaaaaacaagtaattggtgtcttatacaagaaaattatatttctgctttagtcattgacagagtatcctgagaataagagttaagaagtatattcattgtcatcttatttctgatatatttcaaattcttttgctaggaagaagcccttttgactgtgctttgtgtaacaaaacttcttcggagaaacaatttagataaactttgtcagatcttatgtgattatattcaaaatgctaattgaagattctctaaacattttcagtaaaatgttgaattgttttcatgctgttaaataagttaacatgtcttcctttactaaagtcattattataaaaatgtaaatcctaatgataatagctgatgtttattaagcatttagtaggttccattttttgatagcaacttttatgaattatctcattaaatcttcataataatagcatcaagaactacaaatatgttttcatgtaagaagggaaataaaattatgagttttgctgtgaggtttgaagaatgaaaacaatgcatgacttagaaaatagtataattaagtgaattttattatcattatcatctcttagtttataaatgaaaaaactaaggcttacataatgtaaaaatcagttaacaaggttaaacaaccggtagatggtagaggaggagctgggaataaatctgtacatgtctgaatctggagcaggaacccttaactgatgtgtcattctagcaggtcatcagttactctacaatacctattaagtatactttatttactgtgtttagatttatagtagatttagactctactgtaaaaacaaggacttcatacacctgctagaaagtatccatatcatcttgtttgaaagttgtcccgctctagtgttcttttctaatcatgatgattcagaactccaaactcttgaagcagggcaacccgtagggtcagcattcataatttctcaatacttaaaaaagtttcctcatgactgttgctattattgagatttctcaaatgtcttggcctgaattgggtgtgcactatgaaaaaaaaaatggcagacatttctttttgttaaaggaattttaaaaacacatataaacacactgatttgtgacagattaccaggctttatgtttagcagggtttcctaagcaaaacacaaattctgtaaatctacagaattagataaaacattgactcaatccttagatgagagtataatggattatcacttaataacttctgtcactgaaaataaatgatgtaaaaagtaataaagttctactctcacagtatgaataaataggaaatacataatactttaaattaggcaacaaatcattaagcccccagcattcattagactatcattaatgataataaaattgtgtggtatttatacagatattatatgtaactccaggaattttgttataattgtgtatgaatatatttgttgtttgaggcaggtagatggatatttgcagcagctatgtgctgaagcattctggtaatagttttcaaatcaaccatttttttctccttgtcgatcatctttaaagcaaaagcaccgttttttactatattttttgaaaaaaatacattaggtgtaaaattatatattttgaagaagttcactttctgtttttactagtttcacacctttgttattttttcagtggaaggagcagagataggcaaaggcgaagcctgtgtgtgtggtcaggttcctgggcccttcatagcatctgatgccaagctgtgttctcttttgtgtcattgccttcccacttgctaattacgtgacagagctagggacttccctctgtctagaatgccccccatctcttgtttgcctagtgaaatctggtttgaagttcaaggtctgatacaaaccaggtgatcctctgcaaaactaactgtacctgagcaaaccaggcacttactcttttatatgttcctggcactgctgatactctgatagaaaacatcatcacttaatgctaactgtgggctcacaaaggggatacttctactgtaagaagactgtaactcttcttagcacagagattagtaagtacttgaaacagagtttcacatataataagtgttcaataaattttattttttatttctaacacttggcacactgcatagctcagtaaatgttggtgaagtgaactgagtattctccttatctattatgtggtaggcattattctagttgcttctgttataaaccaactcatttaatccttatcacagcacttttattgtggtcaatattttttaatcctcacagatggctaaggaatcagcactctgagagattggttgacttgctttgggtaaggtgcttataaagtggtagaacaagattcctatccaggccttctgattcaaaaatacattctttttttttttttttttagtagtgttttctggaaaggcagggtataactgactatgctgtgtatttgggactaagtatattattgtcaagtatattaaaaatgtcgcaacactggaaaggagtccatcaatgggctatgcaggttgagggatttgtagatgagaaactgataaatttggttagcaaggaaagccatcaagctgtgaaccctttatattggcaaaagagagggtcctttgaaatctaagggaacagaactttcctgttctccaagtttggagcagaataggtaagctctaggcagtctaatgcccaacttttaccagtggtgttttagttttttttttttttccaaaaggaaatgatggaattctttatatacttctgaattgtctatcttttcaaaaataaaaattttcattttgcagtacatacagaatcaaaagactttcaagtcctaactccacaaatgtttattttgaagctctttaaactgtttaccacggatattagtaaatctgtcagaaatgaggtgacttacttatccttgtcccaccagatatgtgggaaggatgatcacgctagatagcatggatgggtcctctatttatctctttttacttgaatggaaaacacatcattcagattaatcaattagtcattgtgactgatagaatttttatatggataatctgggtttggtccctagctttaccacttacttggggtctttatgtcttctatggtctcctatctgtaaagggaagttgataatgccaatctagctaggttactgagatgcttaaatgtgtaatgtatgcaaagcagcaggtactcaataaagggtaactcttactattattgtatagctctccaggtatgtattgagcttctatagaatccatagccccaaactctttagccctttgagaccaagattaagcattgtctttccagaggagagggtgagagagattgccattatactaatagaattcatcattatcaccgtcatcatcatcatcatgatttcttggtgtgtcatggaatgtactgtgtttcacattaccaacagatgttaattttcacaacatccctgagacaagaaactatgattacattttacagataaggtcatgcagctataaagttgtgaaattgggattcaaactcaggcagtctgtccccacagtccatgttcttaacccaccatgctctcctgacacttgaaaagttaggaggcgtactccatagcctgtaatgttgctgcagagagaatctaattttaaatccagtgaagcatattagttgctgtctttgatatgccattcagattgtgctatccttatgatgcctaccttggttgtatatgtaactgggcgtcaaatatataaatactcaaaaagtgataggtgccaataaaatattttatagttaatacttatgtaatctgtgttctctgtgtttgagggctggttctaaaatactgctctatatttgacttctggttaaaacaataaactttgctcatattagttatatagttgataccattctcatgttgctaacatgtctgtaagtaacagttgaaattgatctggcaattttagagctgtcagacccaggagatgagagaaacatttaaaatgtttataacattaaatcagctgagtcaagagagagaaagagaaagatgattcagatttcttgtactggtggatgtaagtgcttggaactgaaataaaggagaaggtgtagggagggagaaagataaagaagtcttccctttatacaagttgaaattgagttttctttgagatatagaggtgaagacattttaagaaacttcttaaaactctctaatgtggcttttcaacctgtttccatcaatttggcacatctcacttttcggcacaacagaatattctaggtttatctcacaccttccttgccccagcccaggaatcagccatttctctaagaaactcttgtttattttggtggggaacagtattgggaaaccaacatctgggagctaaatatactcctagtggttaggaggtcataccttgtagactcttgtagctgacggagttaggacatatttattagaaatcataagtttatattgatcttgctaggatctatccaatcctacaagattcttccctgtgtctctcctttgtatttgtgtatcctttcttccatattaagaactgtggctcccaacaacaaggcatgtgcccatttgcccaatcgtatgatgtataaaaactactttgagaaaagtggcagccaaaccactaagaaaaataaacttgctgaaatgagttcaagatttattggcagctctttttttggcccctagactgaaagtatatatttcaagtattgtgttcaaaaattatttgggttagctttttccacctttcataatagtaatattatttacttgaaatacagttggctttgtttctatattcagtttttttctctctatcttcattaatttcattatatatatttaatatgtaggacattaacatgtttccaaaagaagaaaacactccttcctgtatcatttccacctcatctctcttaccccttataggtaaccaattgcactggtttctagtttatcttacttatattcctatttgaaaagttacctcatatatgtatgttttttaaatttttatacttttttacacagaaagtaacgttcagtatgtactttgccactttccttttaaacttaacagcgtatactggaaatcactccatatcgtgtcacagagagcttccttatattttttaatagctgtataagacttcattgtgttgtctgtaccatattttattcacttccccatgtgtggacattttgactgtttctagtatctgcaattactaataatgctgcagtaaactttgtgcatatcgtaccttggtaaatttctagacatagatttctgggttaaaggttaagcacatgtgtagttttgttagatattgataaattcctttccatggggtttatatcatttttaaaatatttaccagcaacgtataacagcgtccattacttcaaagcctcaccaacagattgtatgttttaagtacttttatgttttagaatttttccaatgcgataggtaaacaatggtatatcaatatagttttaatacattaaagttcagcatcttttcaagttcggctagtctcagggctattcttaatatcttgtgaattatcttcatattattttcccatattccataatacttttggttttttttcctcctcaattctgacaagttctttatatttcaggaatattagccattttatttgatatgttacaaatatttttctcccaatatataacttttctcttataacgatttttttttcatgaaaagtttttaattaaaaccttttatgggcccaggtgcagtggctcacacctgtaattccagcactttggaaggctgaggtgggcagctcatttaaggccaggagttccagaccagcctgaccaacacagtgaaaccctgtctctactaaaaatagaagaacattagctgggcttggtggcacatgcttgtgatcccagctactcaggaggctgaggcatgagaatcacttgaacccagcaggtggaggttgcagtgagtcaagatcgtgccactgcactccagagtgggcaacagagtgagactctgtctcaaaattaaataaatatataaacaaaaccattatgggccaggtgcagtggctcattcctgtaatctcagcactatgggaggtcaaggtggttgaatcatttgcgccaaggaactggacagaccagcctgggcaacatgggaaaaacctctctctaccaaaaaagaaaaaaaaaaaaattagctgggtgtggtagcatgcaccagtagtcccagttactcgggctggtcacatgagcctggggaggtcaaggctgcagtgagcagtgattgtgccattgcactccagcctaggcaacagagtgagaccatttctctaaatacatacatacatacataccttttgtggagttaaatttacacactttttctttattggctctggcttttgcattgtagtaagactttctttacactcaacttatagataaattcacccatgttttcttctagtacttgcatagttgaattttagatctctagtccatttggagtttattttttgtatggtagaaggtattgatcctattttttcccaaatagttgttacccagttgtcccaaaacaagttattgaaaagtccatctttgtcccagatagactggaacaaaatgaattaaagacttaaatatgaagatttttacttgtgtatcctttcttcctagaaagaaaacataggcgtaaagcttcatgacgttgaatacttcatgccattggtctggcaataatattactattatgaaaggtggaaaaagctaacccaagtaacttttgaacacagtacttgaaatatatactttcagtctaggggccaaaaaaagagctgccaataaatcttgaactcatttcagcaagtttacttttcttagtggtttggctgccacttttctgaaagtagtttttatacatcatacaattgggcaaatgggcagatgccttgttgttgggagccacagttcttaatatggtagaaaggatacaccaatagaaatatttatatttaagtctggcaatcatttttaagatgtgaacttgaacaggcaacaaaagcaaaaataggtacgttggattacatcaaacccaaaagctcttcacagcaaagggaacagtcagttgagtgaagagacaacctatggaatgggagaaaatatttctaagccacacatctgacagagggttaatatccaaggtatataaagaactgcaacaactcaatagcaagaaaacaaataacatgaataaaaaatgagcaaaggatctgaatagacatttctcgaaagaagacataccaatggacaacatgaaaaaatactcagcatcactaacaatcagggaaatgcaaattaaaaccacagtgagatatcgcctcacacttgttagaatggctgttatcagaaagataaaagataagtattggtggggtgtggagaaaaaggaactctagcccactgttagtgacagtgtaaattagtatagctgtgatggaaaagagaatggaggttcctcaaacagtttaaagtagaactaccatatgatccagcaattccacgactgggaatatatccaaaggaaatcagtatattgaagagaactgtattttagtgattattgcagcattgttcccaatagccaagataagggatcaatctgagtatctatcaatggacaagtgataaagaaaatatggtgtgtatacacaatgggataccattcagcctttgaagagaaggaaatcctgtcatttgccacaacgtggttgaacctggaggacattagctgagtgtaataagccagccaccaaaagaaaaataccacatgatctttcctatatgtggaattttaaaagttgaactcaaggaagtagaatagaatggtagtgaccaggggtatgcgataggctgagggatcaaggagatgttggtcacgggatacaggatttcagttagataggaggaagaagttcaagaggtctattgtataccatggtgagtatagttaattataaagtatacttgaaaattgttaagagtagattttctgttcataccacaaaatgataagtatgtgagataatgcatatgtaaattggctcaatttagccatttcacaatgtatatatatttcaaaacaacatgatgtacatgataaatatacagtttatttttaattaaaaattttaaactctctaattggtcttcaacatatagtacacaagtcttttcacgactctttataatggaacatatgttcttggaatgctaaaaattattttttttggaggccctgcaaataactaaaaatttatcttaaaagccacacctaattacttacatatgatccagaaaggatactttgaaaaagctttttaattgataaaatcattaaggtaaaacatattcataaaagtgttctctaataattttataattttctagttcatgaaggattaaatatacaactatcatttgaattggattttttatgaggttaattgtatttaaatgctaattattttaactaattttgtggttgacttctatgtagagtagggaaaaagaatttcctaaagccagttacgtatatctctttttagtctggatttttaattaggaaaagtgatatagttaaataggtctactctatagcatcttctaaaatgagtaaaaattcattatatcaggataaaaaatgataaagatatatggatgacacatttggctgaatttttcttcttcgctgttctcttgctctctatttaaatagtcttagctcttttatcatttaaattctgaagtattgaggtgattattccggcagcaggtgattctgctaattactgttcagtcagttttagctattagaaacagagatatgtttacattgctgggctgcatgtaaatttagaagttacatggctttgtttttactttgacttacggcattaaaattattttcatctgtgtatgtaaagatctgcatctataagcttttgtggataataaggtgaaattgatgcattttaatataaattgccaatataaaatatctctaactcagacctctactggaaagttgtcaaatcttatgtaggaaaggcttttaccatcactgttacacattaactgggcatagtttaatattaatagctcctgagacttgtggttaactgaggtttctatttcctgtgtttgggttttatctttgcaacaacttggttgcttttctgtgtaaaatagtggtgaatatacacaagagtatgacaaggttctgggctcttaactttgatgaacaccatgccatttccatcatgctgcactcaaaacagcacagatgtgagtctgggagtggcgtccctgccgctctcatgagcctttgtttggagaacaccctgattaacccccacccttcacggttcattgactcactgatagatcaagtttaaactagtatatattagcacatttgttaccaacagaggaacagttggccattctgttttacattgctggttcattgcaaactggcgtgctaaaaaggtctgtactctagagtatgaattgggaagttaccaaaggactgagaaccaagtcagttgcatattaatgttgaattatacctatattttaatcttggattgtctacttgggggatgcttacactgttgtcaagttatgaataagtgataattaccactttgaaattcatctttttttttcaaggagtttaggggatttaggtgtctcaatatagctttcatattaaacagtttgtcataattggatgagagcagagcaaggtcatgactacctgatgccttgtgttggagcattttaaaaatgttttccagagagttatttgtacctaatgactttacataagtccttacattatactttatttctaggtcacctaaaaatgttaattgtttagtcaagagggttaggatgtgtgtctgttttctcatgaaaaaaattaagctgttccctttttatcaattttcttgcaatctaaaggcttttttttcttaccttcctaacctagtgactaaggtcatcttattgttacagttcctttcatgggagataggtttactgcatcatttggcagtttcatagggtgaattttgtcttggcttcatctttccttactggttgtcatcccctgggccacctgcttttttgcattttcctttctcttgtgagatgatgaagctctgtgccccgatggggatgagagacagcactctgagttcaagtctaggataaggcaatgggcttgcttttcaaaacaaactagtgtcatacgggctgctgctttcaggtccactgtctgattttatcactgatgacttgtttctggaaggcaaactgatttaagttctgagcaaaagggtcggtgtttattttcaatgctactattaatttagagttttaatttagaaaagattttttaccagttctcaaatatgatttttctattgactttaagtttgtagatataaggagtagacatgagatagagactgaattgcttttttgtttttaaaacttggcagtaataaggggttgcttgttttttcatgctaaatattttttctaagggatctagatacctatcagaaaacttaactttgataactctggttctttattaagtatttttgtcttattttaggaattaatagaaatagttgtaattttagacttcctttataaaataccaatttaaagagaagctttttgcttaaatgattgttttgcagtgttgtgcttttgttttctttaatgcagttgaaatcgcagctttataacttattttttaatttggggtttttaaaagaatattagttatttatttatatttattgggcacctactgtgtgccagacactattctaggaactagtaaacatagcagagagcagaatcatgaagttcttgacctcaaggagcttaaatcctagtggtagagggggaattcaaaaaaatcaaataaatgtatttctattatgtcaagtgatggtatgtactaccaggcaatcagatgaaaatatttcctcttctatacacagtgggcaaggaaggcttcattgactgtggagttttagaagaaagctgaaagtaatggggaaagagagccatatcgatatatgaaggaaaacatggtccaagcagaggaaacgaaaagtgcaaagaattgagcaagaaagtcatgttcaagtggagtcagcaggggaaagagtaggtcacaaatgcggctgagggtgggtcatgaagggccttacaagctttgtatgagtttttacttttattctgaaaaaaacaaaaacaaaaacaaaaaaaaccggggagctatttggggattttaatagaaaagtaacataatttccttttaaaatggatatgtggccactaagtggagagagtggtgtatatatgagtggatggaataattgatacaggcaagcaggagacaggttaaatgaaaaatggattaatccaggcaaaagatggtgacttaaattaagctgggagtgggagagatggtgagacatgcttagactttggattcatttttccagatagaactggctgacagagacatgtcatttaccaacatagacatggcagattttttttttcttttctgagacaaggtcttgctctgttgtccaggctggagtgcaatggtgtgaccatagctcatggaagcctcagactcttgatatcaagtgatcctcccacctcaacctccctagtagttgagattacaggcatatgccactgtatccagccaactttttttttttctgtagagacaatatctctctgtgttgcctagggtagcctttaactcctggcctcaagcattcctcctacctcagcctctcaaagtgctgggattataggagtgagccaccatgcctggccaatatggcggttattaagaggataagtcaaagattacatgaatattctgttatgaaaagtgtcaaacatatagaaaatataaacagtattccagtgggcacccatatttttatcaccttgattctacagatcttaacatttttctgtatctgcttcaaacattttattctgccaatgtgttctaaagtaaattgttgatattgtgatagttctctccaaaatgctgcagtgtgtagctctaaaaatagatatttttcagataaccaaatatcattaacctgccaaatcaatgaatgataattgcttattaacatttaatacttggtccatagtcaaattctccatattttccataatgtcttttatagttaacttttaccaactagtgtctgatcaagaatcattcatttaactaattacatttaaactgtaacattacaacatgttttttcgtatgttttattctctctgacattgacttatggaagagactagattatttgtcctgtagacattttatcatacataagagttactaggagagctctgattactagtccccactctcagaaattttgattcagttgctctttccagtgagctgctggtgatgctggactttcattctgaagaccatactttgagcactactgctgtaccactatccgatggcttctttgtgatatcgtttaacttgttgttctgttgcctgtatttcctctaaactgaattttcaatctaaaggcttactgagattcatgtttgatactttgggcaagaatacttcataagttctagtgcttaatgttaggtagcacttaattctgactatttcactattcatgaggctaagctaaggaggtgacagcctgatccttctattgtaatgtttcatgtgaaactactagataatttgttgagttggggggtgggtagggaagagatatctagttttcaataaatatttcacctaatggttttaacacacattgatcatccttgcctgaactaattatttaattagggatggcaacatggagactttctaattcaatctttttttttttttctaaatgaatggccttgtttttatttttaaatggatgttacttcgcaactggggttatttgattacccagaaatatagcgcatattaaaaaggtaggataaatgcttagttaactaattaagcaatttttaattaccagttttcacagtaaggcactaaagtttctgacttgagcaaagataaagtggaaagataaagtggtcgtttagtgagatgggcaagactgtggataggtagactaggtttggtgggaaagtcagaatatcagttttgaatatgttaagtttgagatgtctattagaaacatatgttgacgaggccaggtgcaatggctcatgcctgtaatctcagtactttaggaggctgaggtgggcggatcacctgaagtcaggagttcaagacgagcctggccaacatgtgaaaccctgtgtttactaaaaatacaaaaattagctgggcttggtggcatgcacctgtaatcccagtaatcccagctacttgggaggctgaggcgggagaatcacttgaacccagggggcggaggttggagtgagccaagatcccgccagccactgcacttcagcctgggtgacagagcgagactccatctcaaaaaaaaaaaacatatatatatatatatatatgttgacaatatttcagttgaataaaataaaatattctagctattttaggtagaaaggcattttataccgatactactactaaagggtaagaagatatgactgtagtacattaaatatgctgatggcctacaactgttgctgtgttgctttttcctcttcaccacacatatgcagcctcatgaaacattttccatgaccagcacactgaaggaaataaaaggaacctagtttagagatggttctgcatgatacaacaaaaatgagctgctaaagcattacaatcccactcaagagtattcccccatcaaatagtggggctggtattttaatcagttgatactaattgtcaaggtgtgatggccaagggattgatgtttatcagtgtatggacagtggttcagagtttggtgaattagtcgagttgaaagagaaagattggtgacaaagatgtatgaggtggaaagtatactttcacagaataagaacagaaaatgagatttatgtttttttgtaaacgttcaacaaagaaaattcattcagaggaggaaataggtaggcaagatgccctattctacagatgttagtcagcatcactgcaaagcaacctcagggcttatgcagtggacacttaaaatagcactggtgcagggatgggagaaataaatggatttaataagcactgctgcttaccaaggttgattgaattgccactattgccaagtgttctacctgcaaacagatcaaccttgagccctggatatggcaccatgtcccagagcaaccagccagccacctggtggcaggttgattgcattggatttgctccattatggaaggtcagtggtttgtcactgctgcgatgaatgcttactgtacgtttggatttgcattccctgcccaccatgtttctgtcagcaataacatggccttattaaagccttattcaataatatgacatcctatataatattgcttttgatcaggagactcattcacatcaaaataagtgaggcaattggctgtcaactacaggattcactggtcttaccatgttcctgttgtagcatattgtattctacctggaagatgaaaccttgtgacattaaagtagtttttagttccataaacataatacaggggtctatgaatcaagaagtggaggtagaagtgttgtcttttacttcacatctaatcacatgttcaaaatattttttcatcttgcctctgcaactttgaactttgctgacacactgaggttttagtgtgaggaaacaatactttcacatgggaacatgatagtcgttcaattgaactggacatttagaataacctggccacattactgaactgtataactgaaacaacaaatgaaaaaaatgaagatgctacgctggcaaagatgattaattttgattattgggagaaatagtattgctactgttaggaggaagactatatgtctagaaactaggaggaaacctgggttgcctccttgtagcagggtaaaatgagtgagtaccttgtctaagaaagggaacatgaccaaactgaacccagaagacataggaaatctaaacagatcaattaacaccaaagaaacgggcattttttggtacttctaaaaaagtaccagactgatattttcacagagatgttcgttatacccttaaggaacaggaacagaaaacttctatactatttaaactattttagaggatagaaaaggaaagaaaactccagattttatttatagaacttgcatgaaattgataccaaattctgacaatgcaagttcaaaaaggaaaactagagatcagtgttacttatgtcaaacagctcttaatagaatagatggatatggttatcaacatgataaatatgtttatcacattttaaagcctacatggagaaacatttgaggttttcttattctagaactgacaggaatgtcctttattatgagcactattagtcaaatttttctggtggaactaatgtaagtagactgctgaagaaaatgaatggtatgaacattggaaaggggaaattaaatgattattatttacagataaaataattgttaagctggaaaatccaagtgaataaagggaaggcctacaattaagcagttaaggaaagggctaggtatagaaatcaatagttttgatatatgcaggctatagccagttaggagatcagttaggggaaaaacacgttgacagcagcaacgaaaagctgataaacctagaattgttcaccacttatcttaaaatgtttaacatggtactgagggacacaggagattatttatgtggaaaaacataccatgtttctatacagaaaaattgaacatcacaaaagtattatttgatcttaagataatttatatttaatgcaatctcagtgaaataccaggagaatgtttttaagctagacaaacttatttcaaagatcatatgtaaaaataagcaaaaatagatgtgaaaaattctttaaagtaatgagagaccagtcttattgactattaagtcattataaaactataatgtttaaaagatggtactgacatatgaatagatcagtggatctcagatgggcagtgcagaaagagatccaaacacatacaaaaatttagtacctctaaaggtggcatttaaaatctgtggggaaagatggattttccaatgaataatgttgggataggtagatagccatctggaaaaaatgaaagtcaaatcccaactttttaccttttatcaaaatgaacttcagatacaattgaaaatataaaattgagaccataaaagtattagaagaaaaatgcagtttttaagtctcaaaaggggactcttaaatatcatacaaagcccagaggccataaaagagatgattgataaattcaaatataggtccgtgtaagcgaaaactttcagtatggagaaaacataagttattaaggcaaatgacacactaggaaaagcatttgtaactcataacaagcctagttttcttactgtgtaaagtactgccataattgacaaagaaaatatgaagaattggcaagtgacatacatagaaagttcatggaaaaaataactcttaaacatttacaaaattttacaacctctcatgaaaagagaaatggaaattgaaattagagtcacatacagtatttcacttttcatttgtcaaagatcaaaaagtttgaacatactgtgggtttatgtttataaggatgtaagaaaacaggcaatctaaattccttgtagagtgtaaattggtagtaataagagaaaaatttactgaatactttgtgccaggtgcttttctaagcactttacatttaattatctcaattaacttatccagaaagtaccattatttctgtattacacgtgaggaatttgaagaaaagttagacaagtaattcaaagtcacacagttaataaatgacagagtgaagatttgagaccatttcctttttctcaagtgtccacttttggtcgcaactctgctgtttctgtagtgagtgatttaacactatatgataaaaccttaagagtacgtactctttgatccagtgattctacttccagaagtttgtccattttgcatcaaatagatggagaatagcattcattgcattgttatttgcagtaaaggaagattggaaacaacctgaacatttatcctcaaggactcatccatacaaaagaattgaagtaaattcatccagatgaatatgaggcagctttagatagagtgagatggcatcctatgtagtgatatggagtcatctttaaaatacagtaaaaggaaaaagcaagatacagaatagcatgtagggaagctgctgtctatgtgaaaagctgtagaatatacgtgcatttttgtatatgcatagaatattcctagacaaggacaaacatggtggttcatacctgtaatcctagcactttgggagactgaggcaggtgattcacttgactccaagttcaggatgagcctggccaacatggcaaaaccccatctctagaaaaaatataaaaattagctgggtctggtggtgtatgcctgtggtcccagctacttgggaggctgaggcaagaggattgcttgagcctgggaggcaaaggttgtagtgagccaagatcatgccactgcactccagcttgggtgacagagcaagacaccattcatctctctatctcttttctctctctctctttctctgtctacacacatacacatacccccccacacacatatatatacacacatatatgtgtgtgtgtatatatatgtgtgtatatatatacgtgtgtgtatatatatgcgtgtatatagatacatttctagaaggattctcaaagtgatatcagtgattgttgtgcaagaaggaaactagatatcagtgaatgcgctaaataaggtgattttgaattctgtagcatgtgtatgatttacctatagagaaagcagtctagcatgagcgtgggtttctcaaatatagaatgtttgcagtgaggtcacttggtgaaaagtatagccatgtcagacagatgtaggttcagattccaggacttccaggactgctgaaagggaaaggggctttggatctccttcagctccaggcagcattgctcctttcccagctttgacattagctggagggaagacaagttcttagagctctatgtgcttgggacaagaccccttccccctactgccttactcgccaaccataactgctgcaaacaattcttacctcttccaccccatgtcactgcctaaaacccttcatcacctggcctcccatgcctctaagtctctgtacatcccctagcctgatactgtccccaaccctcctcaactccagacaccattttactctaccctctggaattgtccattattagcaaaatctcctttattttcaacctcctttctaagtatttcccccacattcttgttgtaatagagacacagctttcccaggactgtatagctttccttgcagtcctctaaagtggtaactggtttctctgccatacatttcataccactggtcctggagatattgtcaatatcttaatgtcttccttccatctcacttaaattttgagaccataattcctttttcctctcttaaaagttctcagtgttgaagctcaatccattagatacctctagctggcactactagttgcagtcctgtgcagactactgagtcattttctttactccctgaagacttaaactctatcttactctcactctctctgacattactcctattaaaatgttatgtttctttagctattctttcagtttttggtctcctctccttcaacgaggatgatttctagaatgttggttctcaaaatgtggcccctttgcagacatcgtcagcacctgggaacctgttataaatatgaatctgcagaccacaccccagactactaagcccaaaattctgggggctggagcccagaatctatgttttaagaagcacgtcaggtaattctgatgaatatgccagttccttagatcttgttattgtcattactgacaactttctctgagaccacaatttgaatctaccaatttttcactagtactcacccatcttaagtccttactttccccttaccagccagacatttgaatattccttgactcttctctttcacatactatatccaaagagtcaacaaatgctgtcagctataccttcaaaatacatgtagaatctaacttttaacctccactgcagtcacttcagtccaagcacaaccatttcccacctggagtattgcaactgttcttgtttggtggcccttggccctactttatctactttccgcaaagcagccagagtgtttctttcaacacctaaggttatatggcttcattgattgaaattcaccgtgcttcacctctttctctacaaaagccaaagtccttgtaaatgcctgtaaggctcgagggtgatctgaccttccctggcctgtcgtgtttcggtaaaagtaagctgagtctttcatagttaaaggacagcaatattgtcctgcatgatattttaaaaacccaatcaagaatcacacattgcatttaattttcatgcctttagtctccattaaaagtgtgccctttgtattaataattggagtgatgagggacagagtttaagaatatataaatattttgtccccaactgactgtcactggatggctttggcacccattggtgattcttacctgaatcagtaattattgtgatgactgaaaatagtgatttttctcactgtataattcttctatatttattaattaccttaatattatcctatagaacagaatgttcccttctcatcttttgtttgtttagtgtcagtattactcatgaagttgggtgtttagaaaattcaatgttgtataatactgttattattcaatattgtattttctcagtttgagtcttccatctgcgtcctttcatgtaaatagtataaagatcagtaatagaggaacatagagtaaagtgtgagcagagaagccttactctgagacaaacttcagagaggtgaactctgttgctgattaagaaaggcttcactgaggaagtgttgtttgaagtgagctttgaaaagtcataaaattttgacaaaagtggggatggggtggagcttaaaggaaaaactgtctgaacaaaggaaggcccggcagactaggaatttggcaataatacagtggttttggaccttgatgaggaagttgaaatggaacataaaaaccctctgcatttagctccatttatttgctcaggcagctctcactgcctaaaattttcacccctgctgttttgctcaggggtgggatgaggggtaatgagggaggaaattttagggggtgaaaacagcacaagccaaaaaccctgctcagatactcccttctcttgaagccttttccagatccctaataagaattaaccaccctctctcacacactctgttgtactttgtccttctctgttaaccagcctctgtgttttgtgctgtctgtatttgtggatacatcttcctcctttaaagcacgaatcatatcttaatcccttggcccttcttcccagtacttagcacaagtgctcaatacatgtttctttaacgcgtgtaacagaggaaggcgaggagagtgagtgggattgggagcaggaggattctgaatgtcattttaaggggtttgggctcgctcttcaggcagcaatgagccatagccgcctttgaactgtgcagcactgaccagagctgtgatgccaaaggatgcagtggaaggggaggacagccagcatgcctgggcatggtccccaagtcagaggacatcagtgggagaagggagaaggcatggaagcaagtggctaccatcttatgaatctgagcactcattcaaaggtggcaaggaaaaaggaaggcattgagcacggttttgaggtttccagcctgggtgattggaggctgatgcaggcttcttaccaaaaagggccctaggcagtttcaccaggaatgtttaaggagtttatcatgaccctatctcttcctcgtctaaaactctccctaaaatcaaaacagtatgtcctgttgaaatactttattgtatcaaatataatgagaagtaaaatattctctctacttgatgtatgaaacactgacttcttgtagtggacaattttcacttgtctttttagtaatggtttttattaaaaatagatgttaataactgcttgtttaatctttaaacgtggccctctgagagcagcttaccgtaaaagaaacggttgtcagctttctttttgctcctcagtccctcctgccccttcctaacaacagaaaatttgctttgcacctgctccaactgggttcgaagagataagcatcttgcaagcccagaaaattgtagtatcaaatctcagccccaactgtgaggcagcactatcattgaatccctgctgagaggcgttgctttcccaattcccaaaagagttctttctcccctggccccttttcaggcttgaactctgaccgaaaccctctttttaactcccagcatgcactgcacttggtactgacactgacccatccctgcttcctctgttctgcactggactcatcagtaggtcaggcgttggtagccctggggtcactggggtgcccaattccaataatgagcacatttagctaaggagaggaaatgtacccttctatttgttacagtccattgctttttttccagaaacaaatgctaaaagaacatttgatatattgtggtttggtaaatacacatagcactgcctaatattcacaaagttgcctcttttttttgcatcttccttcataaattaaatatattgttctaactcatgatttattttaagagggatatacctatttcacagctaggaaaatgttttcaaataaagttatattcagaatactcttgcaagaatttcaaataaaaatagcaaatactatttaaatgcatataacattctaacagacttgtgtgtcattttaaagggaaagaaaaaaaatgatgacaaggactttacaactttgtctttaaaatttcttcttaggctttccaaacagaccgaagtcattaaaaatactccttaacccccaaagtcacaaaaaagaagctacccaggtttattatgagaaggttgaacctctgttgaagcttgcaggaataaaaactgatgtaacaagtaagtaattttcagaatataatttcaccatctacaaaaacatacaaaagcaaaataatctgaatttgtccttaatgcaaacttgggaaactacttgtaatatctatagcatttttacgtcttcataacctactgcagccagctcgagggttataatttaattatttttgttatttttattagaatattaatattttctctttagaattttttcagatattttttcagacttaaacaattgttagatataattacaaaggaagctgtatacttgtttacatcttcatggagatgtttgctacttacacgttaattttgcagttaggcaagaaattgattttttgctcacttatatagttgatgtctttccatggaattcttccttgggttgttttcgttctgactctgacccctggtggttaggtcaaaactaagcactgaactgctggttttattaatagatgaatttagagatgctagaagcttaaatttgttgtctaaactaagaaatgtacttaggtttgtgccaaggaaaatagaaacttgttaatgctaaacttaatagatgattagtaatatcctttttgatttttttaatttggtagtcacatttctttgtttctttgagacttattttcgtatggtggggaactgagtagaagagtcgatgctatggagaatcgcaaccttcctagctttatttctatgtggcttcgctaacagtggaaatttgcaataaattttaattgatgaaaagtattataaaataagcctactcaggggacaagcccagagtgcaattggaacttcctagtcccagttatagattcctagggaagggattcacagtgatgtggctttactcagctgtaaacaaaggagataagtttcaagatgttaataatatcattgaaacctacacctagtgatctgatggattgaggtagaagaaagttcaaaaaaaaaaaaaaagcaagttttgtaggaaggtcagcccccatgaaatgtgcctataactatagaggttcgagagaaactaccatgaaaaactcaagaggaatttttgaattaaaataaagttatagtgaagaagttaacctttatgtttgtgaccttcggcttatttagaggtgatttacaagtaaaagagaaaattcagatttatgttttctttctactgaagatttccaaagattggctgaaggaaaagtttgagatttgtattagggtgagacaattaaaagttgaataaacatattggcatactcaatgactattttgttcattgcttttacatgtgaatactacaaagcagcttaacatggatattgctatatagcattcacttcaggaatctcattgtatgcttgctctgtgttcaacatagtgcaggatgcgagatgaataagctatcatacttggatgactttctacattattagagattcaaaaaaatgcttaaaaccattataactggggtatacataaaagaactttgatgtctcagaggtgatattttgatcggaagattcaagaaaagcatttgaactaggcagtttttaagaggcagacaaaaaatgagggaaggaagtcaggctaacaggcatgtactgtaaaagttgggagggggggcggagagagagagtgtgtgtatgtgagagagtccatgtgtgttacacccatacatctggagagtttgtgccataactttgctctactttcctcagtttttacattatctgaaatcttactctatcatcataaaatagctgccagtgaatttcatcctttcttattaatatccagtgggatggggagaggtgtgcatatgtgtgcaagagagacccaacatgctttaatcctgaagatgaattaaaatttccttttttaagtttgggcacagatactgtattagcgcagtcaatctggaataatcatttatttaaccatcaagactcttcccaggggctgaggacagatccccttttcctgatgactgaaatgcctcagctgaatctggattctgttagggagaagaaagggcaaaatgacttctaggaaggctctcaacaatgtatactacaggaggtataattccaggttatggatggatccttaagctgcactcagcagtttactcatcgtgtattgatccacagttggtgtaaatttttttttatcatactgttgcaatctggtttggcaaagatgactccaccagcagaattaaaattaaaaaggaagagagaaaaagagattggagacaagaaaactgatatacaaggcctgaactaaggcagaggaaatcatctaaatgtgctttccttcttaattgtattggagacaaaactattatgttctaggatttttttctctaaatttgtaaatattactaagtaccatatttaaacataaaacaatagaatattccgtaaagcaaatttagaatttacttacatttgtgcagaatggctaattattagctgcctaacactcctcctacaggcaaatttataaaattacatcatttgcttataaaaccattttagtatgcatattggctcaatatttatgaaaaatatttcttgaataaacctgtgaatatttgaaaagttttagtcttcctgcctatcttacagtgttatttttgtagttgaaataatatatttgaaactttgtatattatactacagaaaggtggtcataatactgttagtttcagtttcaaaaattatgtcatagtaagatcgaattcgtactttatttgaaagtatatggaagagtaaagcagaaagaggacatatcttctgcatgtccagtgggacattgttttaatgtatccttgtgtgaatgggtgagtccaaatggaattggaattacaaaataaaccctatatgatgagttaattaggaaatagtgctatataaatatgaagtataatatgaagaattacagctagatatatacactataaggtactgtaattttttcataaatttattttaaaaatggatcttaccacattaataaaaacacacttctttcattttgggttgtgctgaaatcctaactacttctgaatatagatcagcatcttttgaaatatttgtgctaaagttgcatccccactctgctaccaccaccaaggtagtatcttatctaatagcatcagaaaaacttccgggagaacctggaaagaattattttttcctaattacctattcgtacacaaatcaaagaagagtatgaacgataagcccatgctggcatatgatatcatttctcttgcttctgaaacaaagcaagttttagagattgtaccattaaaggtgtgacagatattttgaggatcagagatccataggataattcatagtacaatagagtgaaaaagttaaggcagcagagaaatcagactgaaaagaactttcgaggccatatggttcaatttttctccttgtgggtggagcacaggtgtgtggcactcaactttggcttggccacctacactagaggcagagtacgttgttactggacaatactgtttgacattcttatgaatgttcagagttactgtacctttgggcagattagaaaaggcacctcctctgtgctgacttacaaaaaggtgccctttcttccagactaattcatcctttgcttataaaaccatttcagtatgcatattggctcaatatttatgaaaaaaatatttcatactttcaaaatattcatatttcaaaaatattcagcccaaggtcactagattcagcctaaagtcatttgttagattgcaaatccgtcattcccgttagccaagtacctttgtgctaggcataaactgtacaaaatgagaacttgtcagctgacattcgcctctttgtaatttttatgtactagagttaatgttatctcttgtagtaatatgaaataaatgtgccccatctattgtataggagtcattgagatatttgaagagagatatcctgtctgcccctcatctcttgttcacgataggtacttccatcgccttcagttactttttgcattaacagagctgctagaccttatcatggtcattatcattatcatactcaaagacatttatctgaaggaaaccttgatctctgccagctcagggctcttgggagtgcctagtcaccagataattttacctcctgggcagagttgtcaagaaagtggtgtttgttatcattttccccttctttctcctaaaatcacgcttctaacatggctgttaacaagcctcttcatagtgtttctctggttgtttatggctctacttgaagccttccatttcttggaaatgcctcttgcctttctaaatctcacccagcagaaagctaggccatctaatgaaactgtgtcacaaaagattccagtagcctgaggcatcactccttccaattttacctgcattttaatacaaaatctgaaaagtaaatgttcatgcatcatatctagctagagagaaagataattctgtgtaaaagattctttttgttacctcttaaataattgtgggtgtatatggccagtcctgttcccagcattcagatgtgagttaggaagttggaactttatacctggggacgatgaagactcactaatggggtatatacaaaaaagtgatatgattaaatatgtatctgaaaatggttattctggctagagtgggggagaggtttgagggagacaagataaaaggctattgtagtacaggtggagtatcccttatctgaaaggcttgggaccagaactgttacagatttaggatgtttttagcttttggaatatttgcattatacttaaccacttcagcatctctctaatttgaaaatcatggacacaggaaggggaatatcacactctggggacagttgtggggtggtgggaggggggagggatagcatcgggagatatacctaatgctagatgacgagttagtgggtgcagcgcaccagcatggcacatgtatacatatgtaactaacctgcacaatgtgcacatgtaccctaaaacttaaaagtataataaaaaaaaattaaaaaaaaaaaaaaagaaaatactccaatgagcatttactttgaacgccatgtcattgctccaaaatttttagatgttgaagcgttttggattttagatattctggttacagatacttaacttgtctacacatgaaagatatttagtgatcagatcaatcagctaatttagggaattagctgggagaaatggaggaatgctatggcataatttaaagacagaaacaactggccttggccatggagtggttctggagagtggaggaaagggacactctagaaagaagtcattttcctgtcttggggtagatgatggaacacaaaaagaacaatatatttgagagagaatatatttgaaggtatacataatggattctgttttgagcttactaactttaaagtacctacaggacaggaaagaaaatgacatttcagtatcatatcccacactagaattttatcaccaaaccaagaaatgtttccttatgtccaaatcaaatctcacctgattttatttcaggtgattttctcatcaacattgaatatcaaccttaagactttcttgtcttcctgaggaagttgcatttgcaccaaagaggggagggggaaattcccagcagtgagaattgtgttcaaagacctgtaaactgtgaaggcttcacatctcctatttagaaagagcacaggttggcaatctcataggaaaaggcaaatagatgaaagaagaggctgggttacattttttgaaattacatttatctagcaatcctttctttgtttgtttgtagggggatgatttgaatctggctgtcactgattccagggcccacaatagcctgtctaaatacatatttggtcctttctactatatttaaatagtaatccagatcactctttatccttttgcctaacattgttttgtataaccacctattacttcatattataattcattatttcattagcatatattgtctatctccagaatgcaaattcctgaggccaaagactaattcattttgttcattttgctaatatattttatagatgtagatagtcaggttcttttcattttgtttctttgttctagatctttgattttattggacttttgcaatgttacttaaaaaattgctattttcaggcaggttgcattagtgtataatcaaattccacccacaatatcaaaaaaagactattacaaattaaaaaaataaaaatagcattcaataataacacagttctaaagctcattattggatctgaaaaactttaccaatgtaagctttggtataaaagtaaggcttggtgaactgattcttagcataaatattttttcatgatattcttatttttaatgtgtatatgtaagatgttttattttgcattttaaggttgtaagtacttgctgtagttataaatgaatgatcagcacacatcttctttgataacctttcaactttattaatattaatgtttcatatgtagttttattatggctttcttctgattggaatttaatatagagaggttttattcatgtgagtgttaatggcattttgaataagctatgggagaattacaatgtaacactgctggatacagaatgattcttttagacaccaagactaataatttttaacaatatcgaaaaacattgtaggaaaagcttgaaccatgctggcaccagggacagacaagcatgaaagattaatgtaatcttgcatataatgacacacattcttacacaaaaaatccatctgcaatgtcatgtcagtcagcagaaatctttgatgggtggatacagctgggctgtctcttctggcagagctgccctggaaaatgctaaatgtggttgtgatgcttggtgccatctgcagtgtgcccgtttatcctgtcttcactggcatttacgatactgcatagggcatcagtgactgtggagacagcgatacagagtgacagattcatttcctcggagggtctgagctctggtgggcctgtgtgccaccctccttcttgggtctgggtctcttataattggtgttggctttactttgtattttcacatccaactcttcctctttttagtctaacagttccagtacacattcttctggtttgtaaatcttacactaaccttttgactaatttattcatgtaaggttgccaaaccgatttaagattgactgttcaatgccagctaatatgccttatttccaaaatactgctcctcctaagcctctgatttaaaggacatgtgtcttatttagggaatactaaacaggcaccaggacaaattgggtaaccactatgcgtgggatattcccaaatgactttatgtagttgaaacaaatatatgaccttctcttacataaagctataaaacatcaggccagtaacacttagtcctcttgcccatgattaaaatataaatattcaagaataaatgctgttttatgacttgaccatatgtttatcatattattttgccagaacaagttaaaaagtgtgatcattgtttaaaactgtcactttgtgtatgtgtgtgtgtttttttaatagtaatggaatatgaagggcacgctctgtcactgcttaaggaatgtgaactccagggatttgatgggtaggttatattattaatcaatatatgttatatcatttatgtattaaatgccttcactagttttagctacatatttggaacctaacatttaaaaatatttgtagtgtatgtactttggctctatcttgttcatatctatgtaataataattaatgataatatgacatggtcatctatctctcaggatctggcataggaaagcaaaaagaggaatctaattattaaaatactgggaaatgacagtgtactactctatacttactaatgtgcatacatttgcatctataattatttgcttttaccatatatctagagaagcactaatggaagatgttatactggtcacatggcataactatatgatgatcttcttttgcaaattaattgataggtttaatagctacccattggttaacttgtctgtgatagattgagggaagatattttataaatacaagtaaataaatacattatttccagaaacaataagaaataattttaattatctcataatgtagtgactacaatttaggtatgttattcacagtgggcatcggaaaccattgttcgcaatacattggagtgtacagagattgttcactggcatgcaaacgttagaaccaaggcaagtgatataaatttcattgccattttttaaaattaggtgaaccaatttgctaaagtgttggactgatgtgtaagactaaaacatattatattcctttagggaagttctttttacgtgagtagatatttgagaatttaaaaagttgacaagtgtgtgaattatttgtgttacatggtgatgggcagggggcaaagacccataaggtcaggaaagggagttaggtctgtactttcaccaaagtgaaaggcattaaccttcccaaagactgatttgaatgtgctggggagggaagtgatgcaatcaaaatggagtattggcagggctgtttttcagaaatgcttatttatttatttattttttggatgaggagaaaacaatagctgttgagaaagaaaatgtggtaagtaaaacatgatttttccaaaaggaatctaattgagggaagtaaatctagatagcaatattatataaacattgggaatcaaaaatatggggtaggagattacttcagaactttatacttagaggtagacaaaaacattaataggcttcatttagaaaattgtcttacaagtatacaatttaagaaaagtccttgtgggaatcatgcataccaactacctatttgaatatgctgcatagtccctcactagacctcatgagtacatgaaggtagctgcattgcaaatgagtacctgcttcaaaacttgattaaagaatgagaataaagatatcacagatattaaacttgttcttacacagcagcattacagaatgttctgctgaatgcagtatctatcaatatgttttactggtatttgtactgggtaaagggatgaaaagaactttgcagaatgaagaaagacgattgctgaagtgtagtacaataatatttttctctttacctgaacatatttaatccttatttatttttcatggcaggtgttgttatttttcagtgtagagctaaaagatgtatagatttttcagttattatattttataaaccaaatagtttggcctaaccattatatgaattgagttatgtaagtgtttctaaactctatggcatgctgatttatttcagacttacaataatttcaaatttctactgaaagtcatcttccgtgttctaagactctttaaatcaggggtccccaactccgagactgcagatgaatatcagtcagtggccttttaggaactgggaggcacagtaggaggtgagtggcaggagagggatcatttccgcctgagctccacctcctgtcaggtcagcagcagcattagattctcacaggagtgcgaaccctattgtgaactgggcacgcgagggatataactggtcatgcgagggatctaggttgcgtgctcttgatgagaatctaatgcttgatgatctgaggtggaacagtttcatcctgaaaccatccgtctcccaccccaccctgcagtccatggaaaaattatcttcccacaaaaaagtccttggtaccaaaaaggttggggaccactttaaatagcttatttatttttgtggggtcagttttcccagtagaagctgatatggtagttggagtaattatcttaataaactggcaattttaagtcactgtacttagaattacatagagagatatatgaggagaataatagaaacatagtttcttcaggtacttcaaaggaacaattctcttgcaagtaaaattgtttgaaaatggaatattctacattggtgagttttctattcctgaacctgttctaaagagtggctaaaggaaaattttgggggaaatttatagaaaaggtgcagagatgagagaaggttaaccccaaaatgctatggcattttgatgagagacagactcaaatttctttaagaactttggcctgaagcacctccgtctgacactagtggaactattaatagggagtgattaggaaatcacctaacagtttggtttctagatacaggctgaagaagttaagagccaagaaagattctatgtatagtatttagtaaagcaaaacaatttggtaagtaatgtttaagaaatgctatttcctaagattttggagttgtatttattttttttaatgaattacatatgtttctatgagacatcttgtgacatttctaaacccaacagaaacagtgtatcagcacttatgacagctagttctccactgcagtgtgtcctaggaaacactctaagatccactgttaaaccttatgagagcttcagattctatattgctccctattttactgggcatgagtaggaagttttaggaaggaaaataaaagaatatcagctgcatagacttgaagcagtaacacttgcatttataagtgtgagtatagttttaaaaatctatagattttatgcaattgtaaatatatgaattcctcgctattaatatttgtttcagaatttttaaaaaaattgttgagttacttttcttttgttcatttcaccattaattagacccataatgttgtagacattatttggattatattgacattttatcagattgaacatatctgtattacttagtaaggtaaaaagcaaaaacaaaaacaaacttttccagaaagaaaaaaaactgtgaatcaaaactacaacaatatattgaacatttcatagatgatgggttcatagataagtataaaaacattcattaaaaaaatctttatcactctttgaaaaaggatatattatcacccagtgtttcttttctagacagaataattctgtttggagccatggcaaggagtttacttattttaaaaacaagatttgtcacatgcaaaggattagttactctaaggtttatgttttagagtgacacaagtgtgattaactcactataaatgattgaatactttgctttttgcctttcttgtatatttagactcttgtgatatttttgtaagaagctgttgatgaaaaaaaccaaactgtaaaatatttaaagaggtttattttgagccaaatatgagtgctcatggcctatgataaccccaggggggtcctgagaacatgtgcccacagtagttgggttacaacttggttttatacattttggggatacagaagttatagccaaagacataaatcgataaatgtagggtattcattggtttggcccagagaggcgggatatcatggagctggtgggaaggggagctcacagatgaattcaatgattttctgattgtcagttggttgataagctttgctgaaagattagaagtcagcagaaagaaatgcttgagttaagataaatggggtggtgtaggctgggtgcagtggcttagcagtggctcacacctgtaatcccagctctttagaaggctgaagaggggagatcacctgaggtcaggagtttgagatcagcctggccaacatggcaaaaccccatctctagtaaaaatgcaaaaattagccgggtgtgatggtgtgtgcctgtagtctcagctacttgggaggctgaagcaggagaatcacttgaacccaggagggagaggttgcagtgagctgagatcacaccattgttctccagcctgggcaacagagcgagactctgtctcaaaaataaaataaaataaaataaaaaattataaaaataaagataaatgaagttgtggaagcacaggttcttgttatgtagatgaagcctccagatatcaggcttcagagagaatagatggtcaatatctcttatcagaccttaaaaggtatcaaactcttagttaaatctctcctggatcaggaaaagacctggaaagggaaggagattctctatagaatgcaaatttctcctgcaaatgatagctttgcagggccatttcaaaatatgtcaacaaaatacattttgggataaaatactttgatttcctctagggcctgctatttgttatttaatgctataccagagtcaggttggagttggggatcttattgctaccaagtctgttttgtcagtcttatgatctattttttttttttttttgagataaattctcaccctgtcacccaggctggagtgcagtggtgcaatctcagctcagtgcaacctctgtctcccaggttcaagcaattctcctgccccagcctcctgagtagctgggattacaggcatgcaccaccatgctcagctaattttttgtttctttaatagagatggggtttcaccatgttggccaggatgatcttgaactcctgacctcgtgatccacccttggcctcccaaagtgctggaattgcatgcatgagcctggccaatgatttacatcttaatgccagtgctggccatttgcgcctaaactccaaaagacaagagggtataaggaggcatatccaacctcccttcctgttatgacctgaatagtttttcagattttctttgtgaccttcatggccaaaaggggaggatccattcagttagttggcgacttagaattttatttttgttttacaaaacttatttcctaggttgagtcactttacctgaacatgatcttaatgattgaatagttgttaacataaataaatacatattttttctaactcacttaatttcacactggttctactggtaaactgtttttcaaaataataagattctcataaggctatttttattaggtttcatatatagaaaaggtatctaatatattgaataatattgtagcttctaagaccaaaatgtcttatttcaaatccctgttctattacttactagtggtacaatcttgaaaaagttactttatctttctatgttttagtttcctaatctgcaaattgaaggtaatattacctattgcatacagttatttctccacttaaatgagttaatacatggagagtgcttaggaaaatgtctgatatatatatatagtaattattcactaaatatttctttattgttataattgtcatttgtattagtttcaaaagatttaacacagaatgtattatgacaaaatttcagatgtttcagaacatgctcatagggaggccacctctaataactctagcaatatgttaacatatgcatgacgctataattgtatgcaacattctaggagttaagtgttcgcatcctatgtatgtaagggtcaagttatttggtgctaaattagatttttttgggtatgactccacatagtctttttggtcacacccatatgtcagcatttagacagccatggattgagggttacgtttaagttcacagattagaaatctcatagagatttttgaaatcaggtaagtttcaagtcaaaccttggtttttttcattcataaagatgggactgtggcctattttgcagacttctgaggatttaatagaaattagtaaacacattacctgatatatagtttgtccttagtaaacatcattccttttctctgaataggtggtcatattgcgaacctctggaatcagtttagacataagaataaaacacacctaatcaaacatgacctgggtcatatcttgagtcttctaaccagagtagccttggattgcccaggctatgtggagctagtgggatgaggaagatggggactagagggaatagatggccgagagaaagatggtgggaactgactggaaagacactttcagcctttggtcaccaccctccagagcttcctaaacttagagaaccagtaactactgctgactgtggcccatagacagttttgtttgaaatagtgtttttaaatatattgaatgctagttgcttagtatttacaaattaggagactcagccttaaatcagaatctctggcttctgtagaaaaaccagatctgggtccattaggcctcacacgtgatgtgagtgggccacagcaaagaagtggctgcgcctttagattgagcctactcttccattcctgctgggcccttgtagcccttgagttgtgacacctgctttcactgaggcaaaatccactttccattgggttaactggtgacattttgatacgtaagaatattttgcttcttttgaacataaatgattatgaaatgaatttctggtacttctgtgttattttaatggattctgcccccatagtctacttgatataaagtcttaaaaaatatactagtagtactatctaggatcaaaggctaatagtattacatctagaagcaccgtatagcaataatgtcaaggagatgaaattcaggtcaggtttgtaattactacattcatatagtaatgataattagcagtttcttaaagcttcatattttatatgatttttattgctatctgtcttttcagagctttattgagaattagcaggattttatgactttggttggtgttagttaaatgaattgcagatgacagtattattaacaagaaatgagaatgatatgcttttggatgttaacagagcaaaacgctggtcagatgtgaattaacatgttcaaaagttttcatatctcttaacacacttaaagctattttgtctatggggaattatctagttattatatttgtgaagtaaacttacctgtgttgtgtttgtgttgtcttacccattgacacatattaacatgtttaaaggtacatgtgagcagttatgcacatagactacaaattagtaaactattttgaagtctagatttcatgacttattaccaatcattctgaagttttgccttctttgcttgatttgtatttttctagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggcaagggagtggctacagattcattaaactgacccttctccctcttttcctttcttacttgctaatctagacagcacaacacagaattaatgaacagactttgaaagatccagacttctggcatccccactagcaaatgtgagacttttgacaagtcatttaatctctttgagccttatttttctaatctatagaatagggatcacagatatattattcactttattacaaggttattgtagtactaacgtttggtttagtaaagggtttaatatatagttaaaccatcagtatatggaatggttattattctcccttcgcataaaaaatctgttgattacacagtaccaggtaagaagtttcaaaacagggccactccagtctagctgcttacaattccatatgaggtgaatatggtaacttgcataattgatgtataaccagataaccttgagaatgccaaaattacttgtgactggaagggaggataaggtttggaagggtgagattcttaagggcaaggctttttaatctttctactcactgccatttttcagcatctagaatagactatgccacagtgatgctcagtgaagcctattaagtgaatgcatgtaaagaagactttatatagtaaatgacacttggattaggtcttaaaatgggttggagctggcctgaaaaggtgagaatgagttattttcttggctgcaaaagtaataaagcaaaggcaaaacccaggagtgtttgaggaatagtgaaaaggccattcagtggaagataatggtatcaaaataggcccaaccatggaggctcctacatgccacagtaaggtctctgaattgtatttgataagcagtagggaataatgggatgtttcagagcaagggggcaacctgattggagcttgttccaggaggattcattttgcctcaccgtgtggaatgattagaggttgggagcaggagaaagtagaggtcagagacacggagaaccgttagagcaacactgtgatccagaaaagagggaaacatcattcaaaagctgattgtattacacaatcactcatccctatttaacgaacggtgctgggaaaactggctagccatatgcagaaagctgaaacaggatcccttccttacaccttacacaaaaattaattcaagatggattaaagacttaaacattagacttaaaaccataaaaaccctagaagaaaacctaggcaataccattcaggacataggcatgggcaaggacttcgtgtctaaaacaccaaaagcaatggcaacaaaagccaaaattgacaaatgggatctaattaaactcaagagcttctgcacagcaaaagaaactaccatcagagtgaacaggcaacctacagaaagggagaaaatttttgcaatctactcatctaacaaagggctaatatcctgaatctacaaagaactcaaaagaatttacaagaaaaaaacaaccccatcaacaagtgggcgaaggatatgaacagacacttctcaaaagaagacatttatgcagccaaaagacacatgaaaaaatgctcatcatcactggccatcagagaaatgcaaatcaaaaccacaatgagatatcatctcaccccaggtagaatggtgatcattaaaaagtcaggaaacaacaggtgctggagaggatgtggagaaataggaacacttttacactattggtgggactgtaaactagttcaaccattgtggaagacagtgtggcaattcctcagggatctagaactagaaataccatttgatccagccatcccattactgggtatatacccaaaggaatataaatcatactgctataaaggcacatacacacatatgtttattgtggcactactcacaatagcaaagacttggaaccaacctaaatgtccaacaatgatagactggattaagaaaatgtggcatatatacaccatggaatactatgcagccataaaaaatgatgagttcatatcctttgtagggacatggatgaagctggaaaccatcattctcagcaaaccatcacaaggacaaaaaacgaaacaccgcatgttctcactcataggtgggaaatgaacaatgagaacacttggacacaggaaggggaacatcacacactggggcctgttgtggggtgggggaaggtggggagggataacattaggagaaatacctaatgtaaatgacgagttaatgggtgcagcacaccaacatggcacatgtatacatatgtaacaaacctgcacattgtgcacatgtaccctagaatttaaagtattatatatatatataatatacagccttatgaacatatatatatataaaggaaaattaggcaaaatagcattacttgaggtactcaatagcctggcagagcagacattaagggtaagagagactggacttgaatttcagtttggtacttgactttgggtgggtaattagcctttattagtcttgattacacatttaaaaggtttaataaggccgggtgcagtggcttatacctgtaatcccagcactttgggaggccgaggtagtggatcacctgaggtcaggagttgaagaccagcctggccaacatggtgaaaccctatctctactaaaaatacaaaaatgagctgggcatggtggtgtgcgcctgtgatcccagctactggggaagctggggcagaagaataacttgaacctgggaggcagaggttgcagtgagctgagattgtgccactgtactccagcctgggcgacagagcgaggctgtctcaaaaaaaaaaaaaaaaaaaagtttaataatgtccatccccatagggccattacaagaatcaacttttaaaaagtcacacattatcactaaaaaagcaaaatatttttccctatgattatagaaaataatgcacattgttgaaaaaaattcatattttgataaccctattcatttagtatggattttagaatacttagtattgttgataagttgacagagcataagatattcaaatgcccttttagagtgtaaagtctttcagaaagtcagaatttaaaaggagagagatattcagatataatctgataattctagagtatataggaaaacctaaaatggtttctaagtagaagacaccaagatgattttgactcaaagagaaaaatgatgcattttgggccatcttttcatggcattttatttcttgacctttttgctttactttagtagttctgactataatggtggaaactttccaacatttccttccatgcaaagtggatgtgcttaggacacttcattagtacttaaattcctgaggtcattcattgactgccatacatcagaaatagaaagatgggtgtccctacaggtatgcctttgacataaatttggtggttggctataaaaactggtggttattcttatgttttagtatgtaattcagattttataaagaaatagcatttagttttatcactattataattttgaagagtatttctgatttggggagcattttatgtattctttggatatttgtagtaatgccattttaacctgtcttgtttagaagacacagtatgctgccaaaattctggtcattgcataggagttctagcattctaattccatctaataggaggggaaagtcatgtgtggggtatatttaatatgatgactgtatgcctagtcagggcttttgatagagaatgggaactagaactaggcaggaagttttcaagctgaacatgaggagacagtgtgcctttgaagccatttgcctcctggagagagacacccagagggagagtgtttagtaaattaatccactgagccaacagactaagctgctgaattatggtcagactcaaatggatcagatgtggagaagcctgtatttgaactgctggccattaggaatggtgtttgttgctatgggaactggtgctaaggaactatactgagagactctgattaaaagggggagggggaatggagaaaaaagcctgagaggacataaaaataaaaaagcaatccagttgttgtaaaacaaggctcaagccacatactgatggctgtgaaccatatattcctatagagtttgcataaataaattcatgctttccaattaatttgaggagaataaaatattgccgagggactgttaatttctatgatatttcaggcaaagaaccaaagtgtaggtgccgttttcatgagaattttagatatgcttgactaggaagtcattacatcacatttatctgtttggatgtgggagacattaacagccttatgaatattcatggtatctggttaattaagttaattgttctgcagaagtgcttgcacttccaaggacattttttttttttttttttttttgcctccatagtttctccctggtatttcatcagtaattctttacatgaactgctacttctgtccttacttttttgtatttggaacattttagcagctctcaggaggaagtggtaggcaaagtttctggtagtgttaagaaaaataactttcaggctaattaaaatgtttaccttgaggtagaacatttatagcttttgtgagaacattaaaattacgccattgttatttatgtgagcagcatgttcttttggcatgtagacatcttttcaaatagagtacagtttcctgaaacaaaatgtaatccatctttcagattatcccaacaaaatatagaacaagctatcgttttgcaattttacatatactttctcataaactttccttttttcttcagagtgtcaaaaaccacatttaaagactaagatacagattaatgagtagtcaatgactaaaataattttctgacttctagtcatgtctgttatcactgccaacttctacagaattagagaaaagttgcaaagcctgagaagacataaacaatttttaaagccatctctagcattctaaaaaaattttgtacttgggcatacccaccgtacttcaaactcacagggaataaatggtctttattttcttaagtcatgatatgtgtcattctctattgcacatgacattacattatgttttttaatagcctttctagaggaatgcttttacggtctactcataattaaccatggtaatggaggaaatgtgtttcatggagtactgtaatccatcgataatcctaaatatctgactctaattatgtggcctcctccaaaatctttaccacaaatctgattgggaagcacaatggattgacttgtttcttccttttctcctgatccattccagatttattagcaattagatggtcaaagggcaggctgtagagggccacaagatcattggaaagaccttgataaagatccactgagtaacaggtttctacactacttgttctcaaaacttagggtccatagactcaccttgtgaacttgctaaaacagagatacctgggtcctccctcctccaaacacattctgagtccatgagttggaggtagaacccaggaatgtacgtttttaacaagctcccaggtaatgatgctgcttggaccatgcattccagaggagtttctcaccaagtcactgtgcatacaaaccacctggggatctaataaattgcagactctgaatcagtgtgtctggaatggggcctgagaggcaacattttaaaaataatatattttttacttccattaatactgctattactgttttaatacctattatccttatttttaaatggacaaaaattgtatgtatttattgtgtacaatgtgatgttttgaaacatgtatacattgtgaaatggctaaataaagataaacatgcataaaattgacataatgatcacatactgattttacattgagaacacttaaaatctcccttagaaatttccaagtatataatgcattgttactaactattgttttagcctgttctcatgctgcaataaggaaatacccaagactgggtaatttataaaggaaagaggtttaattgacttgcagttcagcatggctggggaggcctcaggaaacttacaaccatggtggaaggcaaaggagaagcaaggcacattcttcacaaggtggcaggaaggagaaatgctgagtgaagtggggaagagtcccttataaaaccatcagatctcatgagaactcactcactatcacaagaacagcatgggggaaaccacccccgtgattcaattactcctacctggtctctcccttgacatgtggggattatggggattaaaattcaagatgagatttcggtagggacacaaagcctaaccgtatcaactgtagtcactaggttgtataacagatctcttgaatttattccttttacctgaaattttatatcctggaccagtatctccccagtccttcccacccattagccccagtaaccactattttactcttcgcttttatgagtttaagtttttcagattctacataaaagtaagtatttgcctttctgtgcctgtcttatttcacctagcataatgtcctccaggtttatccacgtgttgtaaatgacaggacctctttaatgccaaatagtattccattgtgtatataaacaggctgattgtccctaatctgaagacttaaaatccaaaatgctacaaaattagaaatgtttgagtgccagcatgatgccacaactggaaaattccacacctcatgtgacaggtagcagtcaaagtgcagtcaaacctttgtttcatatagaaaaatattttaaatattatataaaattatcttcaggctatgtgtataagatgtataaaacttttatgtttagacttgggtcccaccccccagatatctcattacaccaacagtgtaaaagtattcccatttctccacagccttaccagcatctattgtttattgactttttaataatcgccattctgactggtgtgagtgtggttttgatttgcatttctctgatgatcagtgatatttagctttttttttatatgtttgttggccacataaatgtcttcttttgagaagtgtctgttcgtatcctttgcccactttttgatggaatttttttttcttataaatatgtttaagttccttgtagattctggatgttagacctttgtcagatgggtacattgcaaaaattttctcccattctgtaggttgcctgttcactctgatgatggtttattttgctgtgcagggattgttttcttgatttctttttcagatagttgtaagtgtacagaaatgctactgatttttgtgtgttgattttgtgtcctgcaacttaactgagtttgtttattagctctgacaattcattcatggagcctttagggtttcctaaataaataagatcatgcctacaaacaaaggcaatttagcttccgtatttatgatttgcaagccttttatttctttctcttgcctaattgctctggctagaacttccagtactattttaatgacagtggtgagaatgggtattattgtcttcttgaggaacaagacattgtttctcaactcatgagagtaattttaataagcactcaagtattgtcattcctgtttgacagtaggccgtattttgagtaacaagggtcacagcataacttgccttttggtgaatcagttggaaccagtttgccatttagttaaaataaacttttctttgcactggtattactagaagtaattgtgcttatttataattaataataattaaatatgcttattcttagttacctaaaaaattatgatattaatgacctcttggttgataatggctaagctgcctcagcttctccaatttagcaacccaagtacatatcagttcaaagtaacacaaattgaagcaattatgtatgatcacataggaatgcttctgattaacaaaatccagaggactggtctttgccttcataaccggaacacaccacatgcatggtttcacagctcttggctattattggacttacttattatattctttaattcaagaaaaattgtagcttcattcattctgttcttaataattttaaattctctttagcctcctgggaatgggaagggctagctggtatagtcccctgtatctcagatttcagttacacataaacattaaaggggcctgacttagggcgctctttgcctctgtggactggtggggaaaatccaggtgtgtcttaaattctaataatcatgaaaatcagaaatcataatgtttcaaatacaaatcttcatacatgggaaatacaattgaattaaacattttcttcaatgtaggagacatttgtcagataacagaggggattctcatttggctaagagcttacctctaagattcattaaatgtgtttagagcatattttttgtagtttgtagttattttatttttctgagttattatttggattattttctcttttatttatgtatgcatttgtcactgctccccagaggcacctcattttggcattgaagctaaaaacccattcattaaggttgggatggagtgggctttgatatagctagcatttgggaggtagaaaatagacattcgtgatcaaaaaagctgtaagcggttactataaactatttttaaatttctaagtattttaaatattgaacaaatgtgtagacatttgatgtgcatctatactgtgaataagaacttaaacttctaatattcacattaactttcctgattttataaattctcgtttatttttcatctgaacattgaagaatgacatctacataaagtaaaagcaaatgttagtttgaacacattctaccctaatagtgcatgttttaaaattgctttggcaggatctaccaatgtattggcacattctcttcatggagttcctcatgtgataactgcaacattgcacattataatgggtaagaattcttccaaagcagttcatattttataaggaaatgttgatttatataaggaaggccatcttatttccatcagactttaagaaaaggcaggttctttgtctcttagagtagagaaatgtttgactaaaaaaccaaaaggcaatgctttactatgtggattgcctgtcttttcaaaatacttgctttgtaaagagcagtaaatgaagttttattgtaatctgtacagaaaaaaaatattgtagtgtgctcaaaattataattttataaccagatgaagaacattaatgaatactccttaagtatatccaacactgatgtaggactgtaccaagactctaggactaggattatgttattaatgaaaaaacataaccagaaaaaaatttcagccagtagatgtctatagatattttattatccctattggtaaaaagcatataagctcaggtatatgtaacactaaactactgttaaatctgtgtttaccttgcctatctactttaacttcgtttctttgaccatgttttataggaaatagcaataagctgaaaaatttagtactctgtgtttcttcactagtacctgaacaagttaaaaatggtaattattgtagttataggtaaagggaactgaagagaaagtgaggatgttcatggtctacagtacctttagatattctcctataagccaataaatatgctctcttatgtttgctgttttgatacaagtcctactgtactcactgattaatatttaatgtaatattcaagggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaagtaagtctttttcttaaaccaaaaattgtatcccaggttcaatgactgttaataacaaatttcattacattttagggcagaagactgtgaaatatcatttttaccatttaacagctctgatgatgtgcaagaaaggtaggtaaaaactcaatgtaatacagataacctgtatctttaaagcataaaacattctgacaaacaattgatcagacttaggatctttggttatttttctaacatagtagtaaagaatatagaatcacagactcttacaggtcctagtaagcaaacaactactcactcagcctttttctctttttccttccttctttcctcccttccttccccctgtctctccctccctccttccgttctctttttcccttcccttcccctttctttcctttcctttgtttttttccctttctttccttttccctttcccttttcttttgagtgcctactatatgccaggcactttgaatacaacaatgcaccaaaaaatgaacaaaacacacagttttgtccctcgtgataattttggtctagtgtgtaatacaaatattaaagccatattaaagaagggttatagtctttaaagaaatagtacattattattccttataatactagtttacctttaaatgaatcaacacattatgttggcagcaacaaaattgtacgtttttacttactatctaattgaagaaagtatttaacatatataatgatgagttctctaattttctcatatttaatagatttgtgtgtgtctgtgtgtctgtgcgcgcgttatctgttttatgtctttgttttgttttctttcttttaggagggcacagggatctcccaaatctggtgagtcgaaaagtatctccttgagaactgtgccaggttctgttgacattttgttctggtgagggaaaataaccaatcactttcattacctttagactgtaatgatcaatggcaaatgatccagggtcagttcttgaatgtcagcattatggcaattccttgcctgtgttcagtggcacctagaggcttggcacctaataccaggttagtaagcatttttattgaattgttgatacatttcttatagaccattttttttccagggtatccaattaactgttggttagctagaaacttaacaggtagtttatctttgtatattagagattctaagggatttgtcatcacagtaggttgagaacaactgttgaactggaataattatcagataatcattgactatttaacgtcactgaggctaaaataatatttcctaagttttattgatagaattttatgcctactttacttgatttattcatttagttgtggagaacattatattaaatactgatatttcttgtgaatgtctttgctttccaactttaatgcaaacataaatatccttagcatgaaaatcacacatatgtatatttgatactgtattagtctgttttcatgctgctgataaagacatacccgagactgggtaatttacaaaagaaagaggtttaatggacttacagttccacgttgctggggaggctccacaatcatggtggaagatgaaagtcacatctcacatggcggcagacaagagagcttgtgcagggaaactcctatttttaaaaccattagatctcatgagacttattcattaccatgagagcagcacaggaaagacccacccccatgattcagttatctcccaccaggtctctcccacaacacatgggaattatgagagctacaagatgagatttgagtgggaacacaaagccaaaccatatcagatacttttagtcaaaagaaacatttcagttctatttaatgtgaatagtagtgcatatcaatctcctgcccacattttcaattgaataaaatatgagacatcttatatatatctttttatccatgggatatagacattccttctcttgcacattcttcttaatcagctgtccattatggggctgaaaatatttctttcctgaatccaatcctgtagagtgtaggagaaaggatcgtgagtgttgtgaaatataggcaataaacggggaaatattcaaagttagagaagaaaaaagagaaactgcaaacttcgatattgaaaacccagatggcaaggtcctcattaattacatctagtgctaaaacttcaaaggagtattttgaaccttgtgtgatttagaaattgagcctggtggttttccccgacaccttcagaaatcctagatagctgtgtgctttcataatgtagtttccctgactaaacttgaagacgtggctagctgaccaaggagctatgtttggcaggacttgagacaatgtttatctaaccctgtttgtttaaggaccttcttgggagggtagacctgctcttctgggaacaatcgattcatagctccttcaaagccactccataaatgttctgcttgactagaattccactgttgactctgcaggcttaatcagtattaatgaatttttcagagaaggatgactaattagagatttcttctgtggtttataatcacaacatgccatctttgcaaagaccttttgatcaagactcatttgaccggagatttttcagagatgtagcttctgatgattcaggatgattgaacaggagatttcactttcttctttttcccccaccatgataaataataatttatgttagaatatctcagtgcaaattgccagtaggaactaatattcttatattctaagtattctaagattaaatgtgttcatatatgtgagacatttaaagcagtgccagccatgtaagttgtgtttctatttcaagtaaatattgcaaagcaggcataggatagtgcttttaatgtttataaattatgcaattaaagatgcacagtaacactaccatgaacgttttggtgctgtttatttttaattgggaagaagaagcatgatggaaagcatactgagcacctggagtattggtgctgatgaccattttttctctgtgtgcctttgaacaaatcacttaaacttggagttgtcttttccctctacatgaaatgagcgaatgatgagataatctctaaggtcccttacagctctgacttgagctttcataagatactaagagctctttttttattttgttgttattcttaaattaacttcatgtttgcactgaaatcaagctagaagtcatttgtatgtatttctgcaaactgcattctatagcttgatgcatttgtgagtggctgttttggcactaaatcacacctctgaattttcactctcttatattggatggaacagttatgcaagattaaaatgttcagtcatttaactgaacatgtgtggcagcatttgttcactccatttcatccatccaaaggccactttgatttatttcatttcctatgtcacttagaccttctgtctataaataaatatttaaatcacactttagattttagaaaatgttgagctatttgttacacaacttgtgcatattaactcttctataatacatcttttaacaacatagtttcacatttagaatttctaattacattgtattttaaattatgtcttgatatgtgagtaggacgcttgatggtttgctttgtaaaatgctctaatgtaagagcttattgagaaggaagccagtgatttaataaaactcatttgaaagcctgcatcatttaaaaaatagcaagatacggtttatgaattttaggtaaacgtaacatggtgatttatctatcttgtccaatactttcagtaaacagtatacttgttataaggaacagtatgtcataatttttggtataatctcttagtaaatttcttgatgtctaatagaaatatttaatttcagattaaataatggaagtatggctcttataattgcccgaaacacttctcggccagaatttataaaacacctgaaaagatatgccagtgtaaaaaatcaggtatagtaaattctttttgttacttatttgcaaagctattaatcatgtagaaaaagatgctgcaagaattgacatcgaatcctgcctcataagaaggttttattttcttctgaatatattaatcttctttttcccaatctatttcatccaaattttgaaaagcatccgccaggattaatatagattggccttttttgaatgatgaattagtggttatgtatctgtaaccacaaagataaaataggaaatgtagtgttatattgcaatgtgaaataaattaaggataaaattccatactcaggctgttcttcagaatgaaaagaagtgaaatttgagagtttagccttcttgatattatggcagcagactttctaaagttatgatctttagatcttcctgacatttgtttgcatatctgcattgattgaaatagatctgtagatatgtatttaaaaatatgacagttttatacaaatattcattcaaaatgagaatatgtgaagatatacatttccacttaagtgatttgctttaaagagaaacagtaactattacaagccatattattttggcagctgttttgacctgattattaggaaaatgatccttgaactatgtgaatttctgaaattgtgagtctttgaagtacataggtatggttgtaaaaccctatagtttcacactttttctttttctttctttttttttttttttttgagttagagccttgctgtgtcacccaggctggagtgcagtggcgtgatgtctgctcactgcaacctccacctcccacgttcaagcgattctcctgcctcagcctcccgagtaggtgggattacaggctcacacctccatgcccagctaatttttatatttttggtagagacagggtttcaccatgttggtcaggctggtctcgaaactcctgacctcgtgatgtgtccacctcggcctcccaaagtgctgggattacaggcgtgagccaccacgtccggcccacacattcttaaaggtataaaatggtgcttggatagagttgggagataacagacgggaggaggaggagagtaaacccagccaatgactggcagctgaaccttgcttatgtaccttagccatagcaagtctctccatttttgcctcattatattttaaaactttcttaggccatcttcatgaagtttgatctgtcagtaacattatttgatcctcatgtattgaacaactaactgggctgcttaggaacttaaatcataaaaaattacagtcccactttctttatatgtcaaagtagatcagcaggtataatgtaggttgtgagcctacataacagttttatgtatgtgtttgggtggaatatggagatttattgattttcaaaggaatatatgccctttcacattttaataaatttctaaacattaaaaccaatttttaaaaaacccaaagcactatatattcattgctgtttttaagtcagaaaatagaaacaagaaaatgattttaaagcactcaaaattccatgttcctcaagattagtgtcattaccttggtagaattttttccgaatccttttttattaaataaatgagaagtaaagtaagtattaacctcattcatgtacctctatttgagaacttaaatagtattaacctattaatgtacccctgagaagttctgtatttattttggggaggtgtatgttgcacaaattgtttatggaaggtctcttttgaaattgcctatggggcaagtctctcaggcaatttttgtaaacattcttcttcttcatttttttaaatcaatatacctttcttctgattttaaaagcaatggttaccttacacataaagacagacatacagaaaataataaaaatctgtatcgataggaagacgttttctaagagataatattatgcaggatttatcatattttctcatgtactctacgaggcatatcttgcttttgacacaagaaacagttgcctgtgtgtgattcactggccttaactctgatttatttatcaactttcaaaaattaaaatccatgctattttttttttttttgcaaagaattctaaaatattttgcatagtgtatatagtaagaaagattgattcccagggtgactgctttcaagcaatgttaatttgatttgttaattatccacacaggtgtgtttatttaggctctttccttcatggtgacattaaaaatgtgaatttatataaattttgtaagattatgaaaatcagatctatgtaaaaatcatgtctactgcataattcatagcagtgctggtattcaggaaggaaaatgtggcaattcagtttaaggagagtaacatctgcttctctgaaccatttttaccaggttgaataagcgaatgttactgtataacactgtaaaatagattgaaaccaccatgtgcggagtggctcctgttccttccccatctctgtgtaaaattagatagaggctgaacactacccttcaaagtccttgcagctccatcctattgctttgccccccttctcactgtccacacttttctctttcattgtgaccatttttggtagggagtttaaaaccttaaatgtgagtgcttcccccaggatttctttgcagccctctcatcttctcaggatgccgtctcctggatggcctcattgcccctcacttttgaactgtctgaacatcatgcactcccaagggttctgtcatctcgtcttatctgcaggacctctgtcttcttgtatgctgaagaggttctgaaattcaccggcatctggaggccaacatgtctacagccgaccttatcttttcccctaaagttgttccttctgcgttgctctgtgcgggtcaatggcaccactttctacccatccaggttaccctgaactgttccttcttcctcattcctcactaccagtcccctaacttgttctgttggtctcctcttaaatgtttctaaaatttctccctcaccttaattcaaactttaatcctttcttgcttacagtagcctccttttggccttcaggttctctggtcttgtcttccatacctctttttagagaaacttttttctaagacacacattggatttctctcctgcttaattcttcagtgcctttctcttgttgtcagaataatatggaatatcctcagtctggaacacgtggcctttgtatccaggtccctgcctgtgttgcaaccccacctcttattaccaccctccaccacattcccagtgttttggcattttattcgttggctaaggttgccataacaaataccacagaaaagatggcttaaacaaacagaaatgtatttctttcatggttctggaggctagagctgcaagacaatgtcagcaggtttggtttgtcctgagtcttctctctctggctggcacatggctgctttctcacagcacccacaagtgagtggtctttcctctgttcatccccgatgccttttcctatgtccaaatttcctcttcttataaggacaccagtcgtattggatgagggcctaaagacatcattttagcttaatcgtctctttaaagatcttatctccaaatatagttatgttctgaggtatacagagcgaggatttcaatacaggaatttgagggccaaggggcatgatgttgagcacctaggagtcacactgaattctgtgtagttgcttgaccatggtttgcctctagttttgtaaatgcttcctctctccagactttcttctccaggctaaatcttatatgttctttaaggctcaattcaaatgggaagctttcccaacatccatagcctgtttgcctcctcttgtttcctctgttgaactccacacttgcaccatcatggcactcccctgtatcaaaattgtaactgtttacttctcctccccgtgccccaaacataccctcacacaggatactaagctcttggctcccgaaagtcccacttaacagcgtctgtggcttcacagttaaagcatttgaaggatggctagatcttcattttgtgaggagtgcacatgacaactgctgatttaagataatagacttactggtggtggctgtcaattcttgacattccttggcttacagctgcatccctccagtctctgactctgccatccttggcattcttctctcataaggacatcagtcatattggattaggtcccgccctaatgacttcatcttaagttgattctacctgcaaagaccctatttctaaacaggggacattcacaggtaccaggggttaggacttgaacatagttggggtggtggagggaaatataatttagatcataacaggcagttgtgtgttttaaatgaattatcaactaacatgaatgattatgtagataattctacaaggatgaggcatgtagccaaggctttatacccgaggtaggaggtctaacgcagttactgtcaaacagttttgcttggggccctctaattctgtacctcagtcacaacagctgatgccatcatatcatctactgtttaactgtgtttacagtataaactggaaagttggctggaccttggtatctacatatgtaaaatatgggtgttggggaaaatattagttttctgtcaacttttaaaactgtttcattgaggtttacatgtggaaaaggggaaaaactatgtagatgatgtttaattaggaatgtatctcatgtcatttttctgaaaactgaaatgagtagttatacatttctgctcaagttatttggctatattttcttaattatgtcagaaaatacatagtgctttttcagtatagtttccttaggcaaacaagaaaaaacgcaagttgaagtttaccttgcaccattctatagtggtaagtaaacagtgatcttgcagcttgtgtccattgttaaagtgggaatggggcaggcaaacaccttttaaaatccatatttgattggctttctcttttaaaagaagacatacatcccattttatcttcagaagtttagacttgcgttcttccaaattaaattccaagtgtgaaacttgtactagtttgctttatgtcagctaaactaattgacaagttgataatggattatatgtcttctgtatctacaggccagtattaaagattatctttaattgaaaaatctacagtatcactattttatgtaacttctcacagatatgtactatttgtcataaaacaagatttctaggtgctagatctaaaagaacccaaaaggctttggataagagattccttcttccaaaaaaacttggagatccctgttcatagtctcaaagctattaaaatgtcagcatacatgctgatatttacttgtgagagagggctcagtgaactttgattcgcgttagtagctagagataaaccaagtataatgattatttgtatttatttttagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattaggtaagtctatttatttcaccgcttattgtcaaccagtaaacataaatctaatattacaacgaaagctctcttctctgaactatcaaagcaggcagttggttagtttttaaaaaatcagtaaatcagggaagcataaagagacatgcacaaatttcaataaataaaaagcaactttacatttattcaactgttatgtagacccaaggcattttctttggttatgcgtgtctacattggctttctaatttattgttgtgcataaactacagataatgtctacaacttccattttggatttttaaaaatggatcaagatcttaaatcttttagtggagccatctgaatagtaaagtgttagatttttatccttccatcttagtttcctctcactcataattactgtaacatgttttgttcagtaatttgcttttattaggcctttacagagcattcaacttcccttgggaacaattttacatagcaactggtataaacaggtttaggaacctgcaaacgcattcttggtaggcattgtgacactcagtggttagaagaagcatgcaggggtgcccactagacatgggtgttctagaggcataactgactgttttacagaggtaatggagagcattggacaatcaaggaagtcagttaaggaggttttagagcaattattgttgttgatgatttatcaatcagaccttctcagttttctagattacagctctgttgggaatgctgtgtttgttatcaatttgtatttggcattggcattgtgtaccatacttattaggtgtatgtgaaaaacaacaaaataagttgatgaaataatgtattttctttacagattgcatccaagacttatcagtctttatggaggaagcatggaagaaatgattccaaagtaacatgtaattgtttctaaaagaaatgtacaaactagaattttaatataaagaaatgtggccatgctttaaacctgtggtccccaccctttttgggaccagtttcatggaagacaatttttccgtggatgggggaatggtttcaggatgaactgttccacctcagatcatcaggcattagattctcttgaggaacatggcactctagatccctcacataccagttcaccatatggttcgcacttctatgagaatctaatgctgctgctgatctgacagggggaggaactcagtaatgctccattgctctaacctcctgctgtgtggccaaacggatatcctaatagaaattgatgttactaacaattagcctctagggctttaaaagtcaagatgaaatatcaattcaaattctgtttttagatatcaattcaaattcttttttttacaatgtgtttattggacacacaaaaaaactttgcaaccatcataatacatcaatatttaacctagataattctgaaataatttggattctttcatttttcaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttcttaaagtggtagggttttaaaattcatgatacaagtaacaaagtaagttgataacaaatactattttgaactgggcaaaatctagcccaatatgtaattgtgttccccttgtatctgagaggcctgtgttggacaaccatagtactctgctttcactgtgctcagataacctgaaatatatagttgtttctgagtagttctgagtaggaaagaaccaaatgtaaatttccttagagaccatcctggagaagacagttctaaatcggggcttgatttttcatctatgatcctagatgttctcctgaaagaatgactagcctttttataacgatacaaagttttttaaaaatacataaatgtcataaagtttattcctgtgtatacacactctgggttcaggaggttttgtgcttacatttcactactcaaatgccttcgcaaatctcagaacattcctcaccatcactgcaggcctgtgaacagataactttcatcaattaggatggctggctagtggcagggacttcatataaagaaatctttcccagaattgtttttccacattgccttctaatttgatcactccctataacagatgttcaaaattcggccacagctctcttatgaaggcagagtcagataaaatgatattctgcaattatctagatcataagcataaaataaatattacaaaaatgattgtatttaaagaaattttttaaaatccagaaagtcatttaaaatagaacctcatatagtatgaacaaactataaaaatattttacatttca

SEQ ID NO: 19 - DNA, 145347 bp, Homo sapiens
  mutation 23890: a/g SNP in reverse strand
attgctatttgggcaacaatatggctccttcagaactggtcgagaatttctgtggtctttgcttgaccttcaagttgggagtttcaaatcagaggctttgaagtctggaggagttcgcagccattaatccttccggggttgtgctaaaggcgtttctagaaagagatcggaaagacccgttcagcacaggcccattgcatcttctctttgaaaacgcttgtctgaatcaagtatcttatacagacccgagactgaggggagcaagagcgcaggtccggctgtggcgaggtgtccaccaccgtacttgtggtcaatgcctggactagagagccgaggccgtccagggcgggctggccagggaaccagaagcgtccctggactggctgagtgagggtgccctttccagcaacccagtggccatggttaaaaggcagaatacaaccgtcaaagaagtccccagctcccacataagagagcgcaaaggccaatggaaccaaggcctcctcgcgagaactagctcgctttgaggacaagatcctggggatggaggtggggactgacgtagtgagagggtctggaggaacagtcgtagctgaaggtcaggacatgaagaattgcacgtatggtagggatagaatggcaggtacaacttttctgtactgaaggaactgggagaggacgatccggttagggaggttggggaactaatctcaacgctgcgtttacagatgaagccgcttttatatggcgtatatgtttgcttagaggggccgacggagattaggagaagccatcctttggcgccaatgatcaaagcgtctgccaaggagaagaagccaagggatgggcctttcagagagggcaaggagtcatgctgctctggatgccagtgtcaggacaagaaatcgaaaggagcgaggactcttcactgcgtgcctcagtctccccgcttctgcctctttcacctctgtcctacttccggcgcgaaagcaggccactcgctctgatctagacctagttaacattagcttttcccttccttccctcaaatcccctcccccctctatccccgtcccttctgccgcctgaaagggttaatctctcctgcgggtaaaaacaggtccgcggagtctctaactggcgacagatgggccactttcttctggccacaaaggggccggaatggagcgctccgcggcatacaaatgggcaggtcacgtggttccaggctcttggctggaccgggaagaccatatggcgcatgccggggaggaaggaggaggggcgggggtaggggtggagggtgaggggagcggttgtcggaggagggcgggagacgagcaaggcgtggggagaagtggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaaggtaattacagttctttcatttttttgccccagaatagaagcaataactgaagactgatgaacctacatattctgtatgtgtgcgtttgcgagagtgtgtatgtgtattgagaccagcatccccctccataattgcccataagtactcacacataatgagtcgtgtcactcaagtaccccctgcaggctttctaatttaaattttaaaaatttgggtttcttttgtggatagcataggagcttcttggattttttaaaagaatgcacggtaactatgattatctgctagtgctgattttaaagtcccaaaagcaataatgacttcactttctcacttcttacagtaagaaaaaaaaatctatgttatcaatatatattttgtgtgcatgtattttacgcacattgggagtgtcaagctgtgttttcagtgaatgaaagggacatggataccttgagtattcacaccatggaaaataaatcaggttcagagatagtttagttgagaggggggaaagtggagaaagggagagggactcactcctgctacctgttaccgctccagaggcggccaagtccccagcagccactactggagccagaaattcagttgttttactaaaggctttttattttccttactagaagcggcaacttcgcggttgccaatcgctgaccattataattactcaatcttttaaagggaggtttgaggcgaactttgaaaagccccaataaagagcgggcggccctttcaatgggctgtttattagagaggagccttccgcacctgatccccggcgcgtgggagagcgctctgcgccgcgcccccagccctcgccctgcagctagcgcttttgtacaaggtggaaatttagcggtgggccagagatggaaggcaagaaaagaaaggcgagggaggggtggaagaccctgtccacttttgttgccaaatgttacattgatggtgaaacaatttggtggaaactatttttcctcctttctgcatttgcttttcagtatcccgtcgatgtaatcttcttaaaaatcgctgccagtattagtaaattacgcaatggctgttcaacttaaatcgctaagtatctggaagccaggacagaaatggaagtagaatgtgtgattttacagcttttttttttttttatggagttgtgagtaactttgaacacatttggataaacatgaagtcgctgaaatgtacagtcatttccacacacattatcctgtcgggcaaccaccataaacacatttaagttaatcactaggatacaaacacatatgcgtgagtggtgtacacatatacatattcactaccctcccccagtcctgtcctcactcctacgtactagcggggcacacgcacgcgccattataaaacactgcatttaactttttctcagaggcattcattttgtaatgggcaggtacttttcgcaagcatttgtacaggtttagggagtggaagctgaaggcgtatctggcttttgaatatagcgtttttctgcttttctttctgtttgcctctcccttgttgaatgtaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaaaccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtgagagcaattgttgcatttcttcttaaagggattctgtttttatttttggggaaagtagttgcttttttgctgagttaaaaaatactaaacactatatgtagaataaaagaaaagaaaaaagtttaccttggcatatgctcttgtctgtttatcttgcacagggagtcaccagttctatgtagataatgaaaagacctaactgatatttcattatttggaatatgggactggacggcagtacaaacagtgtgtttttttctttgttttaagtggcttagcctttaggttttttatttccatttttaaaaatgattgttacatgttttcttctatttctttttttaaaaggtggattttaataattattaacaagcaagacataaacaagtatcctagcttagtttgtctatacatttaagatgtataaaacattactattttcttggtcttctgttatctgtacatttttctgaactaaacagttttatcttgcaaactagtactgtcccagaaaaatttatacacctttaggaagtaccaaagggaaatgagttaattaatttaaagaatccaagagaagtaacattttataattgttctattaacatcttgtgatgatttccatcatttttccaagaaaaagcataatggattatttgtactgaagaacacactatttgtactgtatttaggaaggtgtaattatttcctccccccaccctttggggcactattctgttgtttcatgaacacaactcactggaaaaacttatggatgattctgtctattgttaagtccacttcaaaaaaaaaaaaacagtttggcatttcttttcctctggatgtattgactgacagtcatgattcctagggaatatcattttggcacttgtgccctggctctactgtggtgctctgattactgtcattagtaactccattgtttctactctgattcgggtgccacattggatgactaccccccttcccaagcttgttcctttaatctccttctcattggtgatttaggggttccagaaagctgacctcatttagcaagctgctccagaaaaatgtgagtaatgtaatggacaggaacaattagccatactaataacattgccaatgaggctgcgtcaagctgtgacagaagcagtaaggaatacttcgacgttaaaaaaatgtttgagagcaatttaaaatatattattttaacatgttttctatcagccttcatcacatgacagaaatacttttaagttagtcccaactttatctaaaatgcagcaatctcattccaagtgaatcagagttgttattttggaatcaagctgttgctttctatatcctggattgttctcactgttcttactttaagagacataatactgatatgatacttgaatactaccagccttccagtgtaggaggtaatgaagtgagcattcagatctgatctaacctattaagtagctcaatttcacctgcaattaaaattagacatcttcatgcaaactaaaatctgttgctgtagtgaagagaagaaataaaagaatgccattttgagaattccagcttccaaaatagcaaacagggaaatctagactgtgttcttttgtaaggtagaaatgaagactaaaagttaggttttttttttttttcttcccattttgccaatacaacttcattctaaaacatagggattctttcagtcagtcaaggagtaactcacatgccaccatcttttattcaaaggcaggcacagatgttccttctgcaggggaggatttaatttatgaaaatgatattgtttatgcatgaatgaactgcatgcactctgcataacacatagcacttccatctgatcagagaaataccacagaaccagtgccaatgtcagaaacatattctacaaatttactcacttaaatgtttaatgaatatttggaaggcattttcaaaccataagaaacattttaaattatcttcttttatgaattcctacccatatttaaaagagactcttacagtttttgtaattggctaatgcttatacccagtttgtaagaaaagaacatattttactaaatgaaaaccaaccaaaaaaaaatgctggcaagtttggcttcactggaaaaaatatttcgtttagttttgctgtttaatgcttgtcatgaataatatttgggattctatctgtttcttcatcttgagccacgactattcctatcaaataagatgcttaggtatacttgtttaatgtgaaaatcctatgaatagttatttctagaaaaagctggtatgtaaaatcagggggaaatttcataaagatgaaattgggctaaatattgtaacatgcataattactattgaataggaacacttcacataacatattttactttatataaccaattgcagctatatagtatgatctatctacttttaatcattaaaacaattatatataaattaaaatgaaagattataatatcaagagtgttctactaattttaggtttataatatgttacagtaaaataccatttgaaataaattttgtgttctaatttatcttaaaatctctctgtttttacatttgaaagtccttacattcttacaaaattaatgcattttctgaaagaagctagcaattactaaaatgatatatggatcattagctaacagtttgaatcaagctgttttagttctataattatacaagaaatttaaagtgaaaatacctattaagcaattaataaaactaggtttcaaaatattggctaattttctcctaatgggaaatgtaaaatagcaaaactgcttcttaaactacacaaaaacctcctcacttctccttttctctctctctaacaccacttatttcctgaaaatcatctaaataaaatatttaattccagggtctgatgaagaataaaagagccaatgcaacatcttgtggaacaccaggactgagaactcttgttgttaccattgcaaagaggcgttctggcgtcagatgcacagtgatttgtatggtggcataatcattggctcctggccaggcattatgtttcagaggacactattgtcaagaaccattcaactagaaatctgcactgtatgcactcaaaagttgagatcatctgccttcctatgacaggaagaattctgtgctggcaattgactcatggactctcttcacatacactaaggcttggtccagtggctctgatggaattaactgtgcagccaaactagtggcattgacaagacagggccacagtctctggggacttcaggagaaattgctaattttaaaatgcagagtattatgttaatgctggattaaatcttcagatacattaaatgtggatttggccatctaagcattattatgttatttgcccagttaatttagaggtagatggatggtgacaataaccatctctacagatccacaattctaagagatggatccaattgtgaaatgatatggagagatagagtaagttcaatctagcatatatgaagtaatttggtaactgacttttcttttaacaagatcaaaagctaacctgctttacactttcatgtctaaggacagccaaccagagagatggcttcacacactagcccactgctaagtgcttttcattcactttcatatttcatcatcaaagcaccctcctgccttatttatagatggggaaacttcaggaagttgagatacctagatatttgcattcctgtcttcctttcttcattcaggtttttctttcattgccacttcctcaaagaagcttttactgattcccatttaaaatagcaactgacttcaactccaccaaaatcactgtattgcccctccctctttccagagcatttgcctatcaaatgttatcttatgtatttacttgtatagcttaattttaaactatctatctctaggtcttctgagcacctgagaaacagagacaaagttgtctcttctgtgtgttgctgttcctctggtgcttagaagacctagaggatcctcaataaatattaactttccaagggaactgaagagcactaatgtgatgctaaagcctgttgccttaaccactatgctataagtcaaatcagttgagaatggagaggaccacaaattattttcagtccagcaagtgttataaacattaattctataaaaagaaaacaattgaaactaatttcttattatattgcatggcaccaaactccccccacttcctttttgaggatcatgagttgtctgtcattgtttctttttattgatatcaattggttaaatataatctggaattggaataaaagaaaaactattataggctttttccagaccatgtatttcaatgcatattattttttcctttctgttcattattctttcagtaattgcacttgttctatttttagtgttatgtaaaattactgtagctcataatttctattttgaagggttcagtgtataaacttagcacatcaatactatctttttagtgttcgcgctcaatggtgtcagttaagagatcaccatcacttttggtgacgtcaatgaaggggtattgcaatgcttaagagaactgttaatccctttccactggtgtcactaacaattgtagtgcttgtttattcatagcaggtacgtgactaagtaatgttaacatcaaagcagaaagaggataatagagtgttctaaaaagaaaattcggtggttgggtgcagtggctcacacctgtaatcccagcacttttgagaggccaatgggggtggatagtttgagcctaggagttcaagaccagtctgggcaatatggtgaaacctcgtgtctacaaaaaatacaaaaactagtggtgcatgatggcatgcatctatagtcccagctactcgggaggctcaggtgggaggatcacctgagcctggggaggtcaaggctgcagtgagacgtgattgtaccactgtactccagcctgggtgacaaagtgagaccctgtctcaaaaaaaaaatgatttgagataacatcacttgtcattgtttgttaactgaataatctttattctagccagtgcctaaatacataataaatgatagtacaaatggatataaattataactaaacctaagtagtgatatttatcacaatatttctttactagaagaatttctttgttaatagaggcaaggctacttgtttagataccttaaaataacataagatttttggataaataaattaatgattctttgattctgactggcatattaaaaatattaagcgaagagatctttgcttcccaggttttattttttgtctaattaactactggtgcatttatattaaaacatattgtcaagggaaaacgtatatatatatatgtgtatatatggtgtgtgtgtgtgtgtgtgtgtgtgtgtgtgcacacatatgctatacttggttgagtagtatccccttcccttgcccacctctctcccaaatttatgtccatccagaacctcaaaatgtggcctcatttgaaatattgtctttccagatttaattaagatataagatgtaaattgatacaagttcatgctggattacggtgggccctaaatccaatcactgatgtcctgataagaagcagacagaacacacagacacacagcatacaggaagaatggcatgtgaaggcaaagacagagactggagtgatgtgtctacaaatcaaggggccccaaggatttggggcccacatcagaagctgggaaagagacaggaattctcagcttctccttctgaatccctaagaaggaatcaaccctgctgacaccttgattttaaacttcttgtctccagaactgtaatataatacatttctgttgtcttaagctacccagttgctggtgatttgttatggcagccctaggaaactgataggtatactaaaatctctaatgaattgatgttaaatatatataagtataggagagttcatttaaattcttctgaaaatgtcttcttaaacttttaatgatacagtatataacaaccagtatacgtagttggtatcgggtttgacatttaaacaagctgacaaaaaacagctgtttaataaacatctgaattatataaaagttttattgtttattattcatgtgaatgacttaaactgacatctacatttagtgaagtgtgaatgggcctagccaataaactatgggtaatttttttaaagtctcatctttgaactcacaaaaaattatcaaatatcagctattatgtattcttcatgtgaagaaaatgtcatatttatttgatttgtggattagcatatatattaatagagcttttgaaagaacaaatgtagcactttcccgatttcatagacactcatttaacacacaagttcatattttaaagtacataattttaaaaaaattctagtccaaatgaatttaagtgccatgacttctaaaaattctgtctctatttttgggttttataggaccttgagccagtactcttctggtgagcttaagaggctaagacttcacctttagttatatggggctttcatctgattatttgtctattttgattgctctaaatacaagttagtgtgtatttcatctgaatgtatttcattataagttttggttttatgtagatctggggatctgtcttgtttttaatcttgattggtctgtttgttttgggatagttggtactttcatttcttatgcttgctttctttttcattttgtgcccacctttagtcaggtgaacatcagtaaggaataaaattttatttttttaagccactgaaaaaatttaaaaaccacatcataactctgcctctgctgactgataaaaatgctaacttattaagacaaaatgttatgcaagaagactttattggaatagagaaacatcctttttatgtaagaaatatcaacagagacatgtgcctttcttgtgacaaatgtggtatgtgtgtggattagaggtctggaatgtggcagcatttcagtacttggaggggagaattagagtagggtagaaagatagacggggagcagaggatgattctcacccagtagaaagcagagtgaagaaagaaaggggaattgttttttgcattatattatttgaactgtggattaagtctttccataagccatccctacgcctctaagtaggttttattaacttaagctggtttgagatgggtttttggtcacacacaagaattgcctgatacaagagaggctttgattttgttgttgcttgctcatttttatacactaagatggagaaaaccctggacatagtgaagacgaaattgaggaaggtgttgggtagagtggagggtagaagacctgtaacataggtacagaattacattaaactggaaggacttatatccagatataggagtcagggtagaaagagagaatgttagcagtaagggtaacagagtagcagaagtttattcttaccaggtcctgttatgtgacagtggaggcatgttgaccttctgactaggggagttaaaggagaacactgaaggtttagaataatgtctctaaggatagaaagagaaagtttcatcaagactcatcaataatagggcagcagggcttagggccaagcaaattcagagaccatgatattatagtagtttgtagtggtcttaatccatctaatttttcagcattttctcaatggccaatacttagcagtggtagtgttttatggcatttggacaacagaagtgaaagcactggtaagagagacgttgaagtgaaacaccatggggctcagaaaagcagagttgatccatctggtacatgggcaaggatggtcctgaacaattctgcagtaagttggaagatagaaaaaatacctaacgaacttgtagatctgggtaaggagatttttggcagaatattgtaaggctaattggcttctcttaactatatgagatagggttttacaagggagagataagcgagcataatttagaagaactatagggggtcccaggcagactctctggctggaaaattattctgatagcaagaaattagccccaaagcaaagatgaaaagtagggtacttccaattaaacatgtcataagggcaagcctcaatcaagagtgtggctagaaggcacagctcacctggacaaaagtgcttctaagcatattaggagcatataccacaataacctgacttggacccaaagttgagagaggccagtctcaaaaaaatttgagggaattgcttttgcataatatgatactttatatacatatctgttacatatcatatatatcatattaaaaagaaaaaaaaccctgtttttccttccgttctttcatataacccttctgacaacaaatgtggagtttttcacacactaagcaattctttagttcttgctggacacttcctggatgtcctacaattcaactcgattctcacacaactgcccagagtcagtgcagacccgcagattaaaggcttagccccaaaagactaccccccactttagatgtcaatcacaagtctcaacttcatttacttctgaaggacgagctatacattggaggaaacccctctttctttcaataatttgctagaatggctcacaaaactctgggaaacatttacttatggttaccaatttattataaaggatataactcagaaacagccaaatggaatagattcatagggtgaaaaatgggggagaggcatggagcacaactctctcagcacctccatgtgttcaccaacccagaagctctcagaactccttcatttagggcttttatggagctttatcaagtaggaatgattcatgaaatactggcattggtgattaacttaacctccagcccctttcccctccctcaacattgggggtgaagctaaaagttccaactctgtaatcacagggtgagcttccctggcaactagtcccctgatccttagggggcttctgaaagtcacctcattatcataaactcaggtgtggttgaaagggatgttttgaataacaaaagatgcgcctttttcctttatctttctgagttgtttcaggagctagggacaaaagactaatactataacaacaacaacaaaaaattcaatttttgcttttatctcttgggaattacaaggattttaggagctctgtccagaagccagtgatgaagatcaaaatacatatttcttattatatcacaattcacacatgtacatgatatccgtaagataagtgaactacataaagtaagctcacaaagtttctgtaggagttttgtccatttacaaacagtttgtaagctaaaagtatctgtgacaagcctcagtcaatttagaagttcatttttccaatgttaaggacatgcctgtgacacagcctcagaaggtcctgatgacatgtgcccaaggtgatcaggctacagcttggctttatacatttagggagacataagacatcaatcgatacatgtaagatgaatattagctcagtccagagaagcaggactactgaaagtggaggcttgcaggtcacaggcagattcaaaggttttctgattgggaattggttgagttattatcttaagacctggaattaataaaagggaatttatcatgcagatgaagctttaggtagcaggcttcagagacattagattgtaaaggtttcttatcagacttaaaagagtctgttctaacagtctttaggtctcagtgttgatgttaatgctggtcagctgtgcctgaattccaaaagggaggagagtataatgaggcatgtctgagtcccttttcccatcatggcatgaactagtttttcaggttaactttggaatgtccttggctgagaggaggggtccattgagatggttgggtggcttggaattttatgtttggtttacaagtttaacattaaaagcctctgtacctccaatgttttatggacaaaaagaaggctgaaaaagctacttggctgtaatcatgggccatttcttgctgaaaagaagaataaaatggaggcagaaccaaaagcccagaggctagagccaagagctgctgagaatgatgaattagggaaccactctcagagagcagatctggatgtgagataggaacattttctttctcagggtctatgaaactggcaacatatgctctcctgaatttcagaattgctatggaccagtgactgtgatatgctttctatatttttcccttttgaatgggtgcatctatcttgattatcctctgtctcattattgtatgttggatttgtgtgggacgataacatgtgtttttagttcctaggttcccagaataagaggagcacactcaaagagcgacatttatgagatactggatttttcacttgatatcataattgggtgagacttgaaagaaagtgaacatattttgcaaatgggagggatgttaaccactgacaaccacacccacagggtccactgtattagcctatctgcaaagacggctgccaaaaattccttctgtccatatatacattcccttttttaatgtgactgtttcacctgccagcaactgaagggctttatttccatttccccttgtgacttgtttgactaacagcaagaagcaaaagtaatgctattccaattctagacctgggccttaagaggcatgacagcttctgcttttactctcttgaaactcaatgtcattttttaaaagctcaggctagactactcatcatgagggaccacatgaaaagagataggcccagctagtttccacccattccagccgctccagatgagatgccagacatgcaaatgaagccatcttggatatttcagccccagctgagcttccagctaaatgtaagtacattcagttgatacctcatagagcggaactactgagctgacttcatccaactcacagaatcataatgaataacaaatcattgttgctttaagtcaatacatttaaagtttttttgttatccagttgtagatgaattatacagcctggggggaaaaaggagatagcacactgttagttgcctcatcaatattcatccccaaattctttttcctttttagtaggtctcacctcccacctggaagctgaaaacacctttcccagtctctctggaagctacagcacaggcatgttgcccaattctaaacaataggacatgataggaggtctgctgggtgggatttttgaaaatatttttttttctggttaagaaaaaagaaatgcccaaggaaaacctacaaatgccccttccattcttgcttttggacattttttgggagagggtatgatgcttagcactcctgcagccatctcggggccaacaatagaatccttgttgctacctggtgatagtgaagtagaaagctacaaagctcttgatttcttttcttttttttttttttttaaattttattattatactttaagttttagggtacatgtgcacattgtgcaggttagttacatatgtatacatgtgctatgctggtgcgctgcacccactaactcgtcgtctagcattaggtatatctcctaatgctatccctcccccctccccccaccccacaacagtccccagagtgtgatgttccccttcctgtgtccatgtgatctcattgttcaattcccacctatgagtgagaatatgcagtgtttggttttttgttcttgtgatagtttactgagaatgatgatttccaatttcatccatgtccctacaagggacatgaactcatcattttttatggctgcatagtattccatgctgtatatgtgccacattttcttaatccagtctatcattgttggacatttgggttggttccaagtctttgctattgtgaatagtgccgcaataaacatacgtgtgcatgcgtctttatagcagcatgatttatagtcctttgggtatatacccagtgatgggatggctgggtcaaatggtatttctacttctagatccctgaggaatcgccacactgacttccacaatggttgaactagttcacagtccaacagtgtaaaagtgttcctatttctccacatcctctccagcacctgttgtttcctcactttttaatgattgccattctaactggtgtgagatggtatctcattgtggttttgatttgcatttctctgatggtcagtggtgatgagcattttttcatgtgttttttgactgcataaatgtcttcttttgagaagtgtctgttcatgtcctttgcccactttttgatggggttgttttttttttcttgtaaatttgtttgagttcattgtagattctggatattagccctttgtcagatgagtaggttgcaaaaattttctcccatgctcgtgggtaggaagaatcaatatcgtgaaaatggccatactgcccaaggtaatttacagattcaatgccatccccatcaagctaccaatgactttcttcacagaattggaaaaaactactttaaaattcatatggaaccaaaaaagagcccgcatcgccaagtcaatcctaagccaaaagaacaaagcttggaggcatcacactacctgacttcaaactatactacaaggcttcagtaaccaaaacagcatggtactggtaccaaaacagagatatagatcaatggaacacagcagagccctcagaaataacgccgcatatctacaactatctgatctttgacaaacctgagaaaaacaagcaatggggaaaggattccctatttaataaatggtgctgggaaaactggttagccatatgtagaaagctgaaactggatcccttccttacaccttatacaaaaatcaattcaagatggattaaagacttaaacgttagacctaaaaccataaaaaccctagaagaaaacctaggcaataccattcaggacataggcatgggcaaggacttcatgtctaaaacacgaaaagcaatggcaacaaaagacaaaattgacaaatgggatctaattaaactaaagagcttctgtacggcaaaagaaactaccatcagagtgaacaggcaacctacaaaagctcttgatttctaatgacatcatatgggatgaaccaacccaggaacagcctgactctggacctcttttaatgtcagaaataaaatcttatttgtaaaccactcttagttgttcaggttgttgacacaggcactgaagtgcctccaaatggtgatgaataatgaggcaaaagtcaaagacagcaagtctagtgtcaaattttttgatgcctatgggtaagaagttcaagaaagtgagctattttctttctttttaaaatttatttttatttttgtgggtatatagatgtatacattagtcagctattttcaatagtgagaagggatgttgccacttagtataatgcctttttcatagctatcatagaaaccatatatacatatagtatagaaaatgaggatagatttctgacttaaactgcctatttcatttgtgtgcctggttacacctaattcaagactctacaatacagcattgctagcaattactgtgagaatatttcaagctccctatttgctggaaatacatttcatttttttgttccaagtttatgaatattagaacctatctaaaaaggagcttttaaaaacttgaggaaaggaaaagggagggcctacttttcttgcctgtgttatttcttgttactgctgattgagatgctagagatcatattgggtgagatgtgtcttagaatacagctgagcaattcacttttaacagtttccatctgagtacaaaaaactggtatgtgcagaaaacttgatattctgacttggcgggattctaggatttgttctatttttttctgtaattgttgtagggacatatggccctgtaccttttgggcagcaggagccagaatagcaggaacattctgacaaaattcccactcagcatgagagggaagcagtccccttgatacactgatgatgtgcccacttagcattacaagtgtttgagaggtggacacaactaaaactcacctcactcaaaatatatattgacacggagaaagtaaatacaatttgctgttattaacctttcttctcaccattgagacatgttaaatatctgaaattaataaaggaattaaatttaaaaagtttacttatcatgcatttaacacatttattgagcatctgttatataaatgcactgtttcaggcacaagagatagagccataaataagcagattaaatcactattctcaactgaggtactaatctgatataagagaggagacagaaataagtaaacattataaatcaactacatacttttacatggtgtaaagtgcaattaagaaaatattattgaatagaggtcaattttggaatggttgggcagggaagaccttctgaggtgacaagaagttggcctgggcaccatggggagctctaccatggtgaaaagtgttccagacagagtagacagcaacagcagaggccctaaatgagaatgcacttggcttatctggagagtagaatgaaggccagtgtggtaggacacatactaataataggagaaaactgatagaaaagagggtttgagcaggtgggcaggaattggacaacatggtgtctcatatgtcataatagaagtttggattttattctacctgcagtgagaagttcttaataaaaaaaaaattctataaactggagtttgagaaagaactatgttgatgatagcataagccctcaatcacttgtcacataaactccaaacttcagcagagactcagggagatcaaagggactaccacaggattacccactggctaaaattcagatccatggcagttggtcctgactggaattagacttccttgtctgttgccctcattgcagtgggtctgaatgtctctgtcggctgtgaatttttctccctctatctgtggcactgagaaggtggcccagacttccagagtctgtctcattggcctattacttggggatttgctgcccttcttctggaagtttgggtatttgttttcagagcatacttaaaggcctcctgaaagcaatgttaacaatagcaggatatattttacagtcttctactcagacttggatttttaagaaccagggatggagactgtgtttccagatctagtcaaatcccttccaaacataaagcaacaaagtgccttttaaactaggacctgtactgtttaatgctctggaaacaaatacccaagcttcagccaaaggagggaaagctatgttcaggaagcttcctgaaagttttttgaaagcaattttcatgcattagtattttacatatatatatatatatatatacacacacacacacacacacatatatataaacatatatatatatacacatgaatcactaatgagacaattgatcttcaggaactaacgtgaaataattggggtatcttggtattattgttatagataaatgttgaagaagttcattctttcagatattaattgagcacttactgtgtactaagaactgtgatagatactggggatttaatggtgaacaagataaattctctgccatcagggggcttatattctaacaaacttaaaatttactgagtgttctctgtatttcagtattgttactaagtacactaacttagtggggaagctagacaataaacaaagaagtatgtaataagaattaatagtaagtgctgtaaagaatactaaagcaggttatggtagagagattaatggcagcgtgaagatgtccatgtttcaatccccagaacctgtgaatatgttaccttacatagcaaaagaggctttgaaaacataattaagggttatctgggcaggcccaatgtaatcataagagtccttatctaagacgggggacaaaggtcaaagacagaggaaaagagacgatttaaggatagaagcaaagaggagagatgttagactgctggctttgaagttggaaaaagtgaacatgagccaaaacaaacaaaacagaacaaaacaaaatccacaggtgacctttagaaaaggggtccccagtctctgggccatggaccagtacctgtctgtggcctgtttggaaccaggctgcccagcaggcggtgagtggtgactggtggacaagcaagttttaccacctgagccctgtctcctgtcaggtcagtggcagcatcagattctcatagcagcctgaatcctactgtgaactgcacatgcaagggatctagtttgtgctccttatgagaatctaatgcctccaaaatgctcaccccttcaaactgcccccatccgtggaaaaactgtcttccacaaaaccagtccctggtgccaaaaaggttggggactgctgctctagaagccagaaaagaggagatatattttcctctagagcctacagaaggaatatataggcctgctggcaccttgattttagtcctgtgaaactgattttggatttctgacctccagaaatgtaaaacaatgcattggttttgtttcaagtcactaaatttgtggtaattagatacagcagcagtaagaaatgaatacacaggtttacaggatggtgaattatggagggtgctcaggaatggcctctttgaggtggtggcctttaaacagaaaaatgagcaaagtgaaagaatgaaccatctggtggggagaaaagcattccagtcagagggaacagcaaaagcgaatgctctgagaagggattattcttctcaatgtgtttgaggactggcaagaaggctttgtgtgaatgagcaaggggaaaaagttagtaggtgatctcggagacatagccagggtccagattataaaggacctctcgccttgctaagcattttgactttattccaagaataatgggaagtcaatggaaggctgtgagcagggttatatgctctcgttattttttaaaggcacaatgtaactccaaaatggaaaattggctctgggctggaggtgccagcacaggggaaaccgaaagcagagagctgggttgggagagcggagactgaagttgtccagctgaggggtgcagaagtgcagactgcaatgacagcaggcagaaaggactatatgttctagacagaatggacaggatttgctggtagattggattgaaggcatgagacaaaggagacatggatgatatcaaggattttgatactacagatttgaaacattctgagagggacaggtttgtgatggaaaatcatgagtctggttttagatatgttttagaagcttattggacagccaagtagagatgtcaggtagggagctggacataatacctaaagttcaggagagtggttggagctggtgacatcatttgcagaaccctggatggtacataaagcacgggacagtgtgtggatagatcctaaagagagccctagggcactccagccctggaagaaggcagcttatcaaaggaaaaagaaagaaagaaggaaacacaatccttattacttccatcttcaggacaattcaaagccagtgtttttgacttcctggcttgagtgaagcttgaaaaatggcaacttgcccctttgcaaagctcctaaggagtagccattggcttggcctgtttgcactggctctgggtgagcttttaaaatgccagtgagctctaattgtgttgattgcctaacagctgtgaatacaagatgctgactccagaactgcaactcattctgcgaagggcaccgtccttttccctctaatgactgctgaacagagccacctgaagcctgcatggggtttagcagcagctgcacttctgctctaagaaatagctcactgcagtcagatcaaactgaagctcttccttgcttttcctcgaagcttgggtacttattgtcggagcattaaacagtaagagtcctagcttaactggtgcacagtgctttatgtttggtagggatttggttaggcctacaaaccgtctgagctaagaaccttgagaaactcctgctatagttagctctttctgtgactctgcagtgtgaccaggaatgaggacagaattaagaatttgctgcctctatgatagaactgtttaggcactagaacactggaactagatctacaaccctatgaatttaatttccttttcaactcccctactccttcttttcaatatgatgataatgatcttgtttaaaaaaaaaaaaagccttctgctttacttcccactctgctcctcttcccagggactcactttcttcytgactgcttccccattacaagtactcagctccctgttttatcaccctgcttagagcagccattatcagccttggctgaacattggaattacctgggaacttttaaaaatccggaagtctgggtctcgcctccagagattccagcttagttgtcttgagcgtggcctggacatttgggttttcaaaagttccctatgtaactttaatgtgcaaccacaattgagaatcactagcctccagactctctgtgttatcaaaattaatgagcagctgattttagaaatctcagttatcaggagaaaagggtgaacccccccagggctcttctccttttccaggtgacacttctttatggcagtgcgtgaaagtgaagccctgctgcttgtaatctccctcaagggagtgcaagatccaggcaaagacaagactgcagaggcgctaccttgggggaaagtaggaccctaaatacttacacctggaggcacttacctttaatactgaatttgtcagatgcaaatttgtctatgcaaaccagggccttatctctagcttcccctcaggggttttgggaagtgcgctactactctgaaacagggttgtaaagcgtcacctgtgctctccagggaaccctctggaaaggaggtggaaaaacagaggcttccacccttgcaactctaagtgtgttccttggccagtgggatccatcacctagtattttcttagatatgtggtatctgggggccagtcccacacctatgcaataagaatctccatttgaacaagatgcccaagcgattatatgcaagtttaagattgaggagggctggtttaactcgagggtaacgaaaagtacgaaatcgtactttacaggagaagctaggcggagggagccacttattcttcctcttgcagctgggtctttttgtggtgagtggcgaagcggcgaggctggcaggccagggtgctggactgggtcaggcgcggccccgcctccctcctgggtccctgccctgcgcgccgttgctgtggcagcgctggacgcggctagagctggggctgccgcgccctccacctccttctccaaaggcctccccggacccctggctcgggcccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgagtgcccggccccaagcgtcttcgcctccctccgcgcttcctccctctccccggcccaaggcctacacccacgagcttttgctccaccctccccttttctcgcctcccctccccgtgctcgcctcactgcccggacaggttaccgagtccccaagtcgccgcctcctccttcccaactgggaactcacgcctctcgccccatcccagaacccccagggattctttcgctacctagccttttcccgcctccgagaccttccccgggcaaacgtcacaagcagcttttgctcagagtctcagcagaaaatcttgagccccaaaggggaggtaatttacaaatgtgagaaggtcaactactcctcccctccaagttgaaaaagttttaatccattaactttgatggtacattgaaactataaacatctcacagattatgcctacacaagagttctgaatccaactctcattttgctgacttgaaaatgtaactccagagctttgggagtgtttctgggtttttttctgcccctcaccttccttgccattgtctagaattaagacttcttcaggctcggtctagaaacttttgatttttaatattgaccctagattattggatcacagttttgcgatgcttagttacgtcaagcggtttgcttaacgtttgccttttattgacttaaaattttagttacctaaaaaagttataatgctgtagtttacaacaaatacttcgagtctattttcacgtcttagtcaaatagccttatagacttaacagatattttataaagaccattttgcaagtcttataagtagactttcatatagtcttatttctaagtccaaactcgagaaatactccccattgttgaattagcttagatgtgagcggtgaaagacagatgaaatgggggaggaactacatcaaggttactctacttgcgaggagatgacttgggggagatggaatttggtattcaacctcttttagctaaatacaaatttatgaaattaaaaaaattgccttcccctgttggaaaacaagacacagtgtggtatttatgttacagaatagactcactgtcttaaagtcttgctcaaaagtctaacaaaatgaaaccaactagccagggattcagcactggttgcgattgtgaattctgcctgtgctgcatgtgccatgctcgctcgcttcacgaaaacagtctttgaccttaaagtgttttcaggtgttttaaaaaccaaggtgtagtattttcttgaaccttttaagttaaaagctagggatatagctatggaattatttgtaagtctttcaggcaattcgagttatgcaatatagaagtttataattacagtttggattagcccaaagagccagtttaacctacagtgcagctgaaatgctatagaattaaaatgagacattgtgcaatgagaggtcatacaaaccaatgttgcagtatttgtgtacaaaaaaagcaaacaatgacatgagaaaagaaatgctgttttatattgagtggtgattaaggtaaaataggtttaattagtgcacccctggcagtagagtttaaaatacatcttgacagatttgtaactttaaaggttgcaagtactgattctttgtttaattatgccctaaaaccatttggtggtcttttccttcatacaggtgtaccctttttctttgtaattaatacctggtattcaaaccactttgggcctctaaaattgggggcacagaagcctagagccttagtaagtacttctgtttatggaagaaaccaagagatgttttatttaggtaaaatatagccaggcgtggtgtgtccctgtaatcccagctacttgggaggctgaggcaggtgaattgcttgaacctgggagttggaggttgctgtgagcggagatcacaccactgcactccagcctgggcaacaagagtgaatctccatctcaaaaagcacaacaaacaaacaaaaacaaacactgggaaataagaaggagatattaagagatgatatatttaaatgttagaaatgctctgttgttgaataagcttagatgtgagtggtaaaagattaaatggaagagggagctacatcaaagttactgtacttgggaggacatgatatggtaggatgtggtggggggagagcatgtccattgctggttggcaagtgactggctgcctcagaaaaggatgagggtgggtaggggagatcactggagattattagaacatacgtatgttttcaagattgcttagtttttaaacctcatagtactttgttttcactgatgaaataaaatactatgtgatctttttctaattttccatcttgagtaataagcaaagacattaatgtattttatgaaggctctgactgccaaaattgggacaaattgatggtcttgttggcagggtaaatgagcataaccgtagtaattgtagttctttttattgggttcagggatgacctggaataatggatgtgttattacccttccctgtagaagtgaggctttcgaaaagaggctataagtcaatttgggaggcacaaagtatcagcgctttttggggattttttttttttttaagtagagaaatattttaaatgtgtgatataaagttatgcatgtgcttcttaagcacattaactcaaccagatccaacagctggtctaataactttttaattgtttaaaaaaatttaattgacacattgtaattgtatatatttatgagatactatttgatgttttgatatttacgttgtacaattatccaatcaaagtagttagttatccttcacctcacactttcattatttccttgtgggttagaacattcaaaagactctcttctagttattttgtaatatatagtattttactgttaaccatagtcaccatactatgcaacaaaacaccagaatttattcttcctacctagttgtaactttgtgtcttttgactaacctctctccatccttccttctcccctccccttcccagtctctggtaactattctaatctctgccttatctatatcaaccttttataatagaaaaagattctacatgtgagtgacatgtggtatttgtctttctgtgtctgggttacttctcttaacacgatgtcctccaggcttagcattcacaattgacaggactttattttttaatggctgactagtattccattatgtttctgtatcacattttctttattcatccattgttgtacgcttaggttgattccatatcttggccattgtgaatagtgctgcagtaaatatgggattgcagatctcttcaacatactcattttatttcctttggatgcatacctggtagtgggattgctggatcatatgatacttctatttttaattgttttaggaacttccatgctgttttccatattgactgtactagtttacaatcataccaccggtgtgtaagtgttcccttttctccatatctgtgtcagtacttattttcttttgtctttttggcaatagccattctaactggagtgaggtgtatctaattgtggttttgatttgcatttccctgatgattagtgatgtcaagtatcttttaaatgcacctgttgatcatttatatgtcttcttttgagacctatcaattaaagtcgtttgcccatttaaaaaatcaagttggccaggcacagtggctcacgcctgtaatcccagcactttgggaggccgaggcgggcagatcacgaggtcagaagatcgagaccatcctagccaacatgatgaaaccccgtctgtactaaaaatacaaaaattagccgggtgtggtggcacatgcctgtagtcacagctacttgggaggctgaggcaggagaattgcttgaacccaggaggtggagattgcagtgagccgagatagtgccactgcactccagcctggtaacagagtgagacttcatctcaaaaaaaaaaaaaagtcattattattttatctgttgaattaattttcttatatattttggattttatccctttgtcgcatgtatagattgcaaatatttttctcccattctgcagctgttttcactttgttaatagttttcttcaaggtgcaaagttttttagtttgatgtaatcttattttgtctatgcttttgaggtcttattttaaaaatccttgctcaggtcagtgtcgagaataatttcccttttttcttgtaatttcatagttttcaagttttacattttaaatctttaatctatttttatttttgtatatggtgagagggaggggtttaatctcattcttctgcatgtgaatatctgattttcctagtaccatttgttgaagagactgtctttttcccagtgcatgttcttgacatcttaaaaattcagttggctgttgtaggtgcaaaaatttatttctgggctttccattttatttcatgggtctgtctggttttatgctagtaccatgctgtgttgatatagttttatcgtatatttcgaagtcaggtagtatgatacttccagttttgttctttttgctcagggttgctttggctatttggggttttttttgtggttctgcatgaattttcagattgtaacatttctgtaaagaatggtgttggtattctgatagcaattgcattaaatccatagatcactttgggtagtatggccattttaacaatataattatttcaatccatgaacatgtactatcttcccatttattgatgtgggaagataatttctttcatcaaagttttatacttttcagtgtagagattctttcacttccttggttgtttatttctaggtatctttttttttaaaaaagtactataaatggaattgttttcttgatttttcacatagtacaatattagtgtatagaaatgctactgatttttatatgttgattttgtgtcttgcaactttactgaattctaacagttcttttgtggagcattttgggttttctatctataagatcatatcttctgcaaacagggacagtttgacatgcttctttctaatttggatgctcgttacttctttctcttgcccagtttatctggctagaactttcagtagtatgttgaatagaaattgtgtaagtggccatcctttccttgttattgatcttagaattgatctcgttattggtcttttcccattcagtatgatgttagctgtggatttgtcatatgtggcctttgtgttgaagtacaaactttccatacctaatttgttgggtttttaatcatgaaattatgccacattttgtcaaaggcttttaatgcatctattaaaatgatcatacagtttttgtctttgttaatgtgtatcacatttactgctttgtgtatgttaaaccattcttgcatgcctctgatcccagtgatgaatcgcacttgaatgtagcaagttatctttctaatgtgctgttggatttggtttgctaatatcttgagaatttttgcacctatgttcatcagggatattgtactatagtttcctgtgttgtattgttatctgattttggaattagggtgatgcttgactcatgaaatgagtttggaagtattccctttgcttcagttttctgaaatattttgagaggaattgatattggtttgttaaatgtttggttgagttcagcagtgaagccattcgtttctgggcctttctttgatgaaagactttattactgattcaatttcctcacttattattggtctggtcagattttatgtcttcctaacttaatcttgataggttgtatgtgtcggggacttcgttttttctatgttatcaaatttgatgaaacttgttgaaaaccaactctaaattttgttcatcttttgaaattatttttagtctctatttcatttatttctcctctgagttgaattacttccttacttctaccaactttgggattagtttgttctgttcttttttttctttctttctttttttttgagatggagtttcgctcttgttgcccaggctggagtgcaatggtgtgatctcggctcaccgcaacctctgcctcctgggttcaagcaattctactgcctcagccttcctgagtagctgggattataggcatgtgccaccacacctagctaattttgtatttttagtagagacggggtttctccatgttggtcaggctggtctcgaactcccgacctcaggtgttctgcctgccgtggcctcccaaagtgctgggattacaggcatgagccacaatgcctggccgattagtttgttcttaattttgtagtgccttgaggttcatcattaggctgtttgtcagaaatctgttgtcttttttgatatgggcatttaatactataaacttacctcttaaaactgcttgtgctatgtttcgtaggttttgttatggtatattttcattctcacttgtctcaagaaaaattttaatttcctttttaatttcttcactgacccattggttgtttaggagcattttgtctccatgatttgtgaagttgtcagtttttctcattgttgatttctagtttatttcttttctttctccttccttctttccttccttccttccttccttccttccttccttccttccttccttccttcctccctccctccctccctccctccctccctcccttctgtattgctttgtctcccaggcccaagtgcagaggcacgatcttggcttactgcaatctctgcctcctgggctcaagcaatcctctcacctcagcctcccaagtagctgggactacaggtgtgtgtcactgtgcctacaggtgtgtgtcactgtgcctggttaaatttgttttttgtttttgtttgttttgttttgtatgtttagtagagatggctttcgccgttttgccatgttgcccaggctgttctcaaattgctgggctcaagcaacctgcccaccttggcttcccaaagtgctgggattacagccatgagccactgcacctggcctgatttctagtattataacgctgtggtcagtaaagatacttgatattatcttaatcttttaaaatttgttaagacttgttttgtggcctaacatgtgatctctcctcaagaatgttccatgtgcatttgagaagaatgtgtatctgcagctgttggacggaatgttctgtaagtgtctgctaggtgcatttggtctatggttcagcttaagtccaatatttcttgatctctctgtgtgtgtttgtgtatgtatgtctagataatttattcattattgaaagtgggctgttaaagtctcttactattattgtattggagtttatctctttaggttgaatatttgctgtatgtatctgggtacttaggtattaggtacatgtatgtttataattgttatatcctgttgttgaattgatccctttatcatattatgaccttctttgtctctttttacagtttttgacttaaagtctattttgtctgatatgagtattgctactcctgctcacttttggattctgattgcatggaatatctttttccatttcttcactttcagtctgtctttaacggtgaggtaagcctcttttaggcagcatgtagctgagttttttttccagtcctgcagctactttatatcttttcattagataatttatttacattcaaggtttttattgataagaacttatttctcccattttgttacttgttttctggttgtcttgtagattctcagttcttctttctctcttgtttacctctgtggtttggtcattttctgtggtcctaagctttgttttccttctatctcttgtttatgtatctgttgtaattgctttctttgtgggtaccatggggctaacataaaaagtcttgtagttataataaactattttaagctgatagcaagttaactttggtcacataaaaatactctagacttttttcctccgccatccctaatttatatttttgttgcctttatttctttagtatgtgttccctagccattgtagctgttgttgtttttgaccagttgtactttaaaccttcatctagaggatcgacaggtttacatagtaacatgatatcactggggaattctgagttggatttatacatttacctctattggtgaggtttatattctcacatgtgttcatgatagttatcattttttcatttacagctgtagcactcctgtaaacattgcttgtaaggctggtgtaggagtgaattccctcagcttttgtttgtctgggaaggcctttattctcctccaggatagttttgctggatatagtatcttttgtccttggccgagactcgtttttttttgttcttttagcatcttgaataaattatccctttctctcctggcatacatcagtaatttaatgttactgatgagaaatctactgatagtctaattaggattcccttacatgtaacttgatgcttttctcttgcagattttagaattctctgtcttcaacttttgacagtttgactataatgtgccacagagagaatctttttgggtttaatctaattgggaatctttgtggttccttcatctggatgtctatatctcccccaatatttgggaagtttttagctattatttcattaaataggttttctgtgcctttcttcaacttttctccatctgccagttctataatgcaaaaatttctttgcttagttttttttaaactttgggttatttcacaaaacctattttcagattttgaaattctttcttctgcttgatctggtctattcttgaagctctcgattgtgtcttttattcactgcattcttcagatttctgtgttttaaatgatagatcttgttttaatttctcattttataactttcctgatttcattgggttgtttgtattctcttgtagcctgctgaatttttttaagatcattatttttaattttgtttcaggcattttataaacacccttttctttggggtctgttactagagactcactgtgttcctttggcagtgtcgtgtgtccttgctttttcatgtttcttgtgacatctgcacatctagtggaatagtcacattttccagttgtatgcagtagctttcacagggagagacttttcctgtagatgggtcctagagtgttggttgggtatggtacattggctttggtttggggtggattcagtaccatggtctctgtgtagtttcgtcagctgtaatcttcacagcaatgtctgatttcctcagtggcctaggctgcaggagtttttgatggtggtatagttttgctagggacaggcatgtcatgctagttgtcaggctggacacttgcaggctcggagggctgacaagctgtcttttgggctccccagggaagagaaagtatgattttccagcttttcttctatgtttatttaaaactttgttgtctggctcacagtgttctttatctaaagtctagccagtggtggtggtcatattgcaatcattattacagcttcagactttctagaccttttccattttagtgaccttcagccttcattcgcttccattcatgaccacagaatagatgtagtcatctctattgaaggcaaacccatcccatctcttcagcttcatctagaaatttgtttcatctgttacactttctttctttggtttttagccttcattctctaccagctctttcacttaagcagagatatgttcaagactctcccattctaacagttccctgccttgatcctacaagcttttctctttagctgctaccttgctttttatttttatttttttctcacttgctctgataatctcctagaaaaattggcttactctgaccatctccattagttcacctcttaattattcttcaaccatctgagacctggctttgttctttctctactgaaactcttcaggcagagattagcagaagtcttctaattgctcaatgaagtggaaattttcagtccttattttctgtatttctccttcatttgactttgacttaactctcttggtttttgtaataccaccagcacctagtttatcagtctctcatgggaacttcattctatctgcctgccaaatggtggagtcccaaggactgtggtctgatctgctgttcctcattacatgctttctggtcagtattgcacactgtggttctcatctaccatcatctacctccagaagtgccatatatttagtaagtttacaagaaaagcaactttccttgctccgtagactaactctgatcttttgttccctatcatggttatggaactcactaattattcagcatcagctgtcagaatgtttaactttgctatttaggtttgtgtaagttatgggacaataactaggataactagaattagcttgtagcttatgtgggttagataatacaattgcatatgtaagtagtgaatattttggcttaataagtgaaggagtatttaggaagctatctggaatgttatctaagtcaggattctgaaggtaactctagcctcactgtcccttactcactatttctaaacacccaccaatcctgcctactttatttacttggtatttctccaatctgccatccttctctgtccgaccaatcactaccctagctcaggccttcaaagtctctcacttgacctactccttcacctcctttgaacctgtgcacaaatgttagcttcttagtaaggctttctctggtcacctgtataaaattcccatctgctacatacttcctggttccctgtattgccttatattcctcagtggcatttatctccttgtatactatataatttctgatctctgtcctttctattaccaccccacttcaagatggcaaggatttgtctgttatattagtgactgtcctaataggaaaaaaaatggcacatttatattagagtaacttgagaagaatttttaaaagtcagtatttataaagctgtagatatagagatagtgaagtactcttgggactagtaatcattgggcaggtgataccatttttaagcccaaaagggcatagtgaaagagcaggtgcctgaacctggattcagagagactatgtagaggaggccactaggcaggagctgtggcctttgcctcagcttggctgattacctcactaatcctcactaatcctaaattacccaagttccttcttttctggcccatttcacagtccaaagccaactttaagccagagggcaaggggagcacttgatgcagtccatgcagtatggcctcccagtgaacagggcaggtggaggatagaaactaaatctagatggaggagagggaagatattcagaatatgttttttctttactgtcagcaccttgaagagtgcctggcatatagataatatttattgaatgaatgaatttgttactggtttactggcctcatgaactttagttttgcctattctattataacttggtgactacattcctatatacttgataccaactcctcattaactacaaaggcagtattcccctctccccctttttaaacatcaaaactcttttttaaaaaaaattcttaaatgaatcgccagtatataacacataaaagtatgggtgccttgattggagtggtgggtaaatgatcctgagtctgtctgtttgggttccctctttgcctagcaggaatgtgactgtcttgtttaaagcccactgaagtagaaaacaggatgagagacacactcttcaacatggcataagatttccatgcttggctcctgcctatctctgcatcctcatttctcagtagtttcctcatattttaccatcctgtaattgaaagaattacaaaactagttctctacacaagctttcttgctgttccagctgctgggaattagcttcctttgtgcttttttttatttgaatgattcatgtttacattcattaaaattaatgaagattcattacagttgttttctctttaggcataattggatctcctatactgagacattgaatgcaactttgattgtttttttcccccattatatgttaagctccttgaggttcttttcaactttgcgttattccaggatttctatcgtaagagttaaggttcatccacttctctgatgtgaggttcatggcaggaaggttccatgttgctcagctgcagagtagaaaatactgagcagggcttaaatagattaggatgctgccattataatataaactgtgtttacgaaagagcatcatcaattcagaaaatatctttttcattgactacagtggtgcctgatgatctttctattacaatcttaaattatggtcattttaattatagaatcatacatgggtttatttatgttaaaataaggtaattatcaagctagctgtgacctatgagaaaaatcctgaagaaatgatgaagggatcaggtgactgtttttgaagtcaagtgtgaaaggtcagaccactctgggtcatgggaccctgccaaggcagagcaggtcaagtgctgtgcccagtggggccaacccccagtatggtgccagggactgggtgtgagaagtcaaaaattaagaatacacctcagaaaggggacatggacagatgccacagacttatttgcgtatttcatgatttagcccttagcttgtgctgatactggatcagatattttcagagttcagtattttcaaaagcatcgctgatcacctgttggcattgttttacatctcaaccaaggaaaaacttttgggacatctgtttaacaaggggtaagcttttatttgaaatgttcgattaaagcagaagagtcaggcatttttttgtgcctccccaaagaaagatttgtttactgtcctgtgtgaataaatataatgtcattatttcccgtaaaggaaaagctgatggggagagtaagtaatgggtaagattaggcaatgttaagctcatatattagtatgtttaagagtgatcaatttagggatctctgtgacagagatgccaaatgctcacagtgctatctcatgttggaaacatgtgtctcctccacttttcctcagtcctctgaaatgacggccctttagggattgacagatactatacagatttctgtgctgatatgtgatttgtctaaaacaaaagtttcacaaaacaattcttaccattgccatttaagagtcactctgatatgctctgtttccattgcaaacaaatgctcattatgatttgtgaaattaacttcacaatttcctaatggataacaccttgaagtatgaaaagcactacaggatcttttatagcttccctcctccagctctctataatctgctcccatctgtggtgtaggaaagatttcagcagtggccgctgaaggccctaagatcttgtctcaacagatagcaaggtgcataacagactttggacaggttgtttaacatgtctgagttactgtttattcactggcaaaatgaagggcttatattatattgtctctaagtactatcagttctgaccacctatgaactttcattttaaagaaaatacctatttctatggcctttaggcattagggaattttgtcaaattaaataaatctcagtaaggtttgatggtcaatggggcccactgtctggtgtgtgtggaggggtgttgtattttacatcaggaacttcagagccctcatgaatttctaattagaggaaccacctgggaaatataagtcaaagccctttgctcgccttactcagctttagggcacagtgactagaggtgggcaatcgctttggtgtaggtattgtcattggaaaggaagaaaccattttctggaggaaaagaattggttgaggctagctttaagcagctatttcatgatggacaaaaggactagctcatccattcttcattcgtttctctgtatcctctatcaaatttctgagtaaagattttatacaatgcttgattagcattcaaatagtatgtttcaaagattttaaaaaaaataaaactaggcctttgaatcataattatggcttataactctatttttcatatacttactatctcaagttacaaatttcatgttatgtttttttcaaaagagtattcctgccacaactcagagctcagctgaattagagcagtgactagaaaatctgagaaggctgagcttcaaaataaggtctggaaagtgtttcttattgttacaagagagtcaaaatgattttcttgagctttaagtttatgtaagtatttacttgacacttagcagtttaaaagataatgtgcaaaaatatgaaaatgagaaaaaacaatttcaaaacaagagttggtgattacgtgagacttagtagagcaaagtatattctaagtattaatctgtctaagctgtttgggaacagatgtacgtgaaatggataccgggtgttctgttgtgtacaccccaagtgagacatctgttggtagactgtgtggtcagaaataatggaagcaggggttaaaccccaatatgacctattactcatgtgaattattgaaggactaattactcagtaaaacatgatgctttgattcatcagtctacacgttaagaaaaaagcctctttagaaaaaaatttagttctgtttctaagctgtcaaatttgaggaaatttttaagatgtatgcaaagactcaaatttccatagtaactgcaaatactatctgcttataaagttttaaaatgttttgacaggtctactaatttatcataaaaatagcctcaaaagttttagctttttgttagggtaggttgggtctcacagaaaacaaatgtagagtgaattttctaaagcagggctgtccagttagacttcctgaaatgatgggagtgcactatatctgaagtgttcaatacagttaccaccagctacatgtggctattgaacagaaacatggctagtgtgactgagaaactgaatttttaattatatttaatttttattaatttgaattcaataactgcatgtagcaagtggcaactgcattgtacaacacagctctgacacatggagagttgaaaatgtttgtttactttcttcccaagttttcattttagtctttgtttctacatagaaaggaagatatagcttttgaaaaatgaacctgaatgtagaactgatatggttatgcaatttgagctgcctatttaaagataaagcaactgagtttagagatttcaaagtggcagagtcctttaacatatttcgtgggctggccacggtagctcatacctgtaatcctagtactttgggaggctgagatgggaggattgcttgagcccaggagttcgaggccagcctgggcaacatagcaagaccccatctcagggaaaaaaatatgtgtatatatatgtatatatatatatatatatatatatatatatatatatatatatgcatacacatatatacatatatacacacatatattaacatattttgtgtgtacaaaaaatatttttattatgtgtagattagttggttactagtaaagttgaagtcttgtctatagaaatcattgtatttttcatggtcattgtgatacattgtttgaactgaaatttggcaaattcaatctgtttcttactacaagaatagtacatagatttgaaatggtaactctcttagtctgtgtactctgaccctgtgaacgtctggagactaatgttattcctaaatatgctatgtccacatggcagcatctgaaggcaaacactttttaaaactgatctacttttgtggacccttcctctctctctttcctgcatcccggatggggccctctggggctggaactggcacagaactattcccctaggagtgggttcattgaagccaagggacacacaaattgagaatcagatagactggaccaaggtcattaaaccagagagggcaatccagatggggttgtccaaagtaggaagttctgaagtgaattgcagaaatccaaacatggcaaagctaaaggaatagagaaccagggcaatggatatagagaacagagcaattgggtatgcaggaagatgctattgcctagactggatgtttttgtaccctctgtaatttgagaaaatggaccgtccttgttgaaatggtcagggatgtagtagataaattcattgcagttgtgtaatctcagcactagaatactgatcataaccatatcacttgttatcccacctagcctgccacttgattgggttattagattacatttcagacattgacaagtctacaagcatcattaaaatcctaaacacagacttctgaccgtattcctacccaagttttagaagcactatgccaatgacgggggtagtatatgctgagcaggtgagttttgattgtgtgtgtctacatgtgtacgtgggtgtggtgagcaacaggaaggaactctcagccatgactctaaatgctcttgtgttggccaaaattggtataagctaggaggagaaacacaaaggagagagaggcatgaagttgaaggacattaaaccatttgcaaacttttggcatgcaaaccagaatatgaggaaacttagtgtaatgggtgactgaattcagaggtagacaggcaatcaggaaggtataggcaccaaaaatagttaccattggtgagcgtttttgtttttgtcattggcatggtgttatgaacttatgttaagcctaagggtaagtctaaaataatgtaccagctggcatcagggaattcccatgtacattcctagattttcattagaaacagtgttctggaaactaccactgctgctacacagcagtgcccagtgcttgactgaaaatagtgaacacttagatttgtttactctgccaggttctgtgctaagtatcttatcttgtttaaccttagcaaagaaactatgtagtctagatagaatttttatccctagggcccagaggtgttaaataacttgcccaaggtcataccagtaatttcagttgctggggttcaaagctaggcagtctgactccagagcctgcactgtccccatttggttatgttgcttccccagttaagcaagcaagagtctatctgacatctgagttggtggtagtaaagcatcatggtctgaaccaaaataataaaaacctttgaaacaacattatctgacttctttcaggcttttaagacagttccatcatcaacagcttattccatttctctggccacttccagtttctgaacaaatgaagaaaatgggagtgataaattggagtttttaacaagtttttttaaatctaattttttttatggaaaccaccaaacatacccaaatgtaggaataattatgtaataagtcctcatgttcaaccctaagaggggtgaagctctatgtgacccattactgagtttaaacagttttcaatttatggccagtcttatttcatctatactctacccacatcccttcttcccctggaatgattgaagtaattcctaggcatcatataatttcatctgtaagcatctcagcatgtatctctaggagataaagattttctaaaaaatcatattactactcttcaaatttaaaataatctttatagttttacatatccagttagtgtccagattttcctgatattttctctattttttaaatatgtcaaccttgaaatgaggtccatattatagctgatggctatgccttttaaattttctcatccacagattcttcttccttttttttcctttcaatttatgttttgaacaaactagtttggcctatagtttctcatgggcaagaataaccttcagactgggatggccatcactctgatacccgtaaaggggatgaggcaggttggggaagggagagcctcagaccatgatcagatgtcacaagatttttgcttacctagggtgaggacttgggaaaaagattgcccattaggagtcctgccttgggcaaaagtggccaaacttcagctgtgctgtcacaggctgtgggctgccttggaaatgtaggacctcaactcctctgaagttgaggtggagcttgagggtacgaatccctggtggccattataatgactacactcattgggatggcatggcaagttcatcctcaaagatggatcctagcatccaccatgaccaatgaggtttttttattgttatgatcactataaactcaaggatttaaacctattaaatgtttttcaattcacagcaatgattatttttactgatcttcaaattgtcacattttggatttttagaccaatgggagccccttcatcttgacttctgagttcttttgacattcactcagctgtctgatagcttccctgctttctggaatggcaagatattccaggttcatcttgaacatttcatgcttgagatatggaatcaagctcatcatcagagggtcctggttccttttactggatagtggtattagagacctcaatttgagaactaagcaacatcattgctaaaacttcccctatgtgtaccttgttacttaggtttttcaaagaacagagctagaaaatatgttgggtttttttgttttgtttttaaagaaaaaatgtatcataggattatgctgatacttccaattcaagtgcaggcctaagcttttcacattgtctcttttctcctacccttaaagtcctgattcctaactataacaacatcattactcatttgctttatcctgcattatgtagacacaatagagtaacaacaccaatgctgccaatcaaaagtataattactgaaacccacttaagatagtcctgcaatttttttttttgttcatagagtgtacactactagggaggtgtagtcaaattactatgttttaaagacacttggaataattcatatctgtgaagttatacccccaacttatttgttttttgtattattgtttcattttgcttttgatgtttaggcatttcttttttaaaaatcaattttataattacgtgaaatacttatatggttccaaaatcaaatctactaaacaaactatattctaggaagtatagcttttatgtttcccttctatgcttttccttccttcctgtaggtaggaaagcttatttgttcctcaaagctctgggttgttcttttattttatataaataaacatgtgcatatattcttttcattacccccacagtacccaccgtcttaaacacatgtacaatatatgtgtttttctaccttgatttctttcttacttagcaatatgcccagaagttcactctgtagcgctttacatcagcatcaaaatccattatgtactatcgtttattgacctctctgttggagaaatttggattgtttctagtcatttttgttatcgcaaatagtggtttaataaaaaactttactttccgttttttgtttttcaatgtgcttttaggatagatgcctagaagtgagattgttgagtcaaagaataaatgtgttaataattttgctcaatattaccaaattctttcaaaagggttgtgcaattttgctttttaaaatcattattgtataagggcatgtatttcctgaaaatttctccagaagagtttattgccaaactttaaaaaaacagcctgatacataataaatgatatctcagcatagtttaaatttgcatttttcttgttaaatcattcatgtttttactgtagtcctcctaacatttagggagcaccaattatggggtctctagaaggttccaggattctgtaatcaatttgacatgatttctgtcttcagatattcacaatcttcaggaagatatattgacaaaagaataactacatgatctattttgtgtgcaacttagtacttacagagcattataaatgcacatggaaaaataggtaaaggagaaaatcattctctgttgggcgggctgagggggaagtcaggaaaagctacagagaggttcgagggtaaactttaatgtgggccttgaagtatgatttggagttagcaagacagacaaaggagcaaggaaaccattctagaaaaagaaaattttgaaaaatctccagaaaaggatgctttggcctatttggaaaataacattgtcttatttatgggggagatgacagtgctttgtttttagtcagtagtttatacaggactttgaatagcatgcaaggaagttggcgtctcaacctgaaaattgaggaaggtgtgacaaaggctgggcattaggtgagatcaagtatttctgtttttttttttggtaaattaggtagcaggatagattataaatgggctccacactgaggagcccagtgtgatggctgatccagcagatcagggggcagtggctgcaaagctgggagaatggcaaggtaagcctggatgcaagggatattgtcaaagacaaaatttgggggatgtgaggcttaaaagggaaataaataatggtgatggtgagatttctagcttgggcagtgggatagatagtagacgctgcgcaaattcgtttttaaatcagcagaatgagaagcatcttatttgaaatatattctaccaaatcttagcatcaaatgtgctagtgactagcaaaatatgtaaacagaagggaagtagcttgaaaagtacacaaactggagaaattgctcctgaaggactgtaagttgaacccttttaagcctaagatctgtatttcctatgagccctaggctctttccttgtgtatcctgtttcttattagagtagaggctacttaaaaataatcatagtttaaagcgctctattttcagaaaacattattcattagatgttagtaaataatgtaatctttatacattcataatatttctgcattattggagtgtaaaaagtcagtgaaatagtcatttgtaaagatgtcagtttttatctgtggaaaatagctgttcataccattttaagcttaaaagttcttcatttacttcttaaaatatccatgttggtattattttgtctaatacaagtaattaatatttaccccaaattaagcttttaagtttactaaatgttacaaacataattcaaagcactgtttagtgtccatctgtgcaggaaaaataagatcaatacaattgagcagctgttagcatgtattggtttccttatattttaagtatgttttcatgttttgaaggtgtaaagggatgacagtatgttttgttgtggttttcatcatacagataaaaacttattacagttgaaatcttggtgaacataatacattttaaaatttccattcctcacccatttatctagatatttagacacagtaaaataaataacatggatacatttttgtcatgtgatttatgttttttaaaaagtagaaataaatttctctaaaagttatttttattttttaaatttagcatttttcatatttgaggaaaaaacaatatgtcttggtaccctagcttctgaactaataacacacctgtcattttacaggttattttaatgtttttcattgggatcaaacctactctggaaatatctcatgggtgagctttatttttatgaaatgttcttggcacttgaagacctttgtaggtacatgccagactcatcttacatccagttcttctgcatggaaaatatgtgcattgaaattctaagtgccttttcaaatttgaccttcttagagaataatatgagtcccaacaattaggaaaactatggaatgccttttggcctttacttttcaaagattttcagtcagtaatgtttaattagcattcattgtgtacattgtccttttttgtgtgatatggctagttccaaaggaatattctagaagatctcagccttctgctattgaaggtgataatacactactaagttatgtgttgctttacattaaaataatgttgcagcagttacttattgcttaactagcgggtataggacatcaggttgaaataactgattttgaagtgaagagttcttgtttatatcttaaactaaccaagtatgttcattaactttgagaataacaatgatctttttcattattcttgagtagactggataaatcagaaaacccatgttagaggtccctgtaaaaacttcagtcttatttggtaagtccctttataagagtttcaataaaatcaggtaaatttaaactctgaaaattctacgtactgtctatcatgttcaatttactgttaaccagtactatgcactggaaaaaatttttttcaccttaatgagaccactggtcattactgctgctactgatgctcttttgtctgcacatactgttgcaacataatgtgttgtgcatttgatacggatattatcatattgccataaggagctgctattattttagacaccaactgattccatgatagtgtcagatttctttaacatatgcttatgtttttgtacaaatgaccccaagaaacatctgctagttttgtggtggtatctactgtttcttttttagaatttgacctgtcagtcactttttaacgtgaatctacaatatttgagttgtattcctttctcgtttttatgctattgatattaacaaaattgagtcagttttatggcataattcagagagaaaccgaagctgtctatggatgttattttaaaaatacctttttcatgatgattgtgcctttaaatttttgtcattgattgacactttaaaattgaaaagtgcccttttaatggatcctttaggttccaaaatcttaagttgaaaatttctgtctattggtcctgaaagtactctctgaatttgataagtatgtagtagttgtggtgtatccttggtcagtttatatcctgtgctaattgctaatcttacttagtttctttgatgcgtgtgtgaagacaggcaaagaaaaaggaagtggaatttctacaaaactgtgaaatctttactttatggagactagagaaatttctaagtaaaagaagacactcattctattgtagttaggatcccttcttttacttgcttttcatgatcttgactgaaaagcaacaattgagatttccattgcccgacgctttctcttctgcttttctttttgtttctcttgcatttttaaagacagctatttattcaaaaacaatatgaacttttatttattggacttaaacctggaacatcaacaaaacaaagaacaaacaaaactacctttccaaatttattttattagaggatgctatcaatacaattttgtattatgttcacacttgataccaaacctaaacccaagaaagtgtgtcctgtgttacagcctatccctctgtttaagataataactagaacaatttacttttattttctactcatctgctttctgtgtatcagctgttgtcctccctcagcctcgaagcatgtcatcatttccatctccgtgctcattcagtcatccttgctgctcttagtcccctttttgtcccttgggtgacttatgtcattaggacaaccttctgtccccacttggctgaaactgagctgaggcccttgccagttgcattaggtgtggcacctttcatggctcagtttgggcctctgtgatatctgtgtgccttctactccaaactccattctgccagaggtggcagggtgactggaagctttagtttcagtgacaaaacccaagcgtggctatgctgagtgtctaagtagctttcatttaggcctgaaataggagagtcaggcgcctctgtgtcccctgagaaagagagatttccctcagctctctgggcccagcactcaaccatttaagtcagctggttagtataatttccctaaattgtggtttagtttccctatgagtaggactggagtaggaccaagtaaggaaagtccctagtgacctttctgcctcctgaggagcaggccatttactttgagttgtagcttcccatctgtctgtccccactaccctatccaaggccctggaggagccacaggatgagggaggagattcatggaaaagcgccttcaggtactgggtatgtctggagtaacatttaaagtttaaaagactctttaacaattttcctctgatacttactactgcctatacttgtttggttttagtacagtaagttttgcctatcgtgggggtgaagaaaatagaaatattcccattaactttgtatggtgcttggtatgacaccctgaacaggtgcacccgtaattgtttacttgatgttctttttaataagtcaattatatcatcggaaattgaagaatagcaaagttaatttgtttaatcattctatgggaactcttgcatgctcgttcactagaggaacattgcgtttctcccttaaaggacaaggctttgttttgtttttaataagacacactctttataattaaaacaaaatcccagtgttaagggatttctgttttaaataattggatttctttcctttgttcctctaatccctctatatgagaaaaaaatctaatggtgtcttaggataaatatttttagattaaaaagttctcttaaccactgaaatttaataatacttctcaaagtttatggatgatatagaatgtaatgtaaggttgagaattttagatttggcaaaggcaaagatacaaaaactagtgaaaaacaacaaactggaaacacttttaaaatactgatgtatttatctttgcaataaattattcagaaatataaataaactcactatttacatagttttatttaaatttgtcctcaaaatactaaatttagtactatatattttcttctttcagataaatgctttcctgaaaatggtattttaatatctacagatggtttagtttaacaatggttggggtaaaaatgacatagggaaaagcaaaatgtgacagcccagcttggttacctttagagaaactcagaataaactctattcccatttccttctctttcccctttccatactcgagagcccttttctgagactcttaagtcatgtttgggccttggagaggataaatagcagggtgggtggtaaaaggggagagtgctttgcttgaggcaaagttttcctccatatgggaccttcctcaagccctcccttcaaaccctttaaatgagagcatgagctcctaggacagaggtcatgtggaaagcagcattagcatgaaggggggtgctgtggaggggtgtaaggtgcaaaaagcagcattagcatgggggaaggtggggtggaggggtgtaaagggaatgagatgtgaagtggttaaagggccatttttctagttggcctctgggctttgatgaaccttttccagtgtgcctgtttctccacttagccctgggctaatcttgactcttaactttccaggtgtgtatctatgctgatttctcctgggtttggaagctctgagaagctctggttctagttcaatcacaagacttttaaagaaccagaaaaataaaacaattttttaaaaagtaatgaagaaaagacttttaaagaaccagtgaaaacctgggagtaaaaatatagaagacttgagaaatttcatctttacctttcaagtgggcagcatgagaaattcttgtaaatggtgctttcaaatcttacacaaggttctcagttacctttatttgtactccctagactgtattgcatcccttgctatgttgactaattcccacctaaaataattcaatggcctcccaatataatctggcattctaattaataagctaagaaattatttggtttttcactcattggcgttaaatattcttcagtgcccacatttggaaatattggaacacagaaatgaaaaaagatacaatcagtttctctgcttgccatgttttccttgatatggcaatacgacaacaggtcaccctttgaagaaaattcagagatgctaaagtagaaattaaaactgaagataagtcaaggcaggatagtataggagtctgctacagctgccatagcaaaatactacagcctgggaggcttgaacagaaatttatcttctcacagttcttgaggctagaagtccaaaatcaaggtgccattggggttggtttctgaagagggttctcttcctggctttcaggtggccaccttcatacagcatcctcacgtggccttttctttttgcctgcatggatagagatctctggtgtcttccttgtaagaacaccagtcctattggattaggaccctatgctatgacctcatttaacctaattaccctatttaaggccctgtctctaaatacagtcacactgggggttagggcttaaacatattttaggggaacacaagtcagtccataacacgtgatttgctatagttttcctttacctaaatcttttccaaccttgagagtggattttggccaggtgtggtggctcacacctgtaatcccagcactttgggaggccagggaaggtagattgcttaagcccagaagttcaagatcagcctgggaaacatggcaaaaccccgactctgggggggcagggggagtgggggaattagctgggcttggtggcgttcacctctagtcccacctactcaagagggtgaggctgaggctggaggattgctacagcccaggaggcagaggtcacagtgagcagagatcacaccacttcacttcagccctgggttacagagtgagaacttgtctcaaagaaaaaaaaaagtgggttttattcttccccttaaattcctattaatagtgaggtgaggcttcttgtgttttttttttttttttccaagacaatggttaatgtgtgattacttaaaaatgatatataacactaagaaataaagaattgttaagtgagaaggaacatattaaaatggcttggaaagatgggtaattttttacattttaagtaggttttctcaactctaactctgtggaacttggtcaatctaatcagtctaaatatagcacaaataataatagttatatggacaggagaaatagtagccctcaaagatagtgaaatacatctgaatatcactaacaatgtcatgaatttgcttgttctaaagttttctgaaagtatgaattcataactgagtttttttttttttgcctatgactactaatgtttgaggagagagtagtgtcagaaccacccccccatttattacatgtttatttcatattttggtactgaaatcagtgtttattttgtgtcttcctgataaatcttgccaataagtaattaccttccatactgaaaagttcttaggattaccaggttgctgggggcaaccttaaaaggccatgcagaacattgacttaggtggctattaccctgctttattcaggtctgagcatttactttcctactacaatcagaatactgacctacatttaaaagtgcaacactgccctgttatctaaatccactgtgttcctgagaggaaataccagaaaagagggcaccaatattatttttctgctgttcttgatcataagtgattacctttttttttggttaggcattctgcttctgaaagataactgaggttgaagttaatagaactaagattcttatataaaatcataggaaagataattttcaggattattgaatcatattgaaaaatgatataattgtgttaaaagataaggactaaaatgagttaattcaatttggaaatagttaaattagaatttgcttctgtttttgatgaatactgctttttgaaaaatcttctgagtatttaagcttttactactctagtcattctctctaaagtagacatagaagcgtgttcttatcttgatttggtaaggctctgaaaatgcaaagcaacagatgttgtacccagcataattatatgtatcctggaaacacatctttattgagtgggatttgttcttggggaaacaaaaatttggcaaacaaaggacattaacttgctgatctcagcagtaattacttgggttagattataataatcttgtgtaggtggtaactgcatgcatatattacaaaatctaattctaaaatacgtacattaaaaggaaaatgaacttgcgcaaactttagatcatgtatccccttgaagagcagaaaagatctcaatttcattatttgaaagttgtttgaacagctttttggaagaggtttccaggattccaaatcctaatatgtgtattgatactgaggctttggactaatctttgggggttactgccttttttatgcccactgaaaatagagcatttcaaacaaatgaactgatctctgatctttaagcatgccagtaactctttggaacaaatccatagttatttttaccaatgactgtattaaaacagtactttctgtattatctcttccattccaaggccattttaaaacaccctctttctcttctcccaataggtaaagtacgacagagctccttaggactgggttatggagaattatctggaggtcaatttgagaaccactgtgcaaaccatttcttaaataagtagctacaaggttgtccttacaaaaatttctgaagttgatggtgttgcgttttggagtctgaagcttaaataagagtttgtcagtggtcatggtctaaatagctgattactaccaaggtcatctaatttttttttaacacaaaaaaatgttctgagcacaaatgaaaccttcaggacaagacatttatgttttgagaatgttcttaaatgattcctgtcgtgtatcttattttacatatcttaatgatcagcatgtattttttgttgttgatgatgattttataaatgtgctatcacctagtttctaattcctaacagctccttcatcagtagaatattgctgtagcacagttttgccatctgttaagaaaagatggtgactaataagagtggcacatttcagggctggtgtgctatcgcaacatctagtgttttagtactgaggacagtgatgtatgcagtgttccttacagccatggggtgtgggaatgttttcctcttcggcaaagtctgtgtatttctatagctgaactctcaggatccagaggaaaaccacaagatgatgaaaccagatgattgtcatcaaatttctattccccactacatgattattagttttcgtcaaaagaaatactcatcctatcctgggttggaattggtaaagaattttgcattgtgactaggacacctaaaagtttttaggatgagtacaaatggaatttgatagatttccccaaaatgtttgggaaaagatttattcctccctaggaacagcaagagtagcagcatcacatgaggcaactcctggtaattttttcttcttgctcttatttcaatgatatcttttcattcttttctgtatctctcaatttctatgtttctcctcttaatgtatcctgtaaatttcttagtagaacctttttactaatgagggtttcctagtttgctttaggaggcactcaggatgcccccttttgtaaggcagtaaattgaaaataagaacttggtgaaggtccacgtgacggttagtttccattctccattgtaccaaactgctacagggaaagaaccatatttaatcaacctcaaatcctcaatatttaggtcagaaaacacttggcatagaagagacactcaaattttgcagctaaatagattattgatagaaaatatgtttcttgcctctacaagcaatatgaaaccaatacaatctctaaatatcttcagactactaggggcaaatactgtattataagaataattcttcagaaaggaaaatccagctactctcatatcacctctctatgttgaaagctagggaagataaactggcttccagccagtgagagtccatgtggacctagtgctggctggagatccctaatccaaaggcaagagccagatactggttgtctgctgaaaatcagaagatgacctctctggtagtaaggccagtgactcatccctgcatcttttatcctcttctgatttgtataaggatctctcctttttccccagtacccactctcaagaattgctttcctttttaacatgatcataccaaaatgtatctaacagtaccttgatttcctttctgaggaatttagggagcatatttactttgtcagactcattagaggtttggcttcttggtcgggttcttaaatggacaacttgtttgggtgatttggcagagaataggagaagccagtcccctctgatagagcaaacctggggagctgtggttgacccacctgctaactgtcctgtacaattaggcatgtggcatcagtgggtgactgaccagagccaccatctcaatggcggctgttctttccttcctgtgccttctcagatctcttttttgttcttgttactccactatattggtttttcttgagtttttttcaagcaaatatcattattcacttctactgcagttcctctgttgttcgctttttctcttagtcttcattgttttccattttgaacattcagagatccatcaaaaaaagtaaaataacaggaagggagaggtaaacaccagtcaaatgaagtattataatagtgtattactatactctttaaagtaattgaagggtggttttttggggtcagaatatctgttagaatttggaatttgccactcttgagactggggcaagctatttaaactctaagcttatctgtccttcctcacaatctgtaaaatgggatcataataatggcacccagtttatggtgtagtgagcattcactgacacaattaatctaaacttatttgcactacatagaacagaatttttgtctattaaacaatatagcgttttaggcatgaaagaaactttagattaaattaaatatcatttttcttaccacagggtaagtttctgttttgtttgcccctgtttctctaactcctagaatagtttccagcacatagagattaaacaaatattcgttgaatgaatgaatgcatctattctaatcctcttgttttaggaatgacccgtcaggctcaaaagtgaaagcatttccctcaagattggtgacagagttggggactaaatctaaggctttctcttcctacaccagtgtcctttctgagaacacgatgccattttctcaatatttgtttatttatatggtaaattggtaggaagctgtgtggtactataagaggataaactttgataatgaggtatacttgctatcaaattctaacattctcatttaaaacatggcataccatttgtcttctacattttcatatgtaaagtgaggtgatttctaccttatagaactattgtgaggattaactgaactaatctttgtagagcacctggtcccatttattttttttttttgctcaccccaccccccaactttctagctagataacttatacattcactctgtttttcattccttcttgaatctcctgtggccagacttgacccctgtcactctacagcttactcgtcaaggtcagtcctcatctgacttgacctactaagagtctgacaagtagtcacactatgctccttgatacagctttcttcacctaccttcttggatgtcattcttttggttctcctcctaccccattgggctgctttttcccagtctccattcttgggtattctcattttcccatgtctgtcctctgacttcttattgtctctgtttctgttttctctggttggaccttctctagtttctggcttcaaatactatctaaatgctcatgtctttcaaatttgtaactctagtctagacctctcctctgaattccagttttataaatcttctacttaaatattagaggtctaataaacttctcaaacttatgttctacaacaaactccacattttctcctgcagcctctaaatatgtacctcctatagattttcccatttcagtaagtgggaacttcattattctgattgtccaaaccaaaaacacttggagacttgctacattccaccctttgtctttcattctacatccaacctatcaacaaatcctgttgcctcttccttggaaatatatccacgcttgagcagcatcattgtcaccacttggtgttatacactctcatttctcacctggagtattgtatttctcatctggagtagtgtctgtccaacgatgtcccccatcagtctgttctccatgtagcaatttcgtttttgtttgttttaagattgggtcttactttcgccttggctggaatgcactggtgatcatagctcgctgtagcctttaattcctgggctcaagtgatcctcctgccttagcttctccagtagctaggactacaggcacacaaccacacttgactaatttttttttttttttaacttttactagagatggggtctccctttgctgcccagtctagtcttgaactcctggcctgaagtaatccttctgtgccagcctcccaaagtgttgggattataggcatgagccaccatgtctggcccagatgttaattttaaagtgtacattagagcacatcgttcttctgcatgttcagcataaaatccaatgtccttaatgtagtctatattaccctacatgggctacttgtgcctgatccctctactcttatgtcttatccctctcctgctttctcactagcaccagccacatcttaccgttccttgaacacaccaagtatgcatttgccacaggaccttgatgcttactgttccctttgcccagaaacccttggaaccagctatgtgttaaaattcagatatttactgattttagagagctaaaatggggtatatataatatattacataacactcacagctggtttgtggtagcatttcataattaaataatatttctgaatgaaacattaagaatgcccatgctaagagggatgagtaaagactcaactctcattgtcagttcagctgcagaatgaggtcagctcaagatttgctgccaaatgacttaagaaaaaaatgtttttggagctttggggatttcagaattgcagatgagagattctagacccgtacctacacagcatgctcccttattttgttccaatctttgttcaacgattatttattgggtagtcaaggaagatctctgtctaaaaggcttctctgtgtggaacaagactggcatgtggaaggtttccaattaacgatattgaaagagtgaagctcaaatcatttttcactcaaatacatactatttagaagacagtggccagtttaagaataatcattattggaaacaaagtactatttgattagggatagttaacacaaacacttattagtattagggatatgtgaaatacttaatggatgagtcatgtgctgacataaaacccattatccattttagttcctggtagcctaactggttgaactctgttttattgatctattattgatttggcctgtaacttcaagttacattttaatgtaatttcatccttttctgatcaccttgtgtcttcaagcatttttaagcagttgatagatagttgaaagatattatcactatttcaatctaaaagatattatcactattttaatctacttaaaatttttactacattcattttaagtatgacttatggaacgaatcgaaaatacaagatagtgaaaaacttgtgaggatcacctgaaattttagcattcactttccttacatagaggaacttagtctctctaaagaattatgagtaataaagtatcataatgatatttgtcttagttttggttaagtgtactccacaggagaaagttaggcatgagcaggaattattgtagtcccacattctcaaacagttctccagtaagaaagattttatgtgtttccagaaatcattttcctcctcttcagagctttgggaccataattgtatttaaattgctaatctgttttaaggaatcataataaattgtttaacatttatattcaatcaactttgtaatttgtataaatttttcagggtgacatttgaacaatttttaagaaaatgggaaatacagaagtattcttagttttaatatattttaaaaagatgacatgtgatctactgactgaaatccttcaatcatttttgtttttctccccaagattagatagaatggatgtgattttatttttaatttgcattatggagagtacttttggggggttttatgaaaaagacttcatttattttgttagtggtacttcagttgcataagaaaatgttcttttaaatatagtggtcatttgtgtgcagccttcaagttagcaaacatgcctttgagtagtcactatttttgaaggtctttatatctgattgcaatggcttatattcaatagtcctcctactaaatgaaataaaaatggatgcctcttctgccacagaggcacaggtggacatgttggtagcaagccccatgcggtgtgacacatggcacagcccaacatgggggcaaagagcatgcggcttgagctaggagtcactttatggctactttagtgtagatttgtgtttttctgtggaacagccattattgaagacatttatatagtatgatgtttgtttttcattaaatgctgattgtgatttcttaaaaatagttaagacttgattagcagaacctatttagaagccagagttcccctgcttcacctcttgctatctatataaatgatatttttgactctgtcctttataatgttggcaccctgtgcatattagatgtaatcagggctgaaaggaaacttgaatccatctggaagcaataaacttttctaaaagactgcacagtgttatttaatcctgtgacttcttactgtgagtgaaattaaggtttgatgcagttgtgtcacatcgtattgatatcaaatttatctttctaaaaaaaaactgacagtattacagcacagaggagaagatggcttgctgtaatcctgtaagctattttacattgattacatgctacataatgtacctaagtatataaaatacttgatctagaatgtttatgttttctccaaaattttctcatcaggtaatactttctcaacttcacctttagttttggcttcttatcatagtactaactatgcggtagtaattgtgttatgatgaaaggcatggagaagaaattataattttaaaactattataaagtggagacacacttgtataattaccatctatgtagactgccaaggtataaacatttagcttattttagtatcagactctttgaatcaatttaaggctttttcaataaaattggcttcctctaatttctactccaaaatggttaaaattttgttttacttcaaatacgttgtagggtatcatatttcatgtgactaggagcctaaactatatcagctgactggcataatttgtgaattatatgtgtgtttattaaaatttaaagtttttattaagacttacaattttattaagacttaatttttttccttacattttgagtaagtccaactgaaaataacttagagacttaggaaatttgactacattttataagtaatttccttgtaatttttctttcttgtggaaacaattcttactgatttacttaactcttttttcaatggcaaaaatgaaaaccaaatatatttgtcaactatattcttttaattgtggaaatgaaaggttcatatcccccatttgcctagcatattaaaaataaacatgacctttgtcttgaatgttgttaacttggattttaaaaatcaaaccaattataagctatattaaaattgcttatcaccttccctttgtcttcagtaagtctgggcctaaaaatactcatcatatgaataaataaagttttacaaatactttttagaacatcttgaattatatgtgtgtttgaagcttacttttggatgttcggtcaacaaggcttctgacagtttctttttatcttccctctattccctgccactgtgcaccccaaagtgatccctgaccacagtggtcccattgctggcatcaggaaggtagactgaggagttcaggtatcctagaggctgttaggtgaatctcttctacctctttcctggtcctaggaccactggacacttcaagtaaaaataacaattactttaatctctcaggtaaagtttcttctcccttccagcaacacagatctgcctgtgccgagttcaaatactctgaactttcaacagttgttctgaatacttttttgtcatcttatgatcaaatattgagagcattgaggggataactgaatgggcatggtataaaagtcagacttttagtgtttctaagtagcagaaccctttggacaatttagagggctgtgcgatatcctcaccgtgactgctgggaagtaatgggatctgacctgcagaggtactaccttggctgacaataatgacaaaagtgagagcaaagtacatatgactatccttgaggtcctcaggaaaaaaagagtattagtgagttgaactgtatgtaagggtctttaccaataaggaagcccatgcccagacataatccttacaccctggcaatagaaaccatcattgtggtttacatctcatcctgttcctacagtccagcaagttcaggccacaaaaggtttaagcactttttcctttgttctcatagcaacagttgcccatggaggttcagttacactaatattaacattttaatatacacaaagaagtgcctcgaatgtagtaggtattcaaacttgttaaatgaaagaagtaaactttcagacttaccttgaactactacagttttattctttctctaacctctcccactactaccatcttaaaaccaccatttaattagtattttataacaagttattaaaggctttcaaagacctttgaaccttcaccctctggtaagttaataacttctgatatgcgattaaatgtcaactgagtagtagtgggccctaagagctcagagggactgagaaatgaaggttattgtttagaagagtggctcaatgtgcttcgacagttggttaatatttgaaaagactagagtcaagaaagccttccatgtgctaggaaatgaaggagcaaaggtccagaggtggaaatgtatacagtgtgattaagggattttctgattgatagtaaatacagtcaataaaaaacttttattggaagcctagcctgtgtttgaagcattaagctaggtgctgggatacagagattagagatgaagataatgatgaagatattgttgaagtgaattgctgagaagctggagaaagggccaattaccataatctgaggctcaggaggaattggtgcaaagatcatctggtatgatatatatgaactgtatatacaaactgatctgtgtagctgaactgataatgccaaaaaaaaaaagactaggtttttgattaagatgaatccattaaggtcatgttttctgttggtgccattcttggagacctcccccaaccctatacatttataaatgtttttcctgagggactgagatggaagtggacatataaaaggaaaggtctgggcaaatacataagtaggtagtaaaatcaaggaacaaatgatctcaacaaaattgcccttcttgaaatgaatgaaaatgatgaaagccaatcacattgcatgatgaacttggggtatagaatatgaaatatttaaaattgctttatttcatgatgtttcagatgtagtaggaacttgttgcatagatggtgtaaaaacaatctagtaataaaatcttaggtatttaatacaaggtgaagaaagatgcaatgcataaatcatgccattttaggcttaattttcataaggctatgcctgtctttataagactatataccaggagttctcaagctttttggtcttggaacccttttatactcttaaatcgttgaaaaccacaaagaccatttatttaagttataaccattgatatttgttgtattagaaattaaatagacattaaaaatatttactatttaaaaataaccaaaaagatgggcatggtggcccacacctgtaatctcaacactatgcgaggccgaggcgggtggatcacttgaggtcaggagttcgagaccagccaacatggtgaaaccctgtctctactaaaatacaaaaattagccaggtgtggtggtgggcgcctgtaatcccagctactcaggaggctgaggcacgagaatcacttgaacccagggagatggaggttgccgtgagccgagattgcgccactggactctagcctgggcaacagagtgagactctgtctcaaaaaaataaaaaaaataaaaataaaaataacagtaagttcattgcatattaacataaataacatatttgtattaaaaataactattttccaaaacaatcaaaaaagcagtaccactcttctattttaaattttttcaaatctcccttttctaaaaaaaaaaaaaaaatattgtgtaagtttaaggggtacaagtgcaattttgttgcacggatatattgcttagtggtgaagtctgagaatttagtgtatcttcacccaaataacatacgttgcacccattaaataatttttcaacacccacccccttctcactctcttgagtctcctttgtctatcattccacactctgttcctatgtacacattatttagtacccacttaaagtgagaacatgtggtatttgactttctgagttttttcaactctggcttaatagaagacagctgaaatctcagaatgcttcttcatccagtctgttgtgaatatgttgctttgattcaagtatctaaggaaaatacagttttacacagatgtgcagctgaaaaggaaacatcttttaatatgttcagataattgtggatattgtcctttgatactatagcaaaacttatcaagtgctaatttcttaaaggctggttataatttgaaatctgaaaacatatctatttaattgtagtttgctatttgaaaatttattggtctgtcttgtactttgaatggatattttgcccacgtatgattttataacatcctgtattggccttttggaaaatttggtttactattatacagtttctaaatgttgataatttttattataatatattttaaaaagtctaatgtcactgccagtctcatcagaaaattctttgagattagaaagctgttaagatcatcatcacacttacaagttttacaaaattttaattttactcaaaactttatattttatcattgacaaagctctcagttgctttgcttagtgactgactcactttgttcattttccagaaagtgtttaccaaatgctgctgcctcaataccagagtctgtattgtcagttgatctttcaagtaaaaagtggtgttctatgaaaaacagctagttcagctgcgactgaaatgatataagtgtttctcctggagcaaaccaccacttcgatttgtagcagaaatgctgtatgtatactttccattgttattactcataacatttttaaaaatatactcaagggtggagatttttttaaaaataagtgttattgcttcatcaagaacagttaaatgaaactggattttttaaactgagtttgagttaatgaagaatgcagcaattattagtaaaatttggtgctccaccttgattcatactgacactccaggagttttacccactatttcttttgtacctttagtgcaaatgttaatatggtaggaatggtaaatgacatctttagtattattataaaaatcgtttttaccctgtatactctttgagactacacattgagaattgctgatgaaggtgttttaatttatcataagcactgaaaagatttacttaattcaccaatttctcctgaatatttgtttatataaaacaagactatgtgtatacacctacctttttattaatggtagagatctaggaaaattaatttctaagaactagccaggatatttggaatgtgaataaatcatatatccagaaaaaagctttagaagattgtctatgattgaaagtcaaacagctctcatttctattatactgttctttttcaaagaatttaccaattttatgtggtatttatgattaaacatacaccatgtaatttaacatttttaatgtcacttttacatcataggtattaaagattagcatttttattgtctgtattttaaagctcaaagaataacatttaggctgggtgcggtggctcacacctgtaatcccaacactttgggaggccgaggcaggcggatcacgaggtcaggagattgagaccgtcctggctaacacagtgaaacaccgtctctactaaaaatacaaaaattagccgggcatggtggcgagcgcctgtggtcctagctacttgggaggctgaagcaagagaatggtgtgaacctgggaggcggagcttgcagtgagccaagatcgcaccactgcacttcagcctgggtgacagagtgagactctgtcttaaaaaaaaaaaaaaaaaaaaaaaaatttagatttttgactgtttcattgattcatcttagacttcacatgaaaatatctgtatatcctcaaatgcttacattcttaagaagtatctcagccatttacacatgatagaaacaactaaatggaaaaaaattgcagttggaaattcactattttttatttgatccgataacaatgtgacatttgcgattggactgtaattttctgtctttctctctgaaaataagttcaaaaatttccctctaattcttttactagataagaagcctacttcgttgtaactcttgatatatgtatgtatttaggaacttaagcttttctgctaataaatgttatgtcataattcttgaggatagtattatattgtgatgggttttcagtaaactacaggagcagccctatttgtttaaaccctagtttaacctgattattaacaattaaattgtgttttcttctaacaattaaagtgtgtttaaatttattggtcccttgcttcacagatttatctcagtatgtggtgtattcaaacagaattttgtatttttaattaggggattagataaccaattctgaagagccaaaaaaattgttagacatcacattgcttaaccatctaatataccataagtgtgtgtatacactatgttgtgggagccatctatcaggcaggcctgtttttcaggcagtattttaaaaagtggacatgtgcagaaactgtgagcacaattagcgccaagcagataaatccagctctaatcctgtttacggtctacatcagacagatgtgccaagattgatttagacaagcccgaggcttacagtaatatttttaaaagtgccattcgctgttctatttttgttaaacctttgctaaatattcttaagtcttgttggttttgctcttcttattaaccaccgtaagtaacctactttaagcaggtcccgctttgctctcatggtgacaaggtaacctgccaggagaggttatctttattccctgtaattaagttgacttttccccccaaaaaaatacaacaataggaagtgggtgctgaattaaataaatagcatgatacccagtagatgtatacttaagttccttgcaagaacagatggtccccagtatctctgtaagtaatgtgagaggacagttaatgttctgaaacaactagctataaccagtatgatactaatgaaccagtagatttcaaataataaaccacatgccgccaagcaaaattatatgtcattcataaggatttaattatcataacttgcaaaaaagtgtcaatagatgatttctatatttttatctactgatatcaaatatcaatttatgaatagagtttcacttcatattttttaccaataaaggtatgttttaacattaaggtagaattaaagttatatttaaaatacatgccccaaagtatgtggtgatttttttttaactcctcttttactatactgtctgtatgtattgggctgtatatggaaatgtagcttttacatacaattaggaaaacaattgcttttatttctagcagaaacttgtactataacagaagtggctagcatgggaatcagagtagttatcttgtagatgacaactgaagcagacataaaagatgtaatattttttcagcactcaaaaatttataagtaaaattttataaacaaaaagcagtatttttgtgattcatatggaaaataaaatgagtctgagtcattcttaaggtgataccgtaaaggtgtatagataagaagtccatttttaaatatacccaagacaacagttttttctctcagtatggtttgttttcccttttttctctttaattatgtttcccataagtatttgtatattctaagaatgtccaaaaaataaatgttttgcagtgggggttgaaaagaaagaaagacctttttagatttcagctgatcttatcagatgatctctagaaccttgaaccttcaaccttcactgaagttagctggagggcttttcacctggaaacctgagaaacctcagaagccttctgctttagctctctctcaagtctaggaagccagtggcctgcgaccccacagagccagctggtccactcctcatataagaacttcggtaacaatacaaagacatagcaaagcaccatctaatctgataactcattaaacaatatttagatggctcaagactttaaataaaaacattttaagcttgtttatagaatactaacaagttttattcccaaagactatattcagagtgagaaaacaattttccttaaaactaatattatatacatgttcatatatgttaggaactagttatatgcaaaatcaagtgactcttgtgattagaactggtcacatttattcatgtagcataaatggttaatattgccaaaatgagtaatagatcagattttctatgtgagatattgacacctgagagatttacagtgtttcactgttgtgaaaaatggagtgctgaagaacatttgtctattgttatacatttgtaaaagaattcacaaattactaatttcaaataagaactaaatatttcttctaagcctatagtttttctttttaatttcttctaagcctacagtttttctttttaatttcttcttgtaacattggcaaaaagaccattcgtgtgaaaacctcagattttgatctgtacacaaatgcaggagtagagattggaagcttgagctggaaaagcaggaaatactgctcagagccttacaaggattttcagaattttcactgttgggtcctcctggttgctgcagtctaacctcgcatctccttgaaggcagccccagtttctgatgaaatactcttcagttaatttatacatatgctgtcttgctgttttcctaaggactgcaggcagaactgtggttcacctactgttttaaatttggctagatttaaaaacagatgatctcacttatatgtggaatccaaaaaagtcaaacttatagaagcagagagtacaattgcggttgtcaagagctgggggaggggaagcaaggggatgatggttaaaggtataaaatttcagttagacagaatgaataagttctggatctattgtatagcattgtgactatggctaataatgtatacttgaaaattgctaatacctgaaaatcactaagagactacgtcttaaatgttcttacaacacaccaaaaaaaggtgtgaggtaatgaatatgttacttagcttgattttaatcatttcacattgtaaacgtgtatggtactgatcttgtacctcatttcattttccatatgaatcagaaaaatactgctttttctttataatatcttatacagcatagatacaatttttagtggtcaattatattgtaatatatacataaatatatatgattttcattggtcaattatactgtaataaaacagcaaaaaataaagttgtaattaaaaaataatttggaagaaaaaattagcaagtggttggagattgaggaagatgggaccaataagtcctccaaggagagtcatacattagttttttttaaaagtccattattaatcttataatatttaatatgtttaatttcttgacacttattaatccaattaagtatgagaacactgtggataaatctaaaaaccttaaagttgagtaaaataaaccagatacaaagaagcacatactttatggttacatttatatgaagttctagaaaaggcaaaacttagctatagtaaaaaaatcatggtcctgagggaataactagagagtggtatgagggagctttctataatagtgggaaaattctgtatctttattgggatagtggttatgtgagtgcatatacttaaaaaaactcatggaattatgcccttacaaatctgtaatttttgttggtaatttataccttaataaaaaacaaaacagatgacagggttagtgattgtttccttgaagaaggtctttacatgggtctgttgttaacgagttgtagtaaaaatcatccaaaatgcttggattcaaatcttagatctgttcctaccagatgtgtgaccacagacaagttacttacattccgtcttcagtttcttctcttttaggaaaaagcatctagtttttgttgtagagattaaattagataatacaaatgaagtacagagaacagcgtttggtgtgtaacacatgttcattattagctacccttattttttagagaatggaaatttttaaatttaaactaatcaaactattttaggataagcaagtgaaacaatctttttttcaatcgatcacagaaatattttcactgaagacaaattagacatttatataagcaaactacagtgtcattaccattcaaattttcatatgcatattcatgcttacatgcatatgaaagcattacacatatgtattctataaatatatacaaaacagtaatggaaatgtgctgtactattttgaacatctttctagtcagcccggcattttatttacttttgagacagggtctcactctgttgcccaggcttgagtgcagtagtgtgatctcagctcactggaggctggaggtcctgggctaaaggaatcctcctacctcagcctcctgagtagctgggaccacaggaaagcaccaccatgcccagcttatttggtttattttgtttgtttgtttattttttatttttttgtagagatgaggtctcactatgttgcccaggctggtctcaaactcctgggctcaagttatcctcctgcctcagcctcccaaaacactgcaatcacaggcattagccactacactgacctctacattttaatagctgagtagccttctgttatatgaatatacttttttttaacaaaaccaatactccattattgtacatttaggttgtttccaagtttcactcaaataatgcttgggtaagtaagtatttttatttattattattatttttttgagatggagtttcactctgttgcccaggctgaagtgcaatggtgtgatcttggctcactgcaacctccgcctcctgggttcaagcgattctcctgcctccacctcctgagtagctggggttacaggtgcacaccatcatgcctggctcatttttgtatttttagtagagatgggatttcagcatgttggtcaggctggtctcaaactcctgaccctgtgatccgcccacctcagcctcccaaagtgctgggattacaggccgtgagccaccacgtctggcctggataagtattattttagctaaattgtgcatatttattcccttagagtaaattcctggaagtaaattgctggatcaaaaccaggtatattttaaagaattttccttttctacattaaaaataattataattctgattacaagaaaggaaaattatggagcttcataagaaaaaattagtctcatatttcatacctcatattgcatatttaataggtaaccagtgttaaatttgttgtgtgttttccactgggatttctttttatctcctttaataaaagcaggatcagatccctcagattactttgtaacttgcttttattctactttttcatacctcttagcatgaatgtctttccagaccagaatacagagatttcacttactcatttatgagctgcagaagatgactatgatttattcaaccattctcctattgaagagcatgaatattgcttcagatacttttgttattataaatattagtgcaattaacattttaaagtcttttgatacatattcccaacttgttctccagcaattaccatttttgcattcccaccagcactggggctacttccctttagttgcaccatcatttagcattatttttgatcttgtgccaatctaaaaggcaaaaagtggtatcttgttgttttaatttgcatttctttgattactaattagattgaactttttcatttgttcattggtcaatttgcatttcttcttttgtgaaatgcctgcttgggtcttttatgtactttaccattaaagtgtttttcttgattaaatagattatgtaactgtcatatgttgcaaatatttctgtccatttggcctttgcttatgactttttatgagtctttaggacttttgaggtctttattaggtattcaataattttaatgttaaatatattgatgtctgtcttcctttgtgtcttacggcttttctatttaaggttacgtaaatttctaatatacaaatattggtgtatattatgaaatagggccctatttttctttacaaaagattagtcagttctaaatcatcctttgctatttctagcggcgcttagatgccaccattatcacatcagtgaatttttaaatgtgtaattgtttcctgatctattcatttctctattcctagatacttctattgtaatagctttaccaaatatatctgatagggtgtgtactccccctcattacttcatttatttatttatttatttagagacagagtttcagtcacccaggctggagtgcagtggcatgaacttggctcactgcaacctccgcctcctgggttcaagggattctcctgcctcaacctcttgagtagctgggattacaggtgtgtgccactacacctggcaaatttttttttttttttttttttttagtagagacagggtttcaccatggtggccaggctggtctcgaacttctgatctcaggtgatctgcccttctcggcctcccaaagtgctgggattacaggtgtgagccactgtgcctggccccctcattgcttttaaaacattttcttactgtaatatatttattccaagagaattttcaaatattttatgagattccttgtccattccttacatcaaaaaataccacggagattttgattgaagttctattataagtagttacttggggtggggggaggggggagggatagcattgggagatatacctaatgctagatgacgagttagtgggtgcagcacaccagcgtggcacatgtatacatatgtaactcagctgcacaatgtgcacatgtaccctgaaacttaaagtataataataaaagaaaataaagagaatactggcatggaaaatatgtaatcttggaacttgttgtatctccacttattcaatcctttgtctctcagtagattttgaatggctctttatcccacacgagtctagaatcattttgctaagtttattcctagatataatatgctaattgatatgggaattttttttatctccattataccttcttcttgggtgtagacatatttgtagccagcttcctcactgcatattttttattaggcctaatggcattaagtttattattttggattttacaaaaaaaattatgataacatctttaaatagttagtttcaactcctcctttccccttaaatccatcaattactgtcttttatttcactttccttatgtactgactagaatgcctagaataattgaatgctatgagtaataataggtattcttgccctgtttttggaaatccttctggatttcagtaagtgtgatgttggcttttggtttagtatctttaaatttgcaatttacaagatattttacattggaatagtcattgagttgttaagtaaagcacaaacatgttaaattcagactgaagtacaggacttcaatgaaaagttaaaagagtttatttcatcactttcattttttctttccctcagtggctgtttgtcccctccccccaccccgctccatcccccagcttccttcctttgtgctcttattgttctaggtttgactacataaaaagagactctcaatttatatgtgatacaagaccataactaatattataaaattagtctagaagaagttatttgcaacctatataataagggactaatttcaagattatttgaaggactttaaagattggtaagaaaaaaatagacaaccgtttagaataaggcaaagcatgtgtagaggcaactcttaaaaaaaaaaaagtgagctgggtgtgatgatgcacacctgtggtcccagttactagggaggctgaggcaggaggatcacttgagcccaggagttcagggctgtagtgcaccacagtcacacctgtgaataaccactccattctagactgggcaaacataagaagactctgtgtcttaaagaaaaagaaatgaaaagatattcagtttcattaattgtttgactagctgatttttggaaaatacccacaaatataaccaagcctacaagttattttaaggtgggtaagagatacatcttatctatatgcattcacctatgtgaagcggacacccagtaacacccccgtgtggaagacaagcttccttaaacttcacaggacagtatttcccatgtagtccatcatagggtgaggatttttcaggacctttggtaagcctgcttgctttcattcttgagggtagaggaagggtgcaagacttccctggtctctcccaagcattttggggaccctggccataagcctacttgctcaacaggtgcaaatgactggtaatatgctgaccagatgcaagtgtaccaccaatgatttgctgtgactgagtttggtttcctttgcatatactatccagctttttgtttctaatatattcttccttaagggaaccaggacttcttggggaatccagatgagcttgaaacactgtttttataagagaagggctgttttcaaaaacatctatagttcgtaacaaaggagttagattgaagggactctcactgttcagtctgtgacaagcatgagtgttaaaatggagacaagaattttagttaattgtaatgttgaatttgtaaaaggctataacttcataatatgatcaaggggaacaagcaatctaaaatgtgttaaagtagcattttcaaagtgcggtccagggactctcagggttggtgaggtcacaactgtttttataatattgctaagaatgtatatcactctccttctctccaaggatacggtggagttttccagaagctatgggatatgtggcgatagccttgccctaatggagtgtgtgctttgtgctttgcatttttgtcctttaaaaatgcttggttttaattttgaatacaataattatagatagatataacctacataaaccaaagttatttgcggccctcagtctttaagggtgcacagtggggcctgagactaaagagtttgggaattgatgttctagagaaaagtcagtcttactgatgagggttaatcaattagtatttactgaccgggacaggacaaaccattcattttataaagacacacagagcatttcactaaaatacttttactctgattaagtggtgattttagtaatagtaatgattgtttgattttctgatacctgaaggaaaaagagcctgttgaattgatactttgagggtgttgagttttaggtcactgggtgactgtagaaatggaccaggagaagaactgaaacttgagccttctaagaaatagaagaccaaaaaatgtttagtgttaccctatcccatgaccacaataattgagaaaaaggcctttccgttccctcttccctaccctcccccttctcccctaccctctcctcccccctcccctccccctcctctcccctaccctctcctcccccctcccctccccctcgtctcccctaccctctcctctcccctaccctcccctccccctcctctcccctcccctctcctcccccctcccctccccctcctctcccctcccctccccctcctctcccctcccctccccctcctctccctccccctcttctccctccccctcctctccctaacccctcccaacctttcccctccttctctgtccccctccccctccctccctgtcttcctcccaccccccactccctgtcttcctccttgtcttccatcctcccttccttcctttccttcctgtctttcttttcctttctttcctttttcttctttccttcctgtcttccctcctctccgtctgtctccttctccttgtccccttctctctgtcttgcctttcctttccttctgtctttttctttctttctctttctttttcactcttcctttttttaatttcccttttacttgccttctctctttcattccttccatgctttcttttttttagtggtatgtatactttgtgagcaatcagactatagcttgcagaatagttgggagaggccaaaaatgcccctgagaatgcaagcaaggaacttcttagtgagcatatgaacatcctcactccaatcggaggataacattgttcatacttcaaggactaaaaagctgagagagggtctctgctttctgttacttttagcactcgagtcatttctgcatgtatttctactgattactttttctcctattttggttcatatgttttctgcttctttgcttgtctagtgattttggattagatgagtgacattgtgaattttactgtgcaggatggctgaattttttttctattcctgtaaatatttttttggcattgttctaggatgtagttaagttacctggaaaaagtgacatccttttgagaggcttgcttttaagttttgttaggtggaatcacagcagtctttagccagctcactaaggaccaatactcttctaaatacttaccataatgtcatatgaatttccatgtttttccacttcagctggtaggaacacctgtgtcatctctaagcattgtactgttaattcttctagtagttcttatctggctttgtacatctgctgatcaatactttcagctaaagtctcaaggggacctctgcaaatctacagtgttcactgttcagctttctcttctgtagtaaattgcacagtgaactctagtccccttagccttcctgaacccccagttctccttaactcagggagatcaccaggccccaccaggattcctgtatctgccctgtgacctggagattctctgcaggcaataggttggggcggtcgtagggtccactttgttttcctcctcttcggcttcactgtcctgtgttacctgatgtccaatgtctgaaaactactgtttcacgtatcttgtgtgcttttgtagttttaggtgaaaggtaaaactagtttcttattattccacattggccaaagcagaagttttggaagtctttttttaaggtctaaaacacttctactttgagagtcaattgaaatggtcttttccacaataattattttctgacctatggtttaaagataagtcatgaaaattttatgccactatttttttttaagtctgattatggttaaattcagggggctatttcctcctagattgacagagtttataatgtttcctactcacaataattgtacttctgcttcctctttgcatgtgttactttaatgggaatgtatatttccttttcgttaaggctgccttcaacaatttgtcataaagtcacttctgttagtgaattctattttttctgttactttactctatccttagtaccaaagagctccttatgtgacaccaatttattactaaaatgtcgctttgtttatgttcttggaattcttcatacattgactatcctcagatgtcgaatgttgtaggcctgtgtggcagggactctcttccatttattctatttttaatctaattcttgacaaaataaacccaatttttcttttcttcccctttccatctcacgtagggactggcataaagggcaatccataaaattacaaatgatgaatttttttggttttaactattattcatacatttaagatatggtcacaatttttatttcttactagtaattcattttattttttaacttttaggttctggggtacacgtgcaggtttgttatataggtacatttgtgtcatgggggtttgttgtacagattatttcatcacccaggtattaagcccagtacccattagttatttttcttgatcctctccctttgctcactttctaccctctggtaagccccagtgtctgttgttcctttctatgaaacacaatggttttaattggaaaatttatttttttttcaggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggtaagtactcctcatgggaaattttaatcagcccagtttccttgatatacatgattaatctagacatgttttgagtaaaaacaactttagtgatgttgagatagtttccttctgttcctagtttttgtcgtgagaaagtgttgaaatttgctaaatactttttctacattaattgagataatcatatttttccctacatcctgttaatgtggtatcttatattaattgattttcatatgtttaacatccttgcattccaggaataactccccaatggccatggtgtataatcttttaaagatgctattgaatttggtttgttaatattttgttgagtatgtttgcatcaatattcataaaacatattgttctgtagtttttctgtactgtttgtctgactttggcatcagggtaatactggcctcatagaatgagttaggaagtaactcttgaatgactattttcatgaagaagcttcaataatctgaaataaaatacttaaataatttagttcacctgagagttgtttttagaagcgtatttatttttctattaatgtcttttttgaactatataagaatgtattctccttccactcacacattgatggcaagtgtgtatttgtactctgtggcctgaaaataagatttttttgaataatcttaagaggccatgctttatactctggtaattgagaattacctatttcacagtagctttttctaaaggttaatttccagagaaaagagaacatgtttattaggatatatctcttaatgaattcagtgtatctgaaatttctaaatgacattttcatattttgcatactaaataaaattcataagtacaaatataatgcaattcataagtacaaatataatgcaatttggatttctagaagttatctagttaaaatatgatcttaggatttattttttttgtcttagatttatgaatcttgcttgtttttctgttaattcatttcttcttgtttgctgcatcagtcagatcagagtagaggcagcttgtatagttgatggcacagtttagggttagatggcacaggatagaaatgggtgctagacaaagagcagtcacagaggcatgttagaaatttccagttccagcatcattgatgaagaaaaccatgaggacccaagttgatcaaaggcagccagccaataaagctatgctcatgcgagatgagctgaagtgacattacattaaaattggaagaccctcttactaagtggctccatgcttccctgctagcccctttgggacttccaagaagacttggttatttcaagaagacaagaacccacagaggctgtagtttagtttatctctctggaaacatagagaatatgtataattaaataaaagcactttaatagtgaatcctttacagtgttatttgaaatttatgtcaagtgatttaaaaagtaaaaatgaaaattaataatttcagtggaagtaaattgattaacatgaccaggaatacataaaacttgcatggtcttgtctataaaataaggatatgtcatttaattaggagagtcaaagctcattcttgcgcttaaggtctgaggaactcttctcccatggggcttatgaagggctacactgaggcaacttcctcaatatatctcagccataaaaccaagagaaagtaagaagcagaggacatcacaacaaagctcaattcagtaaaagcaattttataggagtagagggacttgtcaaaaacaaaaacaacaacaaaaaacaatgtccaaatatttattcagcttaatgagtgatgtttttgtttgatctagggttaaaatctagacaaattacagagatgaataaactacatatcctttagtctaccatcctctgaaaatgttactttttgaaactttgattttgataagagctggaggcactcagggagtcattctctggcatggtctttgagtacagagtgattttgctgattaaaagcaaatagattgacttttaaaatcaactcatacaaacaaactgttaaaatcctctaatgagagtgaagaaacctaaccaagactgactgatacattactgctccatctctgcaccaaagtggactcagggaggcctgtaggagatgccaactccttatcctactccccacaaagacagttcttggctatcttcatcagacacaaatgaatggttgaggctccaaagctctctaccaattcttgtgttacactggcacttttaaaaaattttgtttattttttatttttaaatggagtctcactctgtcaccctggctggagtacagtggcgtgatcttggctcactgcaccctttgcctcccgggtttgagcaattctccctgcctcagcctcccgagtagctgggattacaggcacccgccactacgcctggctaatttttgtattacttagtagagatggggtttcgccatgttggccaggctggtcttgaactcctgagctcaggcaatctgcccaccttggcctcccaaagtgctgggattacaggtgttagccaccgcacctggctggcacttctcttaaaactaatatctcaagaagttttttctttaagaatcttctttcaattgcaggtccatgtagttctggtattcattaaagtgcctatcccaggggttttggtatgttgtgtttcaattttcatgtttcaatttttttgatttatgcattaattttgttttttcagaattcaggtgcaggttgtttagtttccatgtatttgtgtcgttttgagaattcctcttgttcttcatttctaattttatttcattgtgacctcagaagacacttgcattgattttgattttttttatcttattgagatgtgacttacgactatgtggtcaattttagagaatgttccatgtacagatgtgaaaaatgtatattttgtgttgttgggtggaatattctgcagatgtctgtcaggtccatttggtcaagagtctgatttaagtccagtgtatacctttgttagttttctgccatggtgatctgtctggtgctgtgagtggggtgttgaagtcccccactattattgtatagctttttttccccataggtctagtagtatttgttttatgaacctgggtgctccaacattgagtgcatatttatttaggatagttaaatcttctggttgaattgaaccctttatataatgccctcctttgtctctttttgatgttgttggtttaatgtctgtttcttctcatacaagtatagcaacatctgttcttttttaattttctatttgcatgctagatctttctccatcccttcactttgagcccatggttgtcattacatgtgagatgggtctcttgaattcagcagaaggttaggtcatttaaaaaatctaatttgccactttatgtcctttaagtggagcatttaggccatttatgttctaagttaatattgatatttgaggttttgttcctatacatttgatatttgtgtattgttaagtagttgctttctagtttgaattgtgtaattgctctataagatctctgagccttgtacttttgtgtgcttatatggtagcaagtattgttcttttgtttccatgtttagaactccttggagtatttcttgtatggcaggtgtggtggtaacaaattcccttagtgttttcttgcctgggaaagactttatttctccttcatttatgaagcttaatttggcagattatgaaattcttggctggcattttcttttttctttaaggaggctaaaagtaggcccctgatctcttcttgcttgtaaggtttctgctgagaagtcctctattagtctgattggatttcctttataggtaatttggcccttttctctagatgcctttcatattttttctttggtgttgaccttgcatagtctgatggactatattccttggggatggtcatcttgtatcttgcaggtgttttctgaatttcttgtatctggatgttaacctctctggcaagattagggaaattttcctgaattattgcctcaaatatgttttccaatttgcttacttcttcctcttctccatcaagaatgccagtaagtcataggtttggttgctttacataatcccatatttatcaaaggctttgttcatttttcagattctttatgtttgtctaactgggttaatttgaaaaggtggtcttcaagctctgaaatcttgtcttctgcttggtgtagtctgttgttaaaacttccaagtgttgttttgttttgttttgttttgttttgagatggagtctcactctgttgcctaggctggagtgcagtggcatgatcttgactcactgcaacctctgcctcctgggttcaagcgattctcctgcctcaccttctggagtagctgggattacgggcgagtgccaccacccccgactaatttttgtattttttagtagagacaaggttttgccatgttggctgagctggtctcgaactcctgaactcaggtgatttacccatcttggcctcccaaagtgctgtgattacaggtgtgagccaccatgcctggcctgcttccaagtgtattttgatgttccctttagtgaatttttcaattccaaaagttctatttggttttatcttaatatggctatctcatgtttcatatcctgcattgtgtttctggtttatttgaaatggattttaaatttctcttggctctcactgagtttccttgcaatacatattttgtttttttagtctgtcatttcaaagttttcaacttggttaggatccattgctatagagctagtgcaattctttggaggtatgaagacactctttttgtagtgttggagttcttgggcagattccttcttatctgagggagctgttgattcttatttttgaatttcctattggttgggcgggacttaaactttttttttttttccccttgagggtatgactatggtgtatgttgtgtgtgatcattcaactttgtttctgggtgctttcagggggccaaggctctttatggattccttgggcgtggtagctttcttaaatgctgcttattgtagcaatgtattggatttgtgagctgacactctatctcatgtggggctgagggtgcagaagtctcaggaagcttattttgtggagtagtgctaagcctttctggtagtgggctttttatttgatagtacagttcaggctgcaatccagtagatggcacttaaaaaataagaaccagcttgccctcagttaggctgatgtccagtagaagcacctgtcctgacaggggagtgacaggaagagattctgttggtgtgtgccgaggcctttggggtcgctggttggggggagatagggggaggtgcactagctcctcatgcaggaatgtgatctgcttttctatcataccccatcagagggctcatgaccttcagttcataaagattttttccttgggttcccagccatagtctgtctgtaggttatgcatatgcccctctgaaggcaaccaccaaaatggtcttggggcagagcctcttcccccagtctagggcagacaactccatgacttgtatgtcctccattgctgggacactgctgctctgtgtagggatggggagttgggccccaccctttatgtaagcctaagtggcattctcactttcagcaggggtggagccatcttgaaaaccatgaaaaactctttcttcgagtacctgtgctggcccccagtgggaagaaccactgctgcgtcttcaacagcgtgtggggtgggagggtattgccacagatgaccccctctccatatccgttccttgacatggtgttgccccctttagcgattggcactgtgcccacctttcctttgtcccaaaggggttttggcaagttgtgtccctctcccttataggtggcctacactaggggggttagatctctagaggttccatagctccctgggaacttgctggccccctgggcttttcaaagtcagaacaggttatgaggtatgtttgctggggatctggtgctacagagactcaagggtagagaatccctgggcagagcagaggcccaccactggtgcacaagcaatatggtgaccaccatctcagtttgtgtctgaggggagtatgggaacccctgcaggagctggccacccagttctctatccctgggaaattcctaaattaccaccaataacattgccctgggtcacaagggtggggccttgaattctttgggggttgatctctgccagactctagctacttttcctttctgcaccccagcttcttcccatgggcactccaaaaggtcctggctctctttccccagttttccattagaaacttgtccatttgacagtaactttgatcttctttctaagaagagctggcatccaaggtctgtggtcagctatgttggaaaaaagaaggagaaaaaaactagtttgtattaaattctgaaagactagtggcactggttaagtctttaaaggattgttaacaaaagaaaatctttttaaaccaaactcctaattttatcagaattgtaactgaaaatataaatgtatgaaaacataggtattatgtaaaatttgctcaataaaagaataggaaaaactactatttatcttggactgatagcatgttagtttgagatttgaaccctttctactctagtaagtagtggtgggaaaaattcactgtaggagtctgcagacataacaaactatcattagactgccaagacctccacataataaagcaagcagagaatgtcaaataagtatgtgaaaaatgatcaaaaaagagaaattgaaaatataaatagggtgctattaaaaaaggatagcatttatgttatgacatatgtacacatgaatatcactttttagaatttcatccttcttaggacttattcctgagtccgaggattgagaggttctgataaaataagtctcagtgggttccaggcatgggctttctttaaaagtctctccagggattctaatgtgttgccaggaccaagtaccatggacagccaagatctcatcagcacagtttgattgaatgaacttatgtagaaccctgaatgccacacttaaccaaagaaacctttccagggattaattataggtgacagaacatgctatattcttattaaatattattaaaagttaagcaatacccattcctgattcatgtaaaattctcacttattttccaagagttttactgtatgactggtttatgggatgcttggaaaaggttgacagacatggcaaaggttcctgcagtgtttctctttgtccatcaacagccctagctcataacctctaccctttcagctaaaagcaattagctcttcagaagtgattcattctatttatacttgggataagtaacatcaggcagtcttccctagggcttctcacgggccctggtggcatttttattctaagagagggttatatttttacatgtaattggtcataattatactaaaaacaagtaattggtgtcttatacaagaaaattatatttctgctttagtcattgacagagtatcctgagaataagagttaagaagtatattcattgtcatcttatttctgatatatttcaaattcttttgctaggaagaagcccttttgactgtgctttgtgtaacaaaacttcttcggagaaacaatttagataaactttgtcagatcttatgtgattatattcaaaatgctaattgaagattctctaaacattttcagtaaaatgttgaattgttttcatgctgttaaataagttaacatgtcttcctttactaaagtcattattataaaaatgtaaatcctaatgataatagctgatgtttattaagcatttagtaggttccattttttgatagcaacttttatgaattatctcattaaatcttcataataatagcatcaagaactacaaatatgttttcatgtaagaagggaaataaaattatgagttttgctgtgaggtttgaagaatgaaaacaatgcatgacttagaaaatagtataattaagtgaattttattatcattatcatctcttagtttataaatgaaaaaactaaggcttacataatgtaaaaatcagttaacaaggttaaacaaccggtagatggtagaggaggagctgggaataaatctgtacatgtctgaatctggagcaggaacccttaactgatgtgtcattctagcaggtcatcagttactctacaatacctattaagtatactttatttactgtgtttagatttatagtagatttagactctactgtaaaaacaaggacttcatacacctgctagaaagtatccatatcatcttgtttgaaagttgtcccgctctagtgttcttttctaatcatgatgattcagaactccaaactcttgaagcagggcaacccgtagggtcagcattcataatttctcaatacttaaaaaagtttcctcatgactgttgctattattgagatttctcaaatgtcttggcctgaattgggtgtgcactatgaaaaaaaaaatggcagacatttctttttgttaaaggaattttaaaaacacatataaacacactgatttgtgacagattaccaggctttatgtttagcagggtttcctaagcaaaacacaaattctgtaaatctacagaattagataaaacattgactcaatccttagatgagagtataatggattatcacttaataacttctgtcactgaaaataaatgatgtaaaaagtaataaagttctactctcacagtatgaataaataggaaatacataatactttaaattaggcaacaaatcattaagcccccagcattcattagactatcattaatgataataaaattgtgtggtatttatacagatattatatgtaactccaggaattttgttataattgtgtatgaatatatttgttgtttgaggcaggtagatggatatttgcagcagctatgtgctgaagcattctggtaatagttttcaaatcaaccatttttttctccttgtcgatcatctttaaagcaaaagcaccgttttttactatattttttgaaaaaaatacattaggtgtaaaattatatattttgaagaagttcactttctgtttttactagtttcacacctttgttattttttcagtggaaggagcagagataggcaaaggcgaagcctgtgtgtgtggtcaggttcctgggcccttcatagcatctgatgccaagctgtgttctcttttgtgtcattgccttcccacttgctaattacgtgacagagctagggacttccctctgtctagaatgccccccatctcttgtttgcctagtgaaatctggtttgaagttcaaggtctgatacaaaccaggtgatcctctgcaaaactaactgtacctgagcaaaccaggcacttactcttttatatgttcctggcactgctgatactctgatagaaaacatcatcacttaatgctaactgtgggctcacaaaggggatacttctactgtaagaagactgtaactcttcttagcacagagattagtaagtacttgaaacagagtttcacatataataagtgttcaataaattttattttttatttctaacacttggcacactgcatagctcagtaaatgttggtgaagtgaactgagtattctccttatctattatgtggtaggcattattctagttgcttctgttataaaccaactcatttaatccttatcacagcacttttattgtggtcaatattttttaatcctcacagatggctaaggaatcagcactctgagagattggttgacttgctttgggtaaggtgcttataaagtggtagaacaagattcctatccaggccttctgattcaaaaatacattctttttttttttttttttagtagtgttttctggaaaggcagggtataactgactatgctgtgtatttgggactaagtatattattgtcaagtatattaaaaatgtcgcaacactggaaaggagtccatcaatgggctatgcaggttgagggatttgtagatgagaaactgataaatttggttagcaaggaaagccatcaagctgtgaaccctttatattggcaaaagagagggtcctttgaaatctaagggaacagaactttcctgttctccaagtttggagcagaataggtaagctctaggcagtctaatgcccaacttttaccagtggtgttttagttttttttttttttccaaaaggaaatgatggaattctttatatacttctgaattgtctatcttttcaaaaataaaaattttcattttgcagtacatacagaatcaaaagactttcaagtcctaactccacaaatgtttattttgaagctctttaaactgtttaccacggatattagtaaatctgtcagaaatgaggtgacttacttatccttgtcccaccagatatgtgggaaggatgatcacgctagatagcatggatgggtcctctatttatctctttttacttgaatggaaaacacatcattcagattaatcaattagtcattgtgactgatagaatttttatatggataatctgggtttggtccctagctttaccacttacttggggtctttatgtcttctatggtctcctatctgtaaagggaagttgataatgccaatctagctaggttactgagatgcttaaatgtgtaatgtatgcaaagcagcaggtactcaataaagggtaactcttactattattgtatagctctccaggtatgtattgagcttctatagaatccatagccccaaactctttagccctttgagaccaagattaagcattgtctttccagaggagagggtgagagagattgccattatactaatagaattcatcattatcaccgtcatcatcatcatcatgatttcttggtgtgtcatggaatgtactgtgtttcacattaccaacagatgttaattttcacaacatccctgagacaagaaactatgattacattttacagataaggtcatgcagctataaagttgtgaaattgggattcaaactcaggcagtctgtccccacagtccatgttcttaacccaccatgctctcctgacacttgaaaagttaggaggcgtactccatagcctgtaatgttgctgcagagagaatctaattttaaatccagtgaagcatattagttgctgtctttgatatgccattcagattgtgctatccttatgatgcctaccttggttgtatatgtaactgggcgtcaaatatataaatactcaaaaagtgataggtgccaataaaatattttatagttaatacttatgtaatctgtgttctctgtgtttgagggctggttctaaaatactgctctatatttgacttctggttaaaacaataaactttgctcatattagttatatagttgataccattctcatgttgctaacatgtctgtaagtaacagttgaaattgatctggcaattttagagctgtcagacccaggagatgagagaaacatttaaaatgtttataacattaaatcagctgagtcaagagagagaaagagaaagatgattcagatttcttgtactggtggatgtaagtgcttggaactgaaataaaggagaaggtgtagggagggagaaagataaagaagtcttccctttatacaagttgaaattgagttttctttgagatatagaggtgaagacattttaagaaacttcttaaaactctctaatgtggcttttcaacctgtttccatcaatttggcacatctcacttttcggcacaacagaatattctaggtttatctcacaccttccttgccccagcccaggaatcagccatttctctaagaaactcttgtttattttggtggggaacagtattgggaaaccaacatctgggagctaaatatactcctagtggttaggaggtcataccttgtagactcttgtagctgacggagttaggacatatttattagaaatcataagtttatattgatcttgctaggatctatccaatcctacaagattcttccctgtgtctctcctttgtatttgtgtatcctttcttccatattaagaactgtggctcccaacaacaaggcatgtgcccatttgcccaatcgtatgatgtataaaaactactttgagaaaagtggcagccaaaccactaagaaaaataaacttgctgaaatgagttcaagatttattggcagctctttttttggcccctagactgaaagtatatatttcaagtattgtgttcaaaaattatttgggttagctttttccacctttcataatagtaatattatttacttgaaatacagttggctttgtttctatattcagtttttttctctctatcttcattaatttcattatatatatttaatatgtaggacattaacatgtttccaaaagaagaaaacactccttcctgtatcatttccacctcatctctcttaccccttataggtaaccaattgcactggtttctagtttatcttacttatattcctatttgaaaagttacctcatatatgtatgttttttaaatttttatacttttttacacagaaagtaacgttcagtatgtactttgccactttccttttaaacttaacagcgtatactggaaatcactccatatcgtgtcacagagagcttccttatattttttaatagctgtataagacttcattgtgttgtctgtaccatattttattcacttccccatgtgtggacattttgactgtttctagtatctgcaattactaataatgctgcagtaaactttgtgcatatcgtaccttggtaaatttctagacatagatttctgggttaaaggttaagcacatgtgtagttttgttagatattgataaattcctttccatggggtttatatcatttttaaaatatttaccagcaacgtataacagcgtccattacttcaaagcctcaccaacagattgtatgttttaagtacttttatgttttagaatttttccaatgcgataggtaaacaatggtatatcaatatagttttaatacattaaagttcagcatcttttcaagttcggctagtctcagggctattcttaatatcttgtgaattatcttcatattattttcccatattccataatacttttggttttttttcctcctcaattctgacaagttctttatatttcaggaatattagccattttatttgatatgttacaaatatttttctcccaatatataacttttctcttataacgatttttttttcatgaaaagtttttaattaaaaccttttatgggcccaggtgcagtggctcacacctgtaattccagcactttggaaggctgaggtgggcagctcatttaaggccaggagttccagaccagcctgaccaacacagtgaaaccctgtctctactaaaaatagaagaacattagctgggcttggtggcacatgcttgtgatcccagctactcaggaggctgaggcatgagaatcacttgaacccagcaggtggaggttgcagtgagtcaagatcgtgccactgcactccagagtgggcaacagagtgagactctgtctcaaaattaaataaatatataaacaaaaccattatgggccaggtgcagtggctcattcctgtaatctcagcactatgggaggtcaaggtggttgaatcatttgcgccaaggaactggacagaccagcctgggcaacatgggaaaaacctctctctaccaaaaaagaaaaaaaaaaaaattagctgggtgtggtagcatgcaccagtagtcccagttactcgggctggtcacatgagcctggggaggtcaaggctgcagtgagcagtgattgtgccattgcactccagcctaggcaacagagtgagaccatttctctaaatacatacatacatacataccttttgtggagttaaatttacacactttttctttattggctctggcttttgcattgtagtaagactttctttacactcaacttatagataaattcacccatgttttcttctagtacttgcatagttgaattttagatctctagtccatttggagtttattttttgtatggtagaaggtattgatcctattttttcccaaatagttgttacccagttgtcccaaaacaagttattgaaaagtccatctttgtcccagatagactggaacaaaatgaattaaagacttaaatatgaagatttttacttgtgtatcctttcttcctagaaagaaaacataggcgtaaagcttcatgacgttgaatacttcatgccattggtctggcaataatattactattatgaaaggtggaaaaagctaacccaagtaacttttgaacacagtacttgaaatatatactttcagtctaggggccaaaaaaagagctgccaataaatcttgaactcatttcagcaagtttacttttcttagtggtttggctgccacttttctgaaagtagtttttatacatcatacaattgggcaaatgggcagatgccttgttgttgggagccacagttcttaatatggtagaaaggatacaccaatagaaatatttatatttaagtctggcaatcatttttaagatgtgaacttgaacaggcaacaaaagcaaaaataggtacgttggattacatcaaacccaaaagctcttcacagcaaagggaacagtcagttgagtgaagagacaacctatggaatgggagaaaatatttctaagccacacatctgacagagggttaatatccaaggtatataaagaactgcaacaactcaatagcaagaaaacaaataacatgaataaaaaatgagcaaaggatctgaatagacatttctcgaaagaagacataccaatggacaacatgaaaaaatactcagcatcactaacaatcagggaaatgcaaattaaaaccacagtgagatatcgcctcacacttgttagaatggctgttatcagaaagataaaagataagtattggtggggtgtggagaaaaaggaactctagcccactgttagtgacagtgtaaattagtatagctgtgatggaaaagagaatggaggttcctcaaacagtttaaagtagaactaccatatgatccagcaattccacgactgggaatatatccaaaggaaatcagtatattgaagagaactgtattttagtgattattgcagcattgttcccaatagccaagataagggatcaatctgagtatctatcaatggacaagtgataaagaaaatatggtgtgtatacacaatgggataccattcagcctttgaagagaaggaaatcctgtcatttgccacaacgtggttgaacctggaggacattagctgagtgtaataagccagccaccaaaagaaaaataccacatgatctttcctatatgtggaattttaaaagttgaactcaaggaagtagaatagaatggtagtgaccaggggtatgcgataggctgagggatcaaggagatgttggtcacgggatacaggatttcagttagataggaggaagaagttcaagaggtctattgtataccatggtgagtatagttaattataaagtatacttgaaaattgttaagagtagattttctgttcataccacaaaatgataagtatgtgagataatgcatatgtaaattggctcaatttagccatttcacaatgtatatatatttcaaaacaacatgatgtacatgataaatatacagtttatttttaattaaaaattttaaactctctaattggtcttcaacatatagtacacaagtcttttcacgactctttataatggaacatatgttcttggaatgctaaaaattattttttttggaggccctgcaaataactaaaaatttatcttaaaagccacacctaattacttacatatgatccagaaaggatactttgaaaaagctttttaattgataaaatcattaaggtaaaacatattcataaaagtgttctctaataattttataattttctagttcatgaaggattaaatatacaactatcatttgaattggattttttatgaggttaattgtatttaaatgctaattattttaactaattttgtggttgacttctatgtagagtagggaaaaagaatttcctaaagccagttacgtatatctctttttagtctggatttttaattaggaaaagtgatatagttaaataggtctactctatagcatcttctaaaatgagtaaaaattcattatatcaggataaaaaatgataaagatatatggatgacacatttggctgaatttttcttcttcgctgttctcttgctctctatttaaatagtcttagctcttttatcatttaaattctgaagtattgaggtgattattccggcagcaggtgattctgctaattactgttcagtcagttttagctattagaaacagagatatgtttacattgctgggctgcatgtaaatttagaagttacatggctttgtttttactttgacttacggcattaaaattattttcatctgtgtatgtaaagatctgcatctataagcttttgtggataataaggtgaaattgatgcattttaatataaattgccaatataaaatatctctaactcagacctctactggaaagttgtcaaatcttatgtaggaaaggcttttaccatcactgttacacattaactgggcatagtttaatattaatagctcctgagacttgtggttaactgaggtttctatttcctgtgtttgggttttatctttgcaacaacttggttgcttttctgtgtaaaatagtggtgaatatacacaagagtatgacaaggttctgggctcttaactttgatgaacaccatgccatttccatcatgctgcactcaaaacagcacagatgtgagtctgggagtggcgtccctgccgctctcatgagcctttgtttggagaacaccctgattaacccccacccttcacggttcattgactcactgatagatcaagtttaaactagtatatattagcacatttgttaccaacagaggaacagttggccattctgttttacattgctggttcattgcaaactggcgtgctaaaaaggtctgtactctagagtatgaattgggaagttaccaaaggactgagaaccaagtcagttgcatattaatgttgaattatacctatattttaatcttggattgtctacttgggggatgcttacactgttgtcaagttatgaataagtgataattaccactttgaaattcatctttttttttcaaggagtttaggggatttaggtgtctcaatatagctttcatattaaacagtttgtcataattggatgagagcagagcaaggtcatgactacctgatgccttgtgttggagcattttaaaaatgttttccagagagttatttgtacctaatgactttacataagtccttacattatactttatttctaggtcacctaaaaatgttaattgtttagtcaagagggttaggatgtgtgtctgttttctcatgaaaaaaattaagctgttccctttttatcaattttcttgcaatctaaaggcttttttttcttaccttcctaacctagtgactaaggtcatcttattgttacagttcctttcatgggagataggtttactgcatcatttggcagtttcatagggtgaattttgtcttggcttcatctttccttactggttgtcatcccctgggccacctgcttttttgcattttcctttctcttgtgagatgatgaagctctgtgccccgatggggatgagagacagcactctgagttcaagtctaggataaggcaatgggcttgcttttcaaaacaaactagtgtcatacgggctgctgctttcaggtccactgtctgattttatcactgatgacttgtttctggaaggcaaactgatttaagttctgagcaaaagggtcggtgtttattttcaatgctactattaatttagagttttaatttagaaaagattttttaccagttctcaaatatgatttttctattgactttaagtttgtagatataaggagtagacatgagatagagactgaattgcttttttgtttttaaaacttggcagtaataaggggttgcttgttttttcatgctaaatattttttctaagggatctagatacctatcagaaaacttaactttgataactctggttctttattaagtatttttgtcttattttaggaattaatagaaatagttgtaattttagacttcctttataaaataccaatttaaagagaagctttttgcttaaatgattgttttgcagtgttgtgcttttgttttctttaatgcagttgaaatcgcagctttataacttattttttaatttggggtttttaaaagaatattagttatttatttatatttattgggcacctactgtgtgccagacactattctaggaactagtaaacatagcagagagcagaatcatgaagttcttgacctcaaggagcttaaatcctagtggtagagggggaattcaaaaaaatcaaataaatgtatttctattatgtcaagtgatggtatgtactaccaggcaatcagatgaaaatatttcctcttctatacacagtgggcaaggaaggcttcattgactgtggagttttagaagaaagctgaaagtaatggggaaagagagccatatcgatatatgaaggaaaacatggtccaagcagaggaaacgaaaagtgcaaagaattgagcaagaaagtcatgttcaagtggagtcagcaggggaaagagtaggtcacaaatgcggctgagggtgggtcatgaagggccttacaagctttgtatgagtttttacttttattctgaaaaaaacaaaaacaaaaacaaaaaaaaccggggagctatttggggattttaatagaaaagtaacataatttccttttaaaatggatatgtggccactaagtggagagagtggtgtatatatgagtggatggaataattgatacaggcaagcaggagacaggttaaatgaaaaatggattaatccaggcaaaagatggtgacttaaattaagctgggagtgggagagatggtgagacatgcttagactttggattcatttttccagatagaactggctgacagagacatgtcatttaccaacatagacatggcagattttttttttcttttctgagacaaggtcttgctctgttgtccaggctggagtgcaatggtgtgaccatagctcatggaagcctcagactcttgatatcaagtgatcctcccacctcaacctccctagtagttgagattacaggcatatgccactgtatccagccaactttttttttttctgtagagacaatatctctctgtgttgcctagggtagcctttaactcctggcctcaagcattcctcctacctcagcctctcaaagtgctgggattataggagtgagccaccatgcctggccaatatggcggttattaagaggataagtcaaagattacatgaatattctgttatgaaaagtgtcaaacatatagaaaatataaacagtattccagtgggcacccatatttttatcaccttgattctacagatcttaacatttttctgtatctgcttcaaacattttattctgccaatgtgttctaaagtaaattgttgatattgtgatagttctctccaaaatgctgcagtgtgtagctctaaaaatagatatttttcagataaccaaatatcattaacctgccaaatcaatgaatgataattgcttattaacatttaatacttggtccatagtcaaattctccatattttccataatgtcttttatagttaacttttaccaactagtgtctgatcaagaatcattcatttaactaattacatttaaactgtaacattacaacatgttttttcgtatgttttattctctctgacattgacttatggaagagactagattatttgtcctgtagacattttatcatacataagagttactaggagagctctgattactagtccccactctcagaaattttgattcagttgctctttccagtgagctgctggtgatgctggactttcattctgaagaccatactttgagcactactgctgtaccactatccgatggcttctttgtgatatcgtttaacttgttgttctgttgcctgtatttcctctaaactgaattttcaatctaaaggcttactgagattcatgtttgatactttgggcaagaatacttcataagttctagtgcttaatgttaggtagcacttaattctgactatttcactattcatgaggctaagctaaggaggtgacagcctgatccttctattgtaatgtttcatgtgaaactactagataatttgttgagttggggggtgggtagggaagagatatctagttttcaataaatatttcacctaatggttttaacacacattgatcatccttgcctgaactaattatttaattagggatggcaacatggagactttctaattcaatctttttttttttttctaaatgaatggccttgtttttatttttaaatggatgttacttcgcaactggggttatttgattacccagaaatatagcgcatattaaaaaggtaggataaatgcttagttaactaattaagcaatttttaattaccagttttcacagtaaggcactaaagtttctgacttgagcaaagataaagtggaaagataaagtggtcgtttagtgagatgggcaagactgtggataggtagactaggtttggtgggaaagtcagaatatcagttttgaatatgttaagtttgagatgtctattagaaacatatgttgacgaggccaggtgcaatggctcatgcctgtaatctcagtactttaggaggctgaggtgggcggatcacctgaagtcaggagttcaagacgagcctggccaacatgtgaaaccctgtgtttactaaaaatacaaaaattagctgggcttggtggcatgcacctgtaatcccagtaatcccagctacttgggaggctgaggcgggagaatcacttgaacccagggggcggaggttggagtgagccaagatcccgccagccactgcacttcagcctgggtgacagagcgagactccatctcaaaaaaaaaaaacatatatatatatatatatatgttgacaatatttcagttgaataaaataaaatattctagctattttaggtagaaaggcattttataccgatactactactaaagggtaagaagatatgactgtagtacattaaatatgctgatggcctacaactgttgctgtgttgctttttcctcttcaccacacatatgcagcctcatgaaacattttccatgaccagcacactgaaggaaataaaaggaacctagtttagagatggttctgcatgatacaacaaaaatgagctgctaaagcattacaatcccactcaagagtattcccccatcaaatagtggggctggtattttaatcagttgatactaattgtcaaggtgtgatggccaagggattgatgtttatcagtgtatggacagtggttcagagtttggtgaattagtcgagttgaaagagaaagattggtgacaaagatgtatgaggtggaaagtatactttcacagaataagaacagaaaatgagatttatgtttttttgtaaacgttcaacaaagaaaattcattcagaggaggaaataggtaggcaagatgccctattctacagatgttagtcagcatcactgcaaagcaacctcagggcttatgcagtggacacttaaaatagcactggtgcagggatgggagaaataaatggatttaataagcactgctgcttaccaaggttgattgaattgccactattgccaagtgttctacctgcaaacagatcaaccttgagccctggatatggcaccatgtcccagagcaaccagccagccacctggtggcaggttgattgcattggatttgctccattatggaaggtcagtggtttgtcactgctgcgatgaatgcttactgtacgtttggatttgcattccctgcccaccatgtttctgtcagcaataacatggccttattaaagccttattcaataatatgacatcctatataatattgcttttgatcaggagactcattcacatcaaaataagtgaggcaattggctgtcaactacaggattcactggtcttaccatgttcctgttgtagcatattgtattctacctggaagatgaaaccttgtgacattaaagtagtttttagttccataaacataatacaggggtctatgaatcaagaagtggaggtagaagtgttgtcttttacttcacatctaatcacatgttcaaaatattttttcatcttgcctctgcaactttgaactttgctgacacactgaggttttagtgtgaggaaacaatactttcacatgggaacatgatagtcgttcaattgaactggacatttagaataacctggccacattactgaactgtataactgaaacaacaaatgaaaaaaatgaagatgctacgctggcaaagatgattaattttgattattgggagaaatagtattgctactgttaggaggaagactatatgtctagaaactaggaggaaacctgggttgcctccttgtagcagggtaaaatgagtgagtaccttgtctaagaaagggaacatgaccaaactgaacccagaagacataggaaatctaaacagatcaattaacaccaaagaaacgggcattttttggtacttctaaaaaagtaccagactgatattttcacagagatgttcgttatacccttaaggaacaggaacagaaaacttctatactatttaaactattttagaggatagaaaaggaaagaaaactccagattttatttatagaacttgcatgaaattgataccaaattctgacaatgcaagttcaaaaaggaaaactagagatcagtgttacttatgtcaaacagctcttaatagaatagatggatatggttatcaacatgataaatatgtttatcacattttaaagcctacatggagaaacatttgaggttttcttattctagaactgacaggaatgtcctttattatgagcactattagtcaaatttttctggtggaactaatgtaagtagactgctgaagaaaatgaatggtatgaacattggaaaggggaaattaaatgattattatttacagataaaataattgttaagctggaaaatccaagtgaataaagggaaggcctacaattaagcagttaaggaaagggctaggtatagaaatcaatagttttgatatatgcaggctatagccagttaggagatcagttaggggaaaaacacgttgacagcagcaacgaaaagctgataaacctagaattgttcaccacttatcttaaaatgtttaacatggtactgagggacacaggagattatttatgtggaaaaacataccatgtttctatacagaaaaattgaacatcacaaaagtattatttgatcttaagataatttatatttaatgcaatctcagtgaaataccaggagaatgtttttaagctagacaaacttatttcaaagatcatatgtaaaaataagcaaaaatagatgtgaaaaattctttaaagtaatgagagaccagtcttattgactattaagtcattataaaactataatgtttaaaagatggtactgacatatgaatagatcagtggatctcagatgggcagtgcagaaagagatccaaacacatacaaaaatttagtacctctaaaggtggcatttaaaatctgtggggaaagatggattttccaatgaataatgttgggataggtagatagccatctggaaaaaatgaaagtcaaatcccaactttttaccttttatcaaaatgaacttcagatacaattgaaaatataaaattgagaccataaaagtattagaagaaaaatgcagtttttaagtctcaaaaggggactcttaaatatcatacaaagcccagaggccataaaagagatgattgataaattcaaatataggtccgtgtaagcgaaaactttcagtatggagaaaacataagttattaaggcaaatgacacactaggaaaagcatttgtaactcataacaagcctagttttcttactgtgtaaagtactgccataattgacaaagaaaatatgaagaattggcaagtgacatacatagaaagttcatggaaaaaataactcttaaacatttacaaaattttacaacctctcatgaaaagagaaatggaaattgaaattagagtcacatacagtatttcacttttcatttgtcaaagatcaaaaagtttgaacatactgtgggtttatgtttataaggatgtaagaaaacaggcaatctaaattccttgtagagtgtaaattggtagtaataagagaaaaatttactgaatactttgtgccaggtgcttttctaagcactttacatttaattatctcaattaacttatccagaaagtaccattatttctgtattacacgtgaggaatttgaagaaaagttagacaagtaattcaaagtcacacagttaataaatgacagagtgaagatttgagaccatttcctttttctcaagtgtccacttttggtcgcaactctgctgtttctgtagtgagtgatttaacactatatgataaaaccttaagagtacgtactctttgatccagtgattctacttccagaagtttgtccattttgcatcaaatagatggagaatagcattcattgcattgttatttgcagtaaaggaagattggaaacaacctgaacatttatcctcaaggactcatccatacaaaagaattgaagtaaattcatccagatgaatatgaggcagctttagatagagtgagatggcatcctatgtagtgatatggagtcatctttaaaatacagtaaaaggaaaaagcaagatacagaatagcatgtagggaagctgctgtctatgtgaaaagctgtagaatatacgtgcatttttgtatatgcatagaatattcctagacaaggacaaacatggtggttcatacctgtaatcctagcactttgggagactgaggcaggtgattcacttgactccaagttcaggatgagcctggccaacatggcaaaaccccatctctagaaaaaatataaaaattagctgggtctggtggtgtatgcctgtggtcccagctacttgggaggctgaggcaagaggattgcttgagcctgggaggcaaaggttgtagtgagccaagatcatgccactgcactccagcttgggtgacagagcaagacaccattcatctctctatctcttttctctctctctctttctctgtctacacacatacacatacccccccacacacatatatatacacacatatatgtgtgtgtgtatatatatgtgtgtatatatatacgtgtgtgtatatatatgcgtgtatatagatacatttctagaaggattctcaaagtgatatcagtgattgttgtgcaagaaggaaactagatatcagtgaatgcgctaaataaggtgattttgaattctgtagcatgtgtatgatttacctatagagaaagcagtctagcatgagcgtgggtttctcaaatatagaatgtttgcagtgaggtcacttggtgaaaagtatagccatgtcagacagatgtaggttcagattccaggacttccaggactgctgaaagggaaaggggctttggatctccttcagctccaggcagcattgctcctttcccagctttgacattagctggagggaagacaagttcttagagctctatgtgcttgggacaagaccccttccccctactgccttactcgccaaccataactgctgcaaacaattcttacctcttccaccccatgtcactgcctaaaacccttcatcacctggcctcccatgcctctaagtctctgtacatcccctagcctgatactgtccccaaccctcctcaactccagacaccattttactctaccctctggaattgtccattattagcaaaatctcctttattttcaacctcctttctaagtatttcccccacattcttgttgtaatagagacacagctttcccaggactgtatagctttccttgcagtcctctaaagtggtaactggtttctctgccatacatttcataccactggtcctggagatattgtcaatatcttaatgtcttccttccatctcacttaaattttgagaccataattcctttttcctctcttaaaagttctcagtgttgaagctcaatccattagatacctctagctggcactactagttgcagtcctgtgcagactactgagtcattttctttactccctgaagacttaaactctatcttactctcactctctctgacattactcctattaaaatgttatgtttctttagctattctttcagtttttggtctcctctccttcaacgaggatgatttctagaatgttggttctcaaaatgtggcccctttgcagacatcgtcagcacctgggaacctgttataaatatgaatctgcagaccacaccccagactactaagcccaaaattctgggggctggagcccagaatctatgttttaagaagcacgtcaggtaattctgatgaatatgccagttccttagatcttgttattgtcattactgacaactttctctgagaccacaatttgaatctaccaatttttcactagtactcacccatcttaagtccttactttccccttaccagccagacatttgaatattccttgactcttctctttcacatactatatccaaagagtcaacaaatgctgtcagctataccttcaaaatacatgtagaatctaacttttaacctccactgcagtcacttcagtccaagcacaaccatttcccacctggagtattgcaactgttcttgtttggtggcccttggccctactttatctactttccgcaaagcagccagagtgtttctttcaacacctaaggttatatggcttcattgattgaaattcaccgtgcttcacctctttctctacaaaagccaaagtccttgtaaatgcctgtaaggctcgagggtgatctgaccttccctggcctgtcgtgtttcggtaaaagtaagctgagtctttcatagttaaaggacagcaatattgtcctgcatgatattttaaaaacccaatcaagaatcacacattgcatttaattttcatgcctttagtctccattaaaagtgtgccctttgtattaataattggagtgatgagggacagagtttaagaatatataaatattttgtccccaactgactgtcactggatggctttggcacccattggtgattcttacctgaatcagtaattattgtgatgactgaaaatagtgatttttctcactgtataattcttctatatttattaattaccttaatattatcctatagaacagaatgttcccttctcatcttttgtttgtttagtgtcagtattactcatgaagttgggtgtttagaaaattcaatgttgtataatactgttattattcaatattgtattttctcagtttgagtcttccatctgcgtcctttcatgtaaatagtataaagatcagtaatagaggaacatagagtaaagtgtgagcagagaagccttactctgagacaaacttcagagaggtgaactctgttgctgattaagaaaggcttcactgaggaagtgttgtttgaagtgagctttgaaaagtcataaaattttgacaaaagtggggatggggtggagcttaaaggaaaaactgtctgaacaaaggaaggcccggcagactaggaatttggcaataatacagtggttttggaccttgatgaggaagttgaaatggaacataaaaaccctctgcatttagctccatttatttgctcaggcagctctcactgcctaaaattttcacccctgctgttttgctcaggggtgggatgaggggtaatgagggaggaaattttagggggtgaaaacagcacaagccaaaaaccctgctcagatactcccttctcttgaagccttttccagatccctaataagaattaaccaccctctctcacacactctgttgtactttgtccttctctgttaaccagcctctgtgttttgtgctgtctgtatttgtggatacatcttcctcctttaaagcacgaatcatatcttaatcccttggcccttcttcccagtacttagcacaagtgctcaatacatgtttctttaacgcgtgtaacagaggaaggcgaggagagtgagtgggattgggagcaggaggattctgaatgtcattttaaggggtttgggctcgctcttcaggcagcaatgagccatagccgcctttgaactgtgcagcactgaccagagctgtgatgccaaaggatgcagtggaaggggaggacagccagcatgcctgggcatggtccccaagtcagaggacatcagtgggagaagggagaaggcatggaagcaagtggctaccatcttatgaatctgagcactcattcaaaggtggcaaggaaaaaggaaggcattgagcacggttttgaggtttccagcctgggtgattggaggctgatgcaggcttcttaccaaaaagggccctaggcagtttcaccaggaatgtttaaggagtttatcatgaccctatctcttcctcgtctaaaactctccctaaaatcaaaacagtatgtcctgttgaaatactttattgtatcaaatataatgagaagtaaaatattctctctacttgatgtatgaaacactgacttcttgtagtggacaattttcacttgtctttttagtaatggtttttattaaaaatagatgttaataactgcttgtttaatctttaaacgtggccctctgagagcagcttaccgtaaaagaaacggttgtcagctttctttttgctcctcagtccctcctgccccttcctaacaacagaaaatttgctttgcacctgctccaactgggttcgaagagataagcatcttgcaagcccagaaaattgtagtatcaaatctcagccccaactgtgaggcagcactatcattgaatccctgctgagaggcgttgctttcccaattcccaaaagagttctttctcccctggccccttttcaggcttgaactctgaccgaaaccctctttttaactcccagcatgcactgcacttggtactgacactgacccatccctgcttcctctgttctgcactggactcatcagtaggtcaggcgttggtagccctggggtcactggggtgcccaattccaataatgagcacatttagctaaggagaggaaatgtacccttctatttgttacagtccattgctttttttccagaaacaaatgctaaaagaacatttgatatattgtggtttggtaaatacacatagcactgcctaatattcacaaagttgcctcttttttttgcatcttccttcataaattaaatatattgttctaactcatgatttattttaagagggatatacctatttcacagctaggaaaatgttttcaaataaagttatattcagaatactcttgcaagaatttcaaataaaaatagcaaatactatttaaatgcatataacattctaacagacttgtgtgtcattttaaagggaaagaaaaaaaatgatgacaaggactttacaactttgtctttaaaatttcttcttaggctttccaaacagaccgaagtcattaaaaatactccttaacccccaaagtcacaaaaaagaagctacccaggtttattatgagaaggttgaacctctgttgaagcttgcaggaataaaaactgatgtaacaagtaagtaattttcagaatataatttcaccatctacaaaaacatacaaaagcaaaataatctgaatttgtccttaatgcaaacttgggaaactacttgtaatatctatagcatttttacgtcttcataacctactgcagccagctcgagggttataatttaattatttttgttatttttattagaatattaatattttctctttagaattttttcagatattttttcagacttaaacaattgttagatataattacaaaggaagctgtatacttgtttacatcttcatggagatgtttgctacttacacgttaattttgcagttaggcaagaaattgattttttgctcacttatatagttgatgtctttccatggaattcttccttgggttgttttcgttctgactctgacccctggtggttaggtcaaaactaagcactgaactgctggttttattaatagatgaatttagagatgctagaagcttaaatttgttgtctaaactaagaaatgtacttaggtttgtgccaaggaaaatagaaacttgttaatgctaaacttaatagatgattagtaatatcctttttgatttttttaatttggtagtcacatttctttgtttctttgagacttattttcgtatggtggggaactgagtagaagagtcgatgctatggagaatcgcaaccttcctagctttatttctatgtggcttcgctaacagtggaaatttgcaataaattttaattgatgaaaagtattataaaataagcctactcaggggacaagcccagagtgcaattggaacttcctagtcccagttatagattcctagggaagggattcacagtgatgtggctttactcagctgtaaacaaaggagataagtttcaagatgttaataatatcattgaaacctacacctagtgatctgatggattgaggtagaagaaagttcaaaaaaaaaaaaaaagcaagttttgtaggaaggtcagcccccatgaaatgtgcctataactatagaggttcgagagaaactaccatgaaaaactcaagaggaatttttgaattaaaataaagttatagtgaagaagttaacctttatgtttgtgaccttcggcttatttagaggtgatttacaagtaaaagagaaaattcagatttatgttttctttctactgaagatttccaaagattggctgaaggaaaagtttgagatttgtattagggtgagacaattaaaagttgaataaacatattggcatactcaatgactattttgttcattgcttttacatgtgaatactacaaagcagcttaacatggatattgctatatagcattcacttcaggaatctcattgtatgcttgctctgtgttcaacatagtgcaggatgcgagatgaataagctatcatacttggatgactttctacattattagagattcaaaaaaatgcttaaaaccattataactggggtatacataaaagaactttgatgtctcagaggtgatattttgatcggaagattcaagaaaagcatttgaactaggcagtttttaagaggcagacaaaaaatgagggaaggaagtcaggctaacaggcatgtactgtaaaagttgggagggggggcggagagagagagtgtgtgtatgtgagagagtccatgtgtgttacacccatacatctggagagtttgtgccataactttgctctactttcctcagtttttacattatctgaaatcttactctatcatcataaaatagctgccagtgaatttcatcctttcttattaatatccagtgggatggggagaggtgtgcatatgtgtgcaagagagacccaacatgctttaatcctgaagatgaattaaaatttccttttttaagtttgggcacagatactgtattagcgcagtcaatctggaataatcatttatttaaccatcaagactcttcccaggggctgaggacagatccccttttcctgatgactgaaatgcctcagctgaatctggattctgttagggagaagaaagggcaaaatgacttctaggaaggctctcaacaatgtatactacaggaggtataattccaggttatggatggatccttaagctgcactcagcagtttactcatcgtgtattgatccacagttggtgtaaatttttttttatcatactgttgcaatctggtttggcaaagatgactccaccagcagaattaaaattaaaaaggaagagagaaaaagagattggagacaagaaaactgatatacaaggcctgaactaaggcagaggaaatcatctaaatgtgctttccttcttaattgtattggagacaaaactattatgttctaggatttttttctctaaatttgtaaatattactaagtaccatatttaaacataaaacaatagaatattccgtaaagcaaatttagaatttacttacatttgtgcagaatggctaattattagctgcctaacactcctcctacaggcaaatttataaaattacatcatttgcttataaaaccattttagtatgcatattggctcaatatttatgaaaaatatttcttgaataaacctgtgaatatttgaaaagttttagtcttcctgcctatcttacagtgttatttttgtagttgaaataatatatttgaaactttgtatattatactacagaaaggtggtcataatactgttagtttcagtttcaaaaattatgtcatagtaagatcgaattcgtactttatttgaaagtatatggaagagtaaagcagaaagaggacatatcttctgcatgtccagtgggacattgttttaatgtatccttgtgtgaatgggtgagtccaaatggaattggaattacaaaataaaccctatatgatgagttaattaggaaatagtgctatataaatatgaagtataatatgaagaattacagctagatatatacactataaggtactgtaattttttcataaatttattttaaaaatggatcttaccacattaataaaaacacacttctttcattttgggttgtgctgaaatcctaactacttctgaatatagatcagcatcttttgaaatatttgtgctaaagttgcatccccactctgctaccaccaccaaggtagtatcttatctaatagcatcagaaaaacttccgggagaacctggaaagaattattttttcctaattacctattcgtacacaaatcaaagaagagtatgaacgataagcccatgctggcatatgatatcatttctcttgcttctgaaacaaagcaagttttagagattgtaccattaaaggtgtgacagatattttgaggatcagagatccataggataattcatagtacaatagagtgaaaaagttaaggcagcagagaaatcagactgaaaagaactttcgaggccatatggttcaatttttctccttgtgggtggagcacaggtgtgtggcactcaactttggcttggccacctacactagaggcagagtacgttgttactggacaatactgtttgacattcttatgaatgttcagagttactgtacctttgggcagattagaaaaggcacctcctctgtgctgacttacaaaaaggtgccctttcttccagactaattcatcctttgcttataaaaccatttcagtatgcatattggctcaatatttatgaaaaaaatatttcatactttcaaaatattcatatttcaaaaatattcagcccaaggtcactagattcagcctaaagtcatttgttagattgcaaatccgtcattcccgttagccaagtacctttgtgctaggcataaactgtacaaaatgagaacttgtcagctgacattcgcctctttgtaatttttatgtactagagttaatgttatctcttgtagtaatatgaaataaatgtgccccatctattgtataggagtcattgagatatttgaagagagatatcctgtctgcccctcatctcttgttcacgataggtacttccatcgccttcagttactttttgcattaacagagctgctagaccttatcatggtcattatcattatcatactcaaagacatttatctgaaggaaaccttgatctctgccagctcagggctcttgggagtgcctagtcaccagataattttacctcctgggcagagttgtcaagaaagtggtgtttgttatcattttccccttctttctcctaaaatcacgcttctaacatggctgttaacaagcctcttcatagtgtttctctggttgtttatggctctacttgaagccttccatttcttggaaatgcctcttgcctttctaaatctcacccagcagaaagctaggccatctaatgaaactgtgtcacaaaagattccagtagcctgaggcatcactccttccaattttacctgcattttaatacaaaatctgaaaagtaaatgttcatgcatcatatctagctagagagaaagataattctgtgtaaaagattctttttgttacctcttaaataattgtgggtgtatatggccagtcctgttcccagcattcagatgtgagttaggaagttggaactttatacctggggacgatgaagactcactaatggggtatatacaaaaaagtgatatgattaaatatgtatctgaaaatggttattctggctagagtgggggagaggtttgagggagacaagataaaaggctattgtagtacaggtggagtatcccttatctgaaaggcttgggaccagaactgttacagatttaggatgtttttagcttttggaatatttgcattatacttaaccacttcagcatctctctaatttgaaaatcatggacacaggaaggggaatatcacactctggggacagttgtggggtggtgggaggggggagggatagcatcgggagatatacctaatgctagatgacgagttagtgggtgcagcgcaccagcatggcacatgtatacatatgtaactaacctgcacaatgtgcacatgtaccctaaaacttaaaagtataataaaaaaaaattaaaaaaaaaaaaaaagaaaatactccaatgagcatttactttgaacgccatgtcattgctccaaaatttttagatgttgaagcgttttggattttagatattctggttacagatacttaacttgtctacacatgaaagatatttagtgatcagatcaatcagctaatttagggaattagctgggagaaatggaggaatgctatggcataatttaaagacagaaacaactggccttggccatggagtggttctggagagtggaggaaagggacactctagaaagaagtcattttcctgtcttggggtagatgatggaacacaaaaagaacaatatatttgagagagaatatatttgaaggtatacataatggattctgttttgagcttactaactttaaagtacctacaggacaggaaagaaaatgacatttcagtatcatatcccacactagaattttatcaccaaaccaagaaatgtttccttatgtccaaatcaaatctcacctgattttatttcaggtgattttctcatcaacattgaatatcaaccttaagactttcttgtcttcctgaggaagttgcatttgcaccaaagaggggagggggaaattcccagcagtgagaattgtgttcaaagacctgtaaactgtgaaggcttcacatctcctatttagaaagagcacaggttggcaatctcataggaaaaggcaaatagatgaaagaagaggctgggttacattttttgaaattacatttatctagcaatcctttctttgtttgtttgtagggggatgatttgaatctggctgtcactgattccagggcccacaatagcctgtctaaatacatatttggtcctttctactatatttaaatagtaatccagatcactctttatccttttgcctaacattgttttgtataaccacctattacttcatattataattcattatttcattagcatatattgtctatctccagaatgcaaattcctgaggccaaagactaattcattttgttcattttgctaatatattttatagatgtagatagtcaggttcttttcattttgtttctttgttctagatctttgattttattggacttttgcaatgttacttaaaaaattgctattttcaggcaggttgcattagtgtataatcaaattccacccacaatatcaaaaaaagactattacaaattaaaaaaataaaaatagcattcaataataacacagttctaaagctcattattggatctgaaaaactttaccaatgtaagctttggtataaaagtaaggcttggtgaactgattcttagcataaatattttttcatgatattcttatttttaatgtgtatatgtaagatgttttattttgcattttaaggttgtaagtacttgctgtagttataaatgaatgatcagcacacatcttctttgataacctttcaactttattaatattaatgtttcatatgtagttttattatggctttcttctgattggaatttaatatagagaggttttattcatgtgagtgttaatggcattttgaataagctatgggagaattacaatgtaacactgctggatacagaatgattcttttagacaccaagactaataatttttaacaatatcgaaaaacattgtaggaaaagcttgaaccatgctggcaccagggacagacaagcatgaaagattaatgtaatcttgcatataatgacacacattcttacacaaaaaatccatctgcaatgtcatgtcagtcagcagaaatctttgatgggtggatacagctgggctgtctcttctggcagagctgccctggaaaatgctaaatgtggttgtgatgcttggtgccatctgcagtgtgcccgtttatcctgtcttcactggcatttacgatactgcatagggcatcagtgactgtggagacagcgatacagagtgacagattcatttcctcggagggtctgagctctggtgggcctgtgtgccaccctccttcttgggtctgggtctcttataattggtgttggctttactttgtattttcacatccaactcttcctctttttagtctaacagttccagtacacattcttctggtttgtaaatcttacactaaccttttgactaatttattcatgtaaggttgccaaaccgatttaagattgactgttcaatgccagctaatatgccttatttccaaaatactgctcctcctaagcctctgatttaaaggacatgtgtcttatttagggaatactaaacaggcaccaggacaaattgggtaaccactatgcgtgggatattcccaaatgactttatgtagttgaaacaaatatatgaccttctcttacataaagctataaaacatcaggccagtaacacttagtcctcttgcccatgattaaaatataaatattcaagaataaatgctgttttatgacttgaccatatgtttatcatattattttgccagaacaagttaaaaagtgtgatcattgtttaaaactgtcactttgtgtatgtgtgtgtgtttttttaatagtaatggaatatgaagggcacgctctgtcactgcttaaggaatgtgaactccagggatttgatgggtaggttatattattaatcaatatatgttatatcatttatgtattaaatgccttcactagttttagctacatatttggaacctaacatttaaaaatatttgtagtgtatgtactttggctctatcttgttcatatctatgtaataataattaatgataatatgacatggtcatctatctctcaggatctggcataggaaagcaaaaagaggaatctaattattaaaatactgggaaatgacagtgtactactctatacttactaatgtgcatacatttgcatctataattatttgcttttaccatatatctagagaagcactaatggaagatgttatactggtcacatggcataactatatgatgatcttcttttgcaaattaattgataggtttaatagctacccattggttaacttgtctgtgatagattgagggaagatattttataaatacaagtaaataaatacattatttccagaaacaataagaaataattttaattatctcataatgtagtgactacaatttaggtatgttattcacagtgggcatcggaaaccattgttcgcaatacattggagtgtacagagattgttcactggcatgcaaacgttagaaccaaggcaagtgatataaatttcattgccattttttaaaattaggtgaaccaatttgctaaagtgttggactgatgtgtaagactaaaacatattatattcctttagggaagttctttttacgtgagtagatatttgagaatttaaaaagttgacaagtgtgtgaattatttgtgttacatggtgatgggcagggggcaaagacccataaggtcaggaaagggagttaggtctgtactttcaccaaagtgaaaggcattaaccttcccaaagactgatttgaatgtgctggggagggaagtgatgcaatcaaaatggagtattggcagggctgtttttcagaaatgcttatttatttatttattttttggatgaggagaaaacaatagctgttgagaaagaaaatgtggtaagtaaaacatgatttttccaaaaggaatctaattgagggaagtaaatctagatagcaatattatataaacattgggaatcaaaaatatggggtaggagattacttcagaactttatacttagaggtagacaaaaacattaataggcttcatttagaaaattgtcttacaagtatacaatttaagaaaagtccttgtgggaatcatgcataccaactacctatttgaatatgctgcatagtccctcactagacctcatgagtacatgaaggtagctgcattgcaaatgagtacctgcttcaaaacttgattaaagaatgagaataaagatatcacagatattaaacttgttcttacacagcagcattacagaatgttctgctgaatgcagtatctatcaatatgttttactggtatttgtactgggtaaagggatgaaaagaactttgcagaatgaagaaagacgattgctgaagtgtagtacaataatatttttctctttacctgaacatatttaatccttatttatttttcatggcaggtgttgttatttttcagtgtagagctaaaagatgtatagatttttcagttattatattttataaaccaaatagtttggcctaaccattatatgaattgagttatgtaagtgtttctaaactctatggcatgctgatttatttcagacttacaataatttcaaatttctactgaaagtcatcttccgtgttctaagactctttaaatcaggggtccccaactccgagactgcagatgaatatcagtcagtggccttttaggaactgggaggcacagtaggaggtgagtggcaggagagggatcatttccgcctgagctccacctcctgtcaggtcagcagcagcattagattctcacaggagtgcgaaccctattgtgaactgggcacgcgagggatataactggtcatgcgagggatctaggttgcgtgctcttgatgagaatctaatgcttgatgatctgaggtggaacagtttcatcctgaaaccatccgtctcccaccccaccctgcagtccatggaaaaattatcttcccacaaaaaagtccttggtaccaaaaaggttggggaccactttaaatagcttatttatttttgtggggtcagttttcccagtagaagctgatatggtagttggagtaattatcttaataaactggcaattttaagtcactgtacttagaattacatagagagatatatgaggagaataatagaaacatagtttcttcaggtacttcaaaggaacaattctcttgcaagtaaaattgtttgaaaatggaatattctacattggtgagttttctattcctgaacctgttctaaagagtggctaaaggaaaattttgggggaaatttatagaaaaggtgcagagatgagagaaggttaaccccaaaatgctatggcattttgatgagagacagactcaaatttctttaagaactttggcctgaagcacctccgtctgacactagtggaactattaatagggagtgattaggaaatcacctaacagtttggtttctagatacaggctgaagaagttaagagccaagaaagattctatgtatagtatttagtaaagcaaaacaatttggtaagtaatgtttaagaaatgctatttcctaagattttggagttgtatttattttttttaatgaattacatatgtttctatgagacatcttgtgacatttctaaacccaacagaaacagtgtatcagcacttatgacagctagttctccactgcagtgtgtcctaggaaacactctaagatccactgttaaaccttatgagagcttcagattctatattgctccctattttactgggcatgagtaggaagttttaggaaggaaaataaaagaatatcagctgcatagacttgaagcagtaacacttgcatttataagtgtgagtatagttttaaaaatctatagattttatgcaattgtaaatatatgaattcctcgctattaatatttgtttcagaatttttaaaaaaattgttgagttacttttcttttgttcatttcaccattaattagacccataatgttgtagacattatttggattatattgacattttatcagattgaacatatctgtattacttagtaaggtaaaaagcaaaaacaaaaacaaacttttccagaaagaaaaaaaactgtgaatcaaaactacaacaatatattgaacatttcatagatgatgggttcatagataagtataaaaacattcattaaaaaaatctttatcactctttgaaaaaggatatattatcacccagtgtttcttttctagacagaataattctgtttggagccatggcaaggagtttacttattttaaaaacaagatttgtcacatgcaaaggattagttactctaaggtttatgttttagagtgacacaagtgtgattaactcactataaatgattgaatactttgctttttgcctttcttgtatatttagactcttgtgatatttttgtaagaagctgttgatgaaaaaaaccaaactgtaaaatatttaaagaggtttattttgagccaaatatgagtgctcatggcctatgataaccccaggggggtcctgagaacatgtgcccacagtagttgggttacaacttggttttatacattttggggatacagaagttatagccaaagacataaatcgataaatgtagggtattcattggtttggcccagagaggcgggatatcatggagctggtgggaaggggagctcacagatgaattcaatgattttctgattgtcagttggttgataagctttgctgaaagattagaagtcagcagaaagaaatgcttgagttaagataaatggggtggtgtaggctgggtgcagtggcttagcagtggctcacacctgtaatcccagctctttagaaggctgaagaggggagatcacctgaggtcaggagtttgagatcagcctggccaacatggcaaaaccccatctctagtaaaaatgcaaaaattagccgggtgtgatggtgtgtgcctgtagtctcagctacttgggaggctgaagcaggagaatcacttgaacccaggagggagaggttgcagtgagctgagatcacaccattgttctccagcctgggcaacagagcgagactctgtctcaaaaataaaataaaataaaataaaaaattataaaaataaagataaatgaagttgtggaagcacaggttcttgttatgtagatgaagcctccagatatcaggcttcagagagaatagatggtcaatatctcttatcagaccttaaaaggtatcaaactcttagttaaatctctcctggatcaggaaaagacctggaaagggaaggagattctctatagaatgcaaatttctcctgcaaatgatagctttgcagggccatttcaaaatatgtcaacaaaatacattttgggataaaatactttgatttcctctagggcctgctatttgttatttaatgctataccagagtcaggttggagttggggatcttattgctaccaagtctgttttgtcagtcttatgatctattttttttttttttttgagataaattctcaccctgtcacccaggctggagtgcagtggtgcaatctcagctcagtgcaacctctgtctcccaggttcaagcaattctcctgccccagcctcctgagtagctgggattacaggcatgcaccaccatgctcagctaattttttgtttctttaatagagatggggtttcaccatgttggccaggatgatcttgaactcctgacctcgtgatccacccttggcctcccaaagtgctggaattgcatgcatgagcctggccaatgatttacatcttaatgccagtgctggccatttgcgcctaaactccaaaagacaagagggtataaggaggcatatccaacctcccttcctgttatgacctgaatagtttttcagattttctttgtgaccttcatggccaaaaggggaggatccattcagttagttggcgacttagaattttatttttgttttacaaaacttatttcctaggttgagtcactttacctgaacatgatcttaatgattgaatagttgttaacataaataaatacatattttttctaactcacttaatttcacactggttctactggtaaactgtttttcaaaataataagattctcataaggctatttttattaggtttcatatatagaaaaggtatctaatatattgaataatattgtagcttctaagaccaaaatgtcttatttcaaatccctgttctattacttactagtggtacaatcttgaaaaagttactttatctttctatgttttagtttcctaatctgcaaattgaaggtaatattacctattgcatacagttatttctccacttaaatgagttaatacatggagagtgcttaggaaaatgtctgatatatatatatagtaattattcactaaatatttctttattgttataattgtcatttgtattagtttcaaaagatttaacacagaatgtattatgacaaaatttcagatgtttcagaacatgctcatagggaggccacctctaataactctagcaatatgttaacatatgcatgacgctataattgtatgcaacattctaggagttaagtgttcgcatcctatgtatgtaagggtcaagttatttggtgctaaattagatttttttgggtatgactccacatagtctttttggtcacacccatatgtcagcatttagacagccatggattgagggttacgtttaagttcacagattagaaatctcatagagatttttgaaatcaggtaagtttcaagtcaaaccttggtttttttcattcataaagatgggactgtggcctattttgcagacttctgaggatttaatagaaattagtaaacacattacctgatatatagtttgtccttagtaaacatcattccttttctctgaataggtggtcatattgcgaacctctggaatcagtttagacataagaataaaacacacctaatcaaacatgacctgggtcatatcttgagtcttctaaccagagtagccttggattgcccaggctatgtggagctagtgggatgaggaagatggggactagagggaatagatggccgagagaaagatggtgggaactgactggaaagacactttcagcctttggtcaccaccctccagagcttcctaaacttagagaaccagtaactactgctgactgtggcccatagacagttttgtttgaaatagtgtttttaaatatattgaatgctagttgcttagtatttacaaattaggagactcagccttaaatcagaatctctggcttctgtagaaaaaccagatctgggtccattaggcctcacacgtgatgtgagtgggccacagcaaagaagtggctgcgcctttagattgagcctactcttccattcctgctgggcccttgtagcccttgagttgtgacacctgctttcactgaggcaaaatccactttccattgggttaactggtgacattttgatacgtaagaatattttgcttcttttgaacataaatgattatgaaatgaatttctggtacttctgtgttattttaatggattctgcccccatagtctacttgatataaagtcttaaaaaatatactagtagtactatctaggatcaaaggctaatagtattacatctagaagcaccgtatagcaataatgtcaaggagatgaaattcaggtcaggtttgtaattactacattcatatagtaatgataattagcagtttcttaaagcttcatattttatatgatttttattgctatctgtcttttcagagctttattgagaattagcaggattttatgactttggttggtgttagttaaatgaattgcagatgacagtattattaacaagaaatgagaatgatatgcttttggatgttaacagagcaaaacgctggtcagatgtgaattaacatgttcaaaagttttcatatctcttaacacacttaaagctattttgtctatggggaattatctagttattatatttgtgaagtaaacttacctgtgttgtgtttgtgttgtcttacccattgacacatattaacatgtttaaaggtacatgtgagcagttatgcacatagactacaaattagtaaactattttgaagtctagatttcatgacttattaccaatcattctgaagttttgccttctttgcttgatttgtatttttctagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggcaagggagtggctacagattcattaaactgacccttctccctcttttcctttcttacttgctaatctagacagcacaacacagaattaatgaacagactttgaaagatccagacttctggcatccccactagcaaatgtgagacttttgacaagtcatttaatctctttgagccttatttttctaatctatagaatagggatcacagatatattattcactttattacaaggttattgtagtactaacgtttggtttagtaaagggtttaatatatagttaaaccatcagtatatggaatggttattattctcccttcgcataaaaaatctgttgattacacagtaccaggtaagaagtttcaaaacagggccactccagtctagctgcttacaattccatatgaggtgaatatggtaacttgcataattgatgtataaccagataaccttgagaatgccaaaattacttgtgactggaagggaggataaggtttggaagggtgagattcttaagggcaaggctttttaatctttctactcactgccatttttcagcatctagaatagactatgccacagtgatgctcagtgaagcctattaagtgaatgcatgtaaagaagactttatatagtaaatgacacttggattaggtcttaaaatgggttggagctggcctgaaaaggtgagaatgagttattttcttggctgcaaaagtaataaagcaaaggcaaaacccaggagtgtttgaggaatagtgaaaaggccattcagtggaagataatggtatcaaaataggcccaaccatggaggctcctacatgccacagtaaggtctctgaattgtatttgataagcagtagggaataatgggatgtttcagagcaagggggcaacctgattggagcttgttccaggaggattcattttgcctcaccgtgtggaatgattagaggttgggagcaggagaaagtagaggtcagagacacggagaaccgttagagcaacactgtgatccagaaaagagggaaacatcattcaaaagctgattgtattacacaatcactcatccctatttaacgaacggtgctgggaaaactggctagccatatgcagaaagctgaaacaggatcccttccttacaccttacacaaaaattaattcaagatggattaaagacttaaacattagacttaaaaccataaaaaccctagaagaaaacctaggcaataccattcaggacataggcatgggcaaggacttcgtgtctaaaacaccaaaagcaatggcaacaaaagccaaaattgacaaatgggatctaattaaactcaagagcttctgcacagcaaaagaaactaccatcagagtgaacaggcaacctacagaaagggagaaaatttttgcaatctactcatctaacaaagggctaatatcctgaatctacaaagaactcaaaagaatttacaagaaaaaaacaaccccatcaacaagtgggcgaaggatatgaacagacacttctcaaaagaagacatttatgcagccaaaagacacatgaaaaaatgctcatcatcactggccatcagagaaatgcaaatcaaaaccacaatgagatatcatctcaccccaggtagaatggtgatcattaaaaagtcaggaaacaacaggtgctggagaggatgtggagaaataggaacacttttacactattggtgggactgtaaactagttcaaccattgtggaagacagtgtggcaattcctcagggatctagaactagaaataccatttgatccagccatcccattactgggtatatacccaaaggaatataaatcatactgctataaaggcacatacacacatatgtttattgtggcactactcacaatagcaaagacttggaaccaacctaaatgtccaacaatgatagactggattaagaaaatgtggcatatatacaccatggaatactatgcagccataaaaaatgatgagttcatatcctttgtagggacatggatgaagctggaaaccatcattctcagcaaaccatcacaaggacaaaaaacgaaacaccgcatgttctcactcataggtgggaaatgaacaatgagaacacttggacacaggaaggggaacatcacacactggggcctgttgtggggtgggggaaggtggggagggataacattaggagaaatacctaatgtaaatgacgagttaatgggtgcagcacaccaacatggcacatgtatacatatgtaacaaacctgcacattgtgcacatgtaccctagaatttaaagtattatatatatatataatatacagccttatgaacatatatatatataaaggaaaattaggcaaaatagcattacttgaggtactcaatagcctggcagagcagacattaagggtaagagagactggacttgaatttcagtttggtacttgactttgggtgggtaattagcctttattagtcttgattacacatttaaaaggtttaataaggccgggtgcagtggcttatacctgtaatcccagcactttgggaggccgaggtagtggatcacctgaggtcaggagttgaagaccagcctggccaacatggtgaaaccctatctctactaaaaatacaaaaatgagctgggcatggtggtgtgcgcctgtgatcccagctactggggaagctggggcagaagaataacttgaacctgggaggcagaggttgcagtgagctgagattgtgccactgtactccagcctgggcgacagagcgaggctgtctcaaaaaaaaaaaaaaaaaaaagtttaataatgtccatccccatagggccattacaagaatcaacttttaaaaagtcacacattatcactaaaaaagcaaaatatttttccctatgattatagaaaataatgcacattgttgaaaaaaattcatattttgataaccctattcatttagtatggattttagaatacttagtattgttgataagttgacagagcataagatattcaaatgcccttttagagtgtaaagtctttcagaaagtcagaatttaaaaggagagagatattcagatataatctgataattctagagtatataggaaaacctaaaatggtttctaagtagaagacaccaagatgattttgactcaaagagaaaaatgatgcattttgggccatcttttcatggcattttatttcttgacctttttgctttactttagtagttctgactataatggtggaaactttccaacatttccttccatgcaaagtggatgtgcttaggacacttcattagtacttaaattcctgaggtcattcattgactgccatacatcagaaatagaaagatgggtgtccctacaggtatgcctttgacataaatttggtggttggctataaaaactggtggttattcttatgttttagtatgtaattcagattttataaagaaatagcatttagttttatcactattataattttgaagagtatttctgatttggggagcattttatgtattctttggatatttgtagtaatgccattttaacctgtcttgtttagaagacacagtatgctgccaaaattctggtcattgcataggagttctagcattctaattccatctaataggaggggaaagtcatgtgtggggtatatttaatatgatgactgtatgcctagtcagggcttttgatagagaatgggaactagaactaggcaggaagttttcaagctgaacatgaggagacagtgtgcctttgaagccatttgcctcctggagagagacacccagagggagagtgtttagtaaattaatccactgagccaacagactaagctgctgaattatggtcagactcaaatggatcagatgtggagaagcctgtatttgaactgctggccattaggaatggtgtttgttgctatgggaactggtgctaaggaactatactgagagactctgattaaaagggggagggggaatggagaaaaaagcctgagaggacataaaaataaaaaagcaatccagttgttgtaaaacaaggctcaagccacatactgatggctgtgaaccatatattcctatagagtttgcataaataaattcatgctttccaattaatttgaggagaataaaatattgccgagggactgttaatttctatgatatttcaggcaaagaaccaaagtgtaggtgccgttttcatgagaattttagatatgcttgactaggaagtcattacatcacatttatctgtttggatgtgggagacattaacagccttatgaatattcatggtatctggttaattaagttaattgttctgcagaagtgcttgcacttccaaggacattttttttttttttttttttttgcctccatagtttctccctggtatttcatcagtaattctttacatgaactgctacttctgtccttacttttttgtatttggaacattttagcagctctcaggaggaagtggtaggcaaagtttctggtagtgttaagaaaaataactttcaggctaattaaaatgtttaccttgaggtagaacatttatagcttttgtgagaacattaaaattacgccattgttatttatgtgagcagcatgttcttttggcatgtagacatcttttcaaatagagtacagtttcctgaaacaaaatgtaatccatctttcagattatcccaacaaaatatagaacaagctatcgttttgcaattttacatatactttctcataaactttccttttttcttcagagtgtcaaaaaccacatttaaagactaagatacagattaatgagtagtcaatgactaaaataattttctgacttctagtcatgtctgttatcactgccaacttctacagaattagagaaaagttgcaaagcctgagaagacataaacaatttttaaagccatctctagcattctaaaaaaattttgtacttgggcatacccaccgtacttcaaactcacagggaataaatggtctttattttcttaagtcatgatatgtgtcattctctattgcacatgacattacattatgttttttaatagcctttctagaggaatgcttttacggtctactcataattaaccatggtaatggaggaaatgtgtttcatggagtactgtaatccatcgataatcctaaatatctgactctaattatgtggcctcctccaaaatctttaccacaaatctgattgggaagcacaatggattgacttgtttcttccttttctcctgatccattccagatttattagcaattagatggtcaaagggcaggctgtagagggccacaagatcattggaaagaccttgataaagatccactgagtaacaggtttctacactacttgttctcaaaacttagggtccatagactcaccttgtgaacttgctaaaacagagatacctgggtcctccctcctccaaacacattctgagtccatgagttggaggtagaacccaggaatgtacgtttttaacaagctcccaggtaatgatgctgcttggaccatgcattccagaggagtttctcaccaagtcactgtgcatacaaaccacctggggatctaataaattgcagactctgaatcagtgtgtctggaatggggcctgagaggcaacattttaaaaataatatattttttacttccattaatactgctattactgttttaatacctattatccttatttttaaatggacaaaaattgtatgtatttattgtgtacaatgtgatgttttgaaacatgtatacattgtgaaatggctaaataaagataaacatgcataaaattgacataatgatcacatactgattttacattgagaacacttaaaatctcccttagaaatttccaagtatataatgcattgttactaactattgttttagcctgttctcatgctgcaataaggaaatacccaagactgggtaatttataaaggaaagaggtttaattgacttgcagttcagcatggctggggaggcctcaggaaacttacaaccatggtggaaggcaaaggagaagcaaggcacattcttcacaaggtggcaggaaggagaaatgctgagtgaagtggggaagagtcccttataaaaccatcagatctcatgagaactcactcactatcacaagaacagcatgggggaaaccacccccgtgattcaattactcctacctggtctctcccttgacatgtggggattatggggattaaaattcaagatgagatttcggtagggacacaaagcctaaccgtatcaactgtagtcactaggttgtataacagatctcttgaatttattccttttacctgaaattttatatcctggaccagtatctccccagtccttcccacccattagccccagtaaccactattttactcttcgcttttatgagtttaagtttttcagattctacataaaagtaagtatttgcctttctgtgcctgtcttatttcacctagcataatgtcctccaggtttatccacgtgttgtaaatgacaggacctctttaatgccaaatagtattccattgtgtatataaacaggctgattgtccctaatctgaagacttaaaatccaaaatgctacaaaattagaaatgtttgagtgccagcatgatgccacaactggaaaattccacacctcatgtgacaggtagcagtcaaagtgcagtcaaacctttgtttcatatagaaaaatattttaaatattatataaaattatcttcaggctatgtgtataagatgtataaaacttttatgtttagacttgggtcccaccccccagatatctcattacaccaacagtgtaaaagtattcccatttctccacagccttaccagcatctattgtttattgactttttaataatcgccattctgactggtgtgagtgtggttttgatttgcatttctctgatgatcagtgatatttagctttttttttatatgtttgttggccacataaatgtcttcttttgagaagtgtctgttcgtatcctttgcccactttttgatggaatttttttttcttataaatatgtttaagttccttgtagattctggatgttagacctttgtcagatgggtacattgcaaaaattttctcccattctgtaggttgcctgttcactctgatgatggtttattttgctgtgcagggattgttttcttgatttctttttcagatagttgtaagtgtacagaaatgctactgatttttgtgtgttgattttgtgtcctgcaacttaactgagtttgtttattagctctgacaattcattcatggagcctttagggtttcctaaataaataagatcatgcctacaaacaaaggcaatttagcttccgtatttatgatttgcaagccttttatttctttctcttgcctaattgctctggctagaacttccagtactattttaatgacagtggtgagaatgggtattattgtcttcttgaggaacaagacattgtttctcaactcatgagagtaattttaataagcactcaagtattgtcattcctgtttgacagtaggccgtattttgagtaacaagggtcacagcataacttgccttttggtgaatcagttggaaccagtttgccatttagttaaaataaacttttctttgcactggtattactagaagtaattgtgcttatttataattaataataattaaatatgcttattcttagttacctaaaaaattatgatattaatgacctcttggttgataatggctaagctgcctcagcttctccaatttagcaacccaagtacatatcagttcaaagtaacacaaattgaagcaattatgtatgatcacataggaatgcttctgattaacaaaatccagaggactggtctttgccttcataaccggaacacaccacatgcatggtttcacagctcttggctattattggacttacttattatattctttaattcaagaaaaattgtagcttcattcattctgttcttaataattttaaattctctttagcctcctgggaatgggaagggctagctggtatagtcccctgtatctcagatttcagttacacataaacattaaaggggcctgacttagggcgctctttgcctctgtggactggtggggaaaatccaggtgtgtcttaaattctaataatcatgaaaatcagaaatcataatgtttcaaatacaaatcttcatacatgggaaatacaattgaattaaacattttcttcaatgtaggagacatttgtcagataacagaggggattctcatttggctaagagcttacctctaagattcattaaatgtgtttagagcatattttttgtagtttgtagttattttatttttctgagttattatttggattattttctcttttatttatgtatgcatttgtcactgctccccagaggcacctcattttggcattgaagctaaaaacccattcattaaggttgggatggagtgggctttgatatagctagcatttgggaggtagaaaatagacattcgtgatcaaaaaagctgtaagcggttactataaactatttttaaatttctaagtattttaaatattgaacaaatgtgtagacatttgatgtgcatctatactgtgaataagaacttaaacttctaatattcacattaactttcctgattttataaattctcgtttatttttcatctgaacattgaagaatgacatctacataaagtaaaagcaaatgttagtttgaacacattctaccctaatagtgcatgttttaaaattgctttggcaggatctaccaatgtattggcacattctcttcatggagttcctcatgtgataactgcaacattgcacattataatgggtaagaattcttccaaagcagttcatattttataaggaaatgttgatttatataaggaaggccatcttatttccatcagactttaagaaaaggcaggttctttgtctcttagagtagagaaatgtttgactaaaaaaccaaaaggcaatgctttactatgtggattgcctgtcttttcaaaatacttgctttgtaaagagcagtaaatgaagttttattgtaatctgtacagaaaaaaaatattgtagtgtgctcaaaattataattttataaccagatgaagaacattaatgaatactccttaagtatatccaacactgatgtaggactgtaccaagactctaggactaggattatgttattaatgaaaaaacataaccagaaaaaaatttcagccagtagatgtctatagatattttattatccctattggtaaaaagcatataagctcaggtatatgtaacactaaactactgttaaatctgtgtttaccttgcctatctactttaacttcgtttctttgaccatgttttataggaaatagcaataagctgaaaaatttagtactctgtgtttcttcactagtacctgaacaagttaaaaatggtaattattgtagttataggtaaagggaactgaagagaaagtgaggatgttcatggtctacagtacctttagatattctcctataagccaataaatatgctctcttatgtttgctgttttgatacaagtcctactgtactcactgattaatatttaatgtaatattcaagggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaagtaagtctttttcttaaaccaaaaattgtatcccaggttcaatgactgttaataacaaatttcattacattttagggcagaagactgtgaaatatcatttttaccatttaacagctctgatgatgtgcaagaaaggtaggtaaaaactcaatgtaatacagataacctgtatctttaaagcataaaacattctgacaaacaattgatcagacttaggatctttggttatttttctaacatagtagtaaagaatatagaatcacagactcttacaggtcctagtaagcaaacaactactcactcagcctttttctctttttccttccttctttcctcccttccttccccctgtctctccctccctccttccgttctctttttcccttcccttcccctttctttcctttcctttgtttttttccctttctttccttttccctttcccttttcttttgagtgcctactatatgccaggcactttgaatacaacaatgcaccaaaaaatgaacaaaacacacagttttgtccctcgtgataattttggtctagtgtgtaatacaaatattaaagccatattaaagaagggttatagtctttaaagaaatagtacattattattccttataatactagtttacctttaaatgaatcaacacattatgttggcagcaacaaaattgtacgtttttacttactatctaattgaagaaagtatttaacatatataatgatgagttctctaattttctcatatttaatagatttgtgtgtgtctgtgtgtctgtgcgcgcgttatctgttttatgtctttgttttgttttctttcttttaggagggcacagggatctcccaaatctggtgagtcgaaaagtatctccttgagaactgtgccaggttctgttgacattttgttctggtgagggaaaataaccaatcactttcattacctttagactgtaatgatcaatggcaaatgatccagggtcagttcttgaatgtcagcattatggcaattccttgcctgtgttcagtggcacctagaggcttggcacctaataccaggttagtaagcatttttattgaattgttgatacatttcttatagaccattttttttccagggtatccaattaactgttggttagctagaaacttaacaggtagtttatctttgtatattagagattctaagggatttgtcatcacagtaggttgagaacaactgttgaactggaataattatcagataatcattgactatttaacgtcactgaggctaaaataatatttcctaagttttattgatagaattttatgcctactttacttgatttattcatttagttgtggagaacattatattaaatactgatatttcttgtgaatgtctttgctttccaactttaatgcaaacataaatatccttagcatgaaaatcacacatatgtatatttgatactgtattagtctgttttcatgctgctgataaagacatacccgagactgggtaatttacaaaagaaagaggtttaatggacttacagttccacgttgctggggaggctccacaatcatggtggaagatgaaagtcacatctcacatggcggcagacaagagagcttgtgcagggaaactcctatttttaaaaccattagatctcatgagacttattcattaccatgagagcagcacaggaaagacccacccccatgattcagttatctcccaccaggtctctcccacaacacatgggaattatgagagctacaagatgagatttgagtgggaacacaaagccaaaccatatcagatacttttagtcaaaagaaacatttcagttctatttaatgtgaatagtagtgcatatcaatctcctgcccacattttcaattgaataaaatatgagacatcttatatatatctttttatccatgggatatagacattccttctcttgcacattcttcttaatcagctgtccattatggggctgaaaatatttctttcctgaatccaatcctgtagagtgtaggagaaaggatcgtgagtgttgtgaaatataggcaataaacggggaaatattcaaagttagagaagaaaaaagagaaactgcaaacttcgatattgaaaacccagatggcaaggtcctcattaattacatctagtgctaaaacttcaaaggagtattttgaaccttgtgtgatttagaaattgagcctggtggttttccccgacaccttcagaaatcctagatagctgtgtgctttcataatgtagtttccctgactaaacttgaagacgtggctagctgaccaaggagctatgtttggcaggacttgagacaatgtttatctaaccctgtttgtttaaggaccttcttgggagggtagacctgctcttctgggaacaatcgattcatagctccttcaaagccactccataaatgttctgcttgactagaattccactgttgactctgcaggcttaatcagtattaatgaatttttcagagaaggatgactaattagagatttcttctgtggtttataatcacaacatgccatctttgcaaagaccttttgatcaagactcatttgaccggagatttttcagagatgtagcttctgatgattcaggatgattgaacaggagatttcactttcttctttttcccccaccatgataaataataatttatgttagaatatctcagtgcaaattgccagtaggaactaatattcttatattctaagtattctaagattaaatgtgttcatatatgtgagacatttaaagcagtgccagccatgtaagttgtgtttctatttcaagtaaatattgcaaagcaggcataggatagtgcttttaatgtttataaattatgcaattaaagatgcacagtaacactaccatgaacgttttggtgctgtttatttttaattgggaagaagaagcatgatggaaagcatactgagcacctggagtattggtgctgatgaccattttttctctgtgtgcctttgaacaaatcacttaaacttggagttgtcttttccctctacatgaaatgagcgaatgatgagataatctctaaggtcccttacagctctgacttgagctttcataagatactaagagctctttttttattttgttgttattcttaaattaacttcatgtttgcactgaaatcaagctagaagtcatttgtatgtatttctgcaaactgcattctatagcttgatgcatttgtgagtggctgttttggcactaaatcacacctctgaattttcactctcttatattggatggaacagttatgcaagattaaaatgttcagtcatttaactgaacatgtgtggcagcatttgttcactccatttcatccatccaaaggccactttgatttatttcatttcctatgtcacttagaccttctgtctataaataaatatttaaatcacactttagattttagaaaatgttgagctatttgttacacaacttgtgcatattaactcttctataatacatcttttaacaacatagtttcacatttagaatttctaattacattgtattttaaattatgtcttgatatgtgagtaggacgcttgatggtttgctttgtaaaatgctctaatgtaagagcttattgagaaggaagccagtgatttaataaaactcatttgaaagcctgcatcatttaaaaaatagcaagatacggtttatgaattttaggtaaacgtaacatggtgatttatctatcttgtccaatactttcagtaaacagtatacttgttataaggaacagtatgtcataatttttggtataatctcttagtaaatttcttgatgtctaatagaaatatttaatttcagattaaataatggaagtatggctcttataattgcccgaaacacttctcggccagaatttataaaacacctgaaaagatatgccagtgtaaaaaatcaggtatagtaaattctttttgttacttatttgcaaagctattaatcatgtagaaaaagatgctgcaagaattgacatcgaatcctgcctcataagaaggttttattttcttctgaatatattaatcttctttttcccaatctatttcatccaaattttgaaaagcatccgccaggattaatatagattggccttttttgaatgatgaattagtggttatgtatctgtaaccacaaagataaaataggaaatgtagtgttatattgcaatgtgaaataaattaaggataaaattccatactcaggctgttcttcagaatgaaaagaagtgaaatttgagagtttagccttcttgatattatggcagcagactttctaaagttatgatctttagatcttcctgacatttgtttgcatatctgcattgattgaaatagatctgtagatatgtatttaaaaatatgacagttttatacaaatattcattcaaaatgagaatatgtgaagatatacatttccacttaagtgatttgctttaaagagaaacagtaactattacaagccatattattttggcagctgttttgacctgattattaggaaaatgatccttgaactatgtgaatttctgaaattgtgagtctttgaagtacataggtatggttgtaaaaccctatagtttcacactttttctttttctttctttttttttttttttttgagttagagccttgctgtgtcacccaggctggagtgcagtggcgtgatgtctgctcactgcaacctccacctcccacgttcaagcgattctcctgcctcagcctcccgagtaggtgggattacaggctcacacctccatgcccagctaatttttatatttttggtagagacagggtttcaccatgttggtcaggctggtctcgaaactcctgacctcgtgatgtgtccacctcggcctcccaaagtgctgggattacaggcgtgagccaccacgtccggcccacacattcttaaaggtataaaatggtgcttggatagagttgggagataacagacgggaggaggaggagagtaaacccagccaatgactggcagctgaaccttgcttatgtaccttagccatagcaagtctctccatttttgcctcattatattttaaaactttcttaggccatcttcatgaagtttgatctgtcagtaacattatttgatcctcatgtattgaacaactaactgggctgcttaggaacttaaatcataaaaaattacagtcccactttctttatatgtcaaagtagatcagcaggtataatgtaggttgtgagcctacataacagttttatgtatgtgtttgggtggaatatggagatttattgattttcaaaggaatatatgccctttcacattttaataaatttctaaacattaaaaccaatttttaaaaaacccaaagcactatatattcattgctgtttttaagtcagaaaatagaaacaagaaaatgattttaaagcactcaaaattccatgttcctcaagattagtgtcattaccttggtagaattttttccgaatccttttttattaaataaatgagaagtaaagtaagtattaacctcattcatgtacctctatttgagaacttaaatagtattaacctattaatgtacccctgagaagttctgtatttattttggggaggtgtatgttgcacaaattgtttatggaaggtctcttttgaaattgcctatggggcaagtctctcaggcaatttttgtaaacattcttcttcttcatttttttaaatcaatatacctttcttctgattttaaaagcaatggttaccttacacataaagacagacatacagaaaataataaaaatctgtatcgataggaagacgttttctaagagataatattatgcaggatttatcatattttctcatgtactctacgaggcatatcttgcttttgacacaagaaacagttgcctgtgtgtgattcactggccttaactctgatttatttatcaactttcaaaaattaaaatccatgctattttttttttttttgcaaagaattctaaaatattttgcatagtgtatatagtaagaaagattgattcccagggtgactgctttcaagcaatgttaatttgatttgttaattatccacacaggtgtgtttatttaggctctttccttcatggtgacattaaaaatgtgaatttatataaattttgtaagattatgaaaatcagatctatgtaaaaatcatgtctactgcataattcatagcagtgctggtattcaggaaggaaaatgtggcaattcagtttaaggagagtaacatctgcttctctgaaccatttttaccaggttgaataagcgaatgttactgtataacactgtaaaatagattgaaaccaccatgtgcggagtggctcctgttccttccccatctctgtgtaaaattagatagaggctgaacactacccttcaaagtccttgcagctccatcctattgctttgccccccttctcactgtccacacttttctctttcattgtgaccatttttggtagggagtttaaaaccttaaatgtgagtgcttcccccaggatttctttgcagccctctcatcttctcaggatgccgtctcctggatggcctcattgcccctcacttttgaactgtctgaacatcatgcactcccaagggttctgtcatctcgtcttatctgcaggacctctgtcttcttgtatgctgaagaggttctgaaattcaccggcatctggaggccaacatgtctacagccgaccttatcttttcccctaaagttgttccttctgcgttgctctgtgcgggtcaatggcaccactttctacccatccaggttaccctgaactgttccttcttcctcattcctcactaccagtcccctaacttgttctgttggtctcctcttaaatgtttctaaaatttctccctcaccttaattcaaactttaatcctttcttgcttacagtagcctccttttggccttcaggttctctggtcttgtcttccatacctctttttagagaaacttttttctaagacacacattggatttctctcctgcttaattcttcagtgcctttctcttgttgtcagaataatatggaatatcctcagtctggaacacgtggcctttgtatccaggtccctgcctgtgttgcaaccccacctcttattaccaccctccaccacattcccagtgttttggcattttattcgttggctaaggttgccataacaaataccacagaaaagatggcttaaacaaacagaaatgtatttctttcatggttctggaggctagagctgcaagacaatgtcagcaggtttggtttgtcctgagtcttctctctctggctggcacatggctgctttctcacagcacccacaagtgagtggtctttcctctgttcatccccgatgccttttcctatgtccaaatttcctcttcttataaggacaccagtcgtattggatgagggcctaaagacatcattttagcttaatcgtctctttaaagatcttatctccaaatatagttatgttctgaggtatacagagcgaggatttcaatacaggaatttgagggccaaggggcatgatgttgagcacctaggagtcacactgaattctgtgtagttgcttgaccatggtttgcctctagttttgtaaatgcttcctctctccagactttcttctccaggctaaatcttatatgttctttaaggctcaattcaaatgggaagctttcccaacatccatagcctgtttgcctcctcttgtttcctctgttgaactccacacttgcaccatcatggcactcccctgtatcaaaattgtaactgtttacttctcctccccgtgccccaaacataccctcacacaggatactaagctcttggctcccgaaagtcccacttaacagcgtctgtggcttcacagttaaagcatttgaaggatggctagatcttcattttgtgaggagtgcacatgacaactgctgatttaagataatagacttactggtggtggctgtcaattcttgacattccttggcttacagctgcatccctccagtctctgactctgccatccttggcattcttctctcataaggacatcagtcatattggattaggtcccgccctaatgacttcatcttaagttgattctacctgcaaagaccctatttctaaacaggggacattcacaggtaccaggggttaggacttgaacatagttggggtggtggagggaaatataatttagatcataacaggcagttgtgtgttttaaatgaattatcaactaacatgaatgattatgtagataattctacaaggatgaggcatgtagccaaggctttatacccgaggtaggaggtctaacgcagttactgtcaaacagttttgcttggggccctctaattctgtacctcagtcacaacagctgatgccatcatatcatctactgtttaactgtgtttacagtataaactggaaagttggctggaccttggtatctacatatgtaaaatatgggtgttggggaaaatattagttttctgtcaacttttaaaactgtttcattgaggtttacatgtggaaaaggggaaaaactatgtagatgatgtttaattaggaatgtatctcatgtcatttttctgaaaactgaaatgagtagttatacatttctgctcaagttatttggctatattttcttaattatgtcagaaaatacatagtgctttttcagtatagtttccttaggcaaacaagaaaaaacgcaagttgaagtttaccttgcaccattctatagtggtaagtaaacagtgatcttgcagcttgtgtccattgttaaagtgggaatggggcaggcaaacaccttttaaaatccatatttgattggctttctcttttaaaagaagacatacatcccattttatcttcagaagtttagacttgcgttcttccaaattaaattccaagtgtgaaacttgtactagtttgctttatgtcagctaaactaattgacaagttgataatggattatatgtcttctgtatctacaggccagtattaaagattatctttaattgaaaaatctacagtatcactattttatgtaacttctcacagatatgtactatttgtcataaaacaagatttctaggtgctagatctaaaagaacccaaaaggctttggataagagattccttcttccaaaaaaacttggagatccctgttcatagtctcaaagctattaaaatgtcagcatacatgctgatatttacttgtgagagagggctcagtgaactttgattcgcgttagtagctagagataaaccaagtataatgattatttgtatttatttttagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattaggtaagtctatttatttcaccgcttattgtcaaccagtaaacataaatctaatattacaacgaaagctctcttctctgaactatcaaagcaggcagttggttagtttttaaaaaatcagtaaatcagggaagcataaagagacatgcacaaatttcaataaataaaaagcaactttacatttattcaactgttatgtagacccaaggcattttctttggttatgcgtgtctacattggctttctaatttattgttgtgcataaactacagataatgtctacaacttccattttggatttttaaaaatggatcaagatcttaaatcttttagtggagccatctgaatagtaaagtgttagatttttatccttccatcttagtttcctctcactcataattactgtaacatgttttgttcagtaatttgcttttattaggcctttacagagcattcaacttcccttgggaacaattttacatagcaactggtataaacaggtttaggaacctgcaaacgcattcttggtaggcattgtgacactcagtggttagaagaagcatgcaggggtgcccactagacatgggtgttctagaggcataactgactgttttacagaggtaatggagagcattggacaatcaaggaagtcagttaaggaggttttagagcaattattgttgttgatgatttatcaatcagaccttctcagttttctagattacagctctgttgggaatgctgtgtttgttatcaatttgtatttggcattggcattgtgtaccatacttattaggtgtatgtgaaaaacaacaaaataagttgatgaaataatgtattttctttacagattgcatccaagacttatcagtctttatggaggaagcatggaagaaatgattccaaagtaacatgtaattgtttctaaaagaaatgtacaaactagaattttaatataaagaaatgtggccatgctttaaacctgtggtccccaccctttttgggaccagtttcatggaagacaatttttccgtggatgggggaatggtttcaggatgaactgttccacctcagatcatcaggcattagattctcttgaggaacatggcactctagatccctcacataccagttcaccatatggttcgcacttctatgagaatctaatgctgctgctgatctgacagggggaggaactcagtaatgctccattgctctaacctcctgctgtgtggccaaacggatatcctaatagaaattgatgttactaacaattagcctctagggctttaaaagtcaagatgaaatatcaattcaaattctgtttttagatatcaattcaaattcttttttttacaatgtgtttattggacacacaaaaaaactttgcaaccatcataatacatcaatatttaacctagataattctgaaataatttggattctttcatttttcaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttcttaaagtggtagggttttaaaattcatgatacaagtaacaaagtaagttgataacaaatactattttgaactgggcaaaatctagcccaatatgtaattgtgttccccttgtatctgagaggcctgtgttggacaaccatagtactctgctttcactgtgctcagataacctgaaatatatagttgtttctgagtagttctgagtaggaaagaaccaaatgtaaatttccttagagaccatcctggagaagacagttctaaatcggggcttgatttttcatctatgatcctagatgttctcctgaaagaatgactagcctttttataacgatacaaagttttttaaaaatacataaatgtcataaagtttattcctgtgtatacacactctgggttcaggaggttttgtgcttacatttcactactcaaatgccttcgcaaatctcagaacattcctcaccatcactgcaggcctgtgaacagataactttcatcaattaggatggctggctagtggcagggacttcatataaagaaatctttcccagaattgtttttccacattgccttctaatttgatcactccctataacagatgttcaaaattcggccacagctctcttatgaaggcagagtcagataaaatgatattctgcaattatctagatcataagcataaaataaatattacaaaaatgattgtatttaaagaaattttttaaaatccagaaagtcatttaaaatagaacctcatatagtatgaacaaactataaaaatattttacatttca

SEQ ID NO: 20 - DNA, 145347 bp, Homo sapiens
  mutation 13541: c/g SNP in forward strand
attgctatttgggcaacaatatggctccttcagaactggtcgagaatttctgtggtctttgcttgaccttcaagttgggagtttcaaatcagaggctttgaagtctggaggagttcgcagccattaatccttccggggttgtgctaaaggcgtttctagaaagagatcggaaagacccgttcagcacaggcccattgcatcttctctttgaaaacgcttgtctgaatcaagtatcttatacagacccgagactgaggggagcaagagcgcaggtccggctgtggcgaggtgtccaccaccgtacttgtggtcaatgcctggactagagagccgaggccgtccagggcgggctggccagggaaccagaagcgtccctggactggctgagtgagggtgccctttccagcaacccagtggccatggttaaaaggcagaatacaaccgtcaaagaagtccccagctcccacataagagagcgcaaaggccaatggaaccaaggcctcctcgcgagaactagctcgctttgaggacaagatcctggggatggaggtggggactgacgtagtgagagggtctggaggaacagtcgtagctgaaggtcaggacatgaagaattgcacgtatggtagggatagaatggcaggtacaacttttctgtactgaaggaactgggagaggacgatccggttagggaggttggggaactaatctcaacgctgcgtttacagatgaagccgcttttatatggcgtatatgtttgcttagaggggccgacggagattaggagaagccatcctttggcgccaatgatcaaagcgtctgccaaggagaagaagccaagggatgggcctttcagagagggcaaggagtcatgctgctctggatgccagtgtcaggacaagaaatcgaaaggagcgaggactcttcactgcgtgcctcagtctccccgcttctgcctctttcacctctgtcctacttccggcgcgaaagcaggccactcgctctgatctagacctagttaacattagcttttcccttccttccctcaaatcccctcccccctctatccccgtcccttctgccgcctgaaagggttaatctctcctgcgggtaaaaacaggtccgcggagtctctaactggcgacagatgggccactttcttctggccacaaaggggccggaatggagcgctccgcggcatacaaatgggcaggtcacgtggttccaggctcttggctggaccgggaagaccatatggcgcatgccggggaggaaggaggaggggcgggggtaggggtggagggtgaggggagcggttgtcggaggagggcgggagacgagcaaggcgtggggagaagtggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaaggtaattacagttctttcatttttttgccccagaatagaagcaataactgaagactgatgaacctacatattctgtatgtgtgcgtttgcgagagtgtgtatgtgtattgagaccagcatccccctccataattgcccataagtactcacacataatgagtcgtgtcactcaagtaccccctgcaggctttctaatttaaattttaaaaatttgggtttcttttgtggatagcataggagcttcttggattttttaaaagaatgcacggtaactatgattatctgctagtgctgattttaaagtcccaaaagcaataatgacttcactttctcacttcttacagtaagaaaaaaaaatctatgttatcaatatatattttgtgtgcatgtattttacgcacattgggagtgtcaagctgtgttttcagtgaatgaaagggacatggataccttgagtattcacaccatggaaaataaatcaggttcagagatagtttagttgagaggggggaaagtggagaaagggagagggactcactcctgctacctgttaccgctccagaggcggccaagtccccagcagccactactggagccagaaattcagttgttttactaaaggctttttattttccttactagaagcggcaacttcgcggttgccaatcgctgaccattataattactcaatcttttaaagggaggtttgaggcgaactttgaaaagccccaataaagagcgggcggccctttcaatgggctgtttattagagaggagccttccgcacctgatccccggcgcgtgggagagcgctctgcgccgcgcccccagccctcgccctgcagctagcgcttttgtacaaggtggaaatttagcggtgggccagagatggaaggcaagaaaagaaaggcgagggaggggtggaagaccctgtccacttttgttgccaaatgttacattgatggtgaaacaatttggtggaaactatttttcctcctttctgcatttgcttttcagtatcccgtcgatgtaatcttcttaaaaatcgctgccagtattagtaaattacgcaatggctgttcaacttaaatcgctaagtatctggaagccaggacagaaatggaagtagaatgtgtgattttacagcttttttttttttttatggagttgtgagtaactttgaacacatttggataaacatgaagtcgctgaaatgtacagtcatttccacacacattatcctgtcgggcaaccaccataaacacatttaagttaatcactaggatacaaacacatatgcgtgagtggtgtacacatatacatattcactaccctcccccagtcctgtcctcactcctacgtactagcggggcacacgcacgcgccattataaaacactgcatttaactttttctcagaggcattcattttgtaatgggcaggtacttttcgcaagcatttgtacaggtttagggagtggaagctgaaggcgtatctggcttttgaatatagcgtttttctgcttttctttctgtttgcctctcccttgttgaatgtaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaaaccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtgagagcaattgttgcatttcttcttaaagggattctgtttttatttttggggaaagtagttgcttttttgctgagttaaaaaatactaaacactatatgtagaataaaagaaaagaaaaaagtttaccttggcatatgctcttgtctgtttatcttgcacagggagtcaccagttctatgtagataatgaaaagacctaactgatatttcattatttggaatatgggactggacggcagtacaaacagtgtgtttttttctttgttttaagtggcttagcctttaggttttttatttccatttttaaaaatgattgttacatgttttcttctatttctttttttaaaaggtggattttaataattattaacaagcaagacataaacaagtatcctagcttagtttgtctatacatttaagatgtataaaacattactattttcttggtcttctgttatctgtacatttttctgaactaaacagttttatcttgcaaactagtactgtcccagaaaaatttatacacctttaggaagtaccaaagggaaatgagttaattaatttaaagaatccaagagaagtaacattttataattgttctattaacatcttgtgatgatttccatcatttttccaagaaaaagcataatggattatttgtactgaagaacacactatttgtactgtatttaggaaggtgtaattatttcctccccccaccctttggggcactattctgttgtttcatgaacacaactcactggaaaaacttatggatgattctgtctattgttaagtccacttcaaaaaaaaaaaaacagtttggcatttcttttcctctggatgtattgactgacagtcatgattcctagggaatatcattttggcacttgtgccctggctctactgtggtgctctgattactgtcattagtaactccattgtttctactctgattcgggtgccacattggatgactaccccccttcccaagcttgttcctttaatctccttctcattggtgatttaggggttccagaaagctgacctcatttagcaagctgctccagaaaaatgtgagtaatgtaatggacaggaacaattagccatactaataacattgccaatgaggctgcgtcaagctgtgacagaagcagtaaggaatacttcgacgttaaaaaaatgtttgagagcaatttaaaatatattattttaacatgttttctatcagccttcatcacatgacagaaatacttttaagttagtcccaactttatctaaaatgcagcaatctcattccaagtgaatcagagttgttattttggaatcaagctgttgctttctatatcctggattgttctcactgttcttactttaagagacataatactgatatgatacttgaatactaccagccttccagtgtaggaggtaatgaagtgagcattcagatctgatctaacctattaagtagctcaatttcacctgcaattaaaattagacatcttcatgcaaactaaaatctgttgctgtagtgaagagaagaaataaaagaatgccattttgagaattccagcttccaaaatagcaaacagggaaatctagactgtgttcttttgtaaggtagaaatgaagactaaaagttaggttttttttttttttcttcccattttgccaatacaacttcattctaaaacatagggattctttcagtcagtcaaggagtaactcacatgccaccatcttttattcaaaggcaggcacagatgttccttctgcaggggaggatttaatttatgaaaatgatattgtttatgcatgaatgaactgcatgcactctgcataacacatagcacttccatctgatcagagaaataccacagaaccagtgccaatgtcagaaacatattctacaaatttactcacttaaatgtttaatgaatatttggaaggcattttcaaaccataagaaacattttaaattatcttcttttatgaattcctacccatatttaaaagagactcttacagtttttgtaattggctaatgcttatacccagtttgtaagaaaagaacatattttactaaatgaaaaccaaccaaaaaaaaatgctggcaagtttggcttcactggaaaaaatatttcgtttagttttgctgtttaatgcttgtcatgaataatatttgggattctatctgtttcttcatcttgagccacgactattcctatcaaataagatgcttaggtatacttgtttaatgtgaaaatcctatgaatagttatttctagaaaaagctggtatgtaaaatcagggggaaatttcataaagatgaaattgggctaaatattgtaacatgcataattactattgaataggaacacttcacataacatattttactttatataaccaattgcagctatatagtatgatctatctacttttaatcattaaaacaattatatataaattaaaatgaaagattataatatcaagagtgttctactaattttaggtttataatatgttacagtaaaataccatttgaaataaattttgtgttctaatttatcttaaaatctctctgtttttacatttgaaagtccttacattcttacaaaattaatgcattttctgaaagaagctagcaattactaaaatgatatatggatcattagctaacagtttgaatcaagctgttttagttctataattatacaagaaatttaaagtgaaaatacctattaagcaattaataaaactaggtttcaaaatattggctaattttctcctaatgggaaatgtaaaatagcaaaactgcttcttaaactacacaaaaacctcctcacttctccttttctctctctctaacaccacttatttcctgaaaatcatctaaataaaatatttaattccagggtctgatgaagaataaaagagccaatgcaacatcttgtggaacaccaggactgagaactcttgttgttaccattgcaaagaggcgttctggcgtcagatgcacagtgatttgtatggtggcataatcattggctcctggccaggcattatgtttcagaggacactattgtcaagaaccattcaactagaaatctgcactgtatgcactcaaaagttgagatcatctgccttcctatgacaggaagaattctgtgctggcaattgactcatggactctcttcacatacactaaggcttggtccagtggctctgatggaattaactgtgcagccaaactagtggcattgacaagacagggccacagtctctggggacttcaggagaaattgctaattttaaaatgcagagtattatgttaatgctggattaaatcttcagatacattaaatgtggatttggccatctaagcattattatgttatttgcccagttaatttagaggtagatggatggtgacaataaccatctctacagatccacaattctaagagatggatccaattgtgaaatgatatggagagatagagtaagttcaatctagcatatatgaagtaatttggtaactgacttttcttttaacaagatcaaaagctaacctgctttacactttcatgtctaaggacagccaaccagagagatggcttcacacactagcccactgctaagtgcttttcattcactttcatatttcatcatcaaagcaccctcctgccttatttatagatggggaaacttcaggaagttgagatacctagatatttgcattcctgtcttcctttcttcattcaggtttttctttcattgccacttcctcaaagaagcttttactgattcccatttaaaatagcaactgacttcaactccaccaaaatcactgtattgcccctccctctttccagagcatttgcctatcaaatgttatcttatgtatttacttgtatagcttaattttaaactatctatctctaggtcttctgagcacctgagaaacagagacaaagttgtctcttctgtgtgttgctgttcctctggtgcttagaagacctagaggatcctcaataaatattaactttccaagggaactgaagagcactaatgtgatgctaaagcctgttgccttaaccactatgctataagtcaaatcagttgagaatggagaggaccacaaattattttcagtccagcaagtgttataaacattaattctataaaaagaaaacaattgaaactaatttcttattatattgcatggcaccaaactccccccacttcctttttgaggatcatgagttgtctgtcattgtttctttttattgatatcaattggttaaatataatctggaattggaataaaagaaaaactattataggctttttccagaccatgtatttcaatgcatattattttttcctttctgttcattattctttcagtaattgcacttgttctatttttagtgttatgtaaaattactgtagctcataatttctattttgaagggttcagtgtataaacttagcacatcaatactatctttttagtgttcgcgctcaatggtgtcagttaagagatcaccatcacttttggtgacgtcaatgaaggggtattgcaatgcttaagagaactgttaatccctttccactggtgtcactaacaattgtagtgcttgtttattcatagcaggtacgtgactaagtaatgttaacatcaaagcagaaagaggataatagagtgttctaaaaagaaaattcggtggttgggtgcagtggctcacacctgtaatcccagcacttttgagaggccaatgggggtggatagtttgagcctaggagttcaagaccagtctgggcaatatggtgaaacctcgtgtctacaaaaaatacaaaaactagtggtgcatgatggcatgcatctatagtcccagctactcgggaggctcaggtgggaggatcacctgagcctggggaggtcaaggctgcagtgagacgtgattgtaccactgtactccagcctgggtgacaaagtgagaccctgtctcaaaaaaaaaatgatttgagataacatcacttgtcattgtttgttaactgaataatctttattctagccagtgcctaaatacataataaatgatagtacaaatggatataaattataactaaacctaagtagtgatatttatcacaatatttctttactagaagaatttctttgttaatagaggcaaggctacttgtttagataccttaaaataacataagatttttggataaataaattaatgattctttgattctgactggcatattaaaaatattaagcgaagagatctttgcttcccaggttttattttttgtctaattaactactggtgcatttatattaaaacatattgtcaagggaaaacgtatatatatatatgtgtatatatggtgtgtgtgtgtgtgtgtgtgtgtgtgtgtgcacacatatgctatacttggttgagtagtatccccttcccttgcccacctctctcccaaatttatgtccatccagaacctcaaaatgtggcctcatttgaaatattgtctttccagatttaattaagatataagatgtaaattgatacaagttcatgctggattacggtgggccctaaatccaatcactgatgtcctgataagaagcagacagaacacacagacacacagcatacaggaagaatggcatgtgaaggcaaagacagagactggagtgatgtgtctacaaatcaaggggccccaaggatttggggcccacatcagaagctgggaaagagacaggaattctcagcttctccttctgaatccctaagaaggaatcaaccctgctgacaccttgattttaaacttcttgtctccagaactgtaatataatacatttctgttgtcttaagctacccagttgctggtgatttgttatggcagccctaggaaactgataggtatactaaaatctctaatgaattgatgttaaatatatataagtataggagagttcatttaaattcttctgaaaatgtcttcttaaacttttaatgatacagtatataacaaccagtatacgtagttggtatcgggtttgacatttaaacaagctgacaaaaaacagctgtttaataaacatctgaattatataaaagttttattgtttattattcatgtgaatgacttaaactgacatctacatttagtgaagtgtgaatgggcctagccaataaactatgggtaatttttttaaagtctcatctttgaactcacaaaaaattatcaaatatcagctattatgtattcttcatgtgaagaaaatgtcatatttatttgatttgtggattagcatatatattaatagagcttttgaaagaacaaatgtagcactttcccgatttcatagacactcatttaacacacaagttcatattttaaagtacataattttaaaaaaattctagtccaaatgaatttaagtgccatgacttctaaaaattctgtctctatttttgggttttataggaccttgagccagtactcttctggtgagcttaagaggctaagacttcacctttagttatatggggctttcatctgattatttgtctattttgattgctctaaatacaagttagtgtgtatttcatctgaatgtatttcattataagttttggttttatgtagatctggggatctgtcttgtttttaatcttgattggtctgtttgttttgggatagttggtactttcatttcttatgcttgctttctttttcattttgtgcccacctttagtcaggtgaacatcagtaaggaataaaattttatttttttaagccactgaaaaaatttaaaaaccacatcataactctgcctctgctgactgataaaaatgctaacttattaagacaaaatgttatgcaagaagactttattggaatagagaaacatcctttttatgtaagaaatatcaacagagacatgtgcctttcttgtgacaaatgtggtatgtgtgtggattagaggtctggaatgtggcagcatttcagtacttggaggggagaattagagtagggtagaaagatagacggggagcagaggatgattctcacccagtagaaagcagagtgaagaaagaaaggggaattgttttttgcattatattatttgaactgtggattaagtctttccataagccatccctacgcctctaagtaggttttattaacttaagctggtttgagatgggtttttggtcacacacaagaattgcctgatacaagagaggctttgattttgttgttgcttgctcatttttatacactaagatggagaaaaccctggacatagtgaagacgaaattgaggaaggtgttgggtagagtggagggtagaagacctgtaacataggtacagaattacattaaactggaaggacttatatccagatataggagtcagggtagaaagagagaatgttagcagtaagggtaacagagtagcagaagtttattcttaccaggtcctgttatgtgacagtggaggcatgttgaccttctgactaggggagttaaaggagaacactgaaggtttagaataatgtctctaaggatagaaagagaaagtttcatcaagactcatcaataatagggcagcagggcttagggccaagcaaattcagagaccatgatattatagtagtttgtagtggtcttaatccatctaatttttcagcattttctcaatggccaatacttagcagtggtagtgttttatggcatttggacaacagaagtgaaagcactggtaagagagacgttgaagtgaaacaccatggggctcagaaaagcagagttgatccatctggtacatgggcaaggatggtcctgaacaattctgcagtaagttggaagatagaaaaaatacctaacgaacttgtagatctgggtaaggagatttttggcagaatattgtaaggctaattggcttctcttaastatatgagatagggttttacaagggagagataagcgagcataatttagaagaactatagggggtcccaggcagactctctggctggaaaattattctgatagcaagaaattagccccaaagcaaagatgaaaagtagggtacttccaattaaacatgtcataagggcaagcctcaatcaagagtgtggctagaaggcacagctcacctggacaaaagtgcttctaagcatattaggagcatataccacaataacctgacttggacccaaagttgagagaggccagtctcaaaaaaatttgagggaattgcttttgcataatatgatactttatatacatatctgttacatatcatatatatcatattaaaaagaaaaaaaaccctgtttttccttccgttctttcatataacccttctgacaacaaatgtggagtttttcacacactaagcaattctttagttcttgctggacacttcctggatgtcctacaattcaactcgattctcacacaactgcccagagtcagtgcagacccgcagattaaaggcttagccccaaaagactaccccccactttagatgtcaatcacaagtctcaacttcatttacttctgaaggacgagctatacattggaggaaacccctctttctttcaataatttgctagaatggctcacaaaactctgggaaacatttacttatggttaccaatttattataaaggatataactcagaaacagccaaatggaatagattcatagggtgaaaaatgggggagaggcatggagcacaactctctcagcacctccatgtgttcaccaacccagaagctctcagaactccttcatttagggcttttatggagctttatcaagtaggaatgattcatgaaatactggcattggtgattaacttaacctccagcccctttcccctccctcaacattgggggtgaagctaaaagttccaactctgtaatcacagggtgagcttccctggcaactagtcccctgatccttagggggcttctgaaagtcacctcattatcataaactcaggtgtggttgaaagggatgttttgaataacaaaagatgcgcctttttcctttatctttctgagttgtttcaggagctagggacaaaagactaatactataacaacaacaacaaaaaattcaatttttgcttttatctcttgggaattacaaggattttaggagctctgtccagaagccagtgatgaagatcaaaatacatatttcttattatatcacaattcacacatgtacatgatatccgtaagataagtgaactacataaagtaagctcacaaagtttctgtaggagttttgtccatttacaaacagtttgtaagctaaaagtatctgtgacaagcctcagtcaatttagaagttcatttttccaatgttaaggacatgcctgtgacacagcctcagaaggtcctgatgacatgtgcccaaggtgatcaggctacagcttggctttatacatttagggagacataagacatcaatcgatacatgtaagatgaatattagctcagtccagagaagcaggactactgaaagtggaggcttgcaggtcacaggcagattcaaaggttttctgattgggaattggttgagttattatcttaagacctggaattaataaaagggaatttatcatgcagatgaagctttaggtagcaggcttcagagacattagattgtaaaggtttcttatcagacttaaaagagtctgttctaacagtctttaggtctcagtgttgatgttaatgctggtcagctgtgcctgaattccaaaagggaggagagtataatgaggcatgtctgagtcccttttcccatcatggcatgaactagtttttcaggttaactttggaatgtccttggctgagaggaggggtccattgagatggttgggtggcttggaattttatgtttggtttacaagtttaacattaaaagcctctgtacctccaatgttttatggacaaaaagaaggctgaaaaagctacttggctgtaatcatgggccatttcttgctgaaaagaagaataaaatggaggcagaaccaaaagcccagaggctagagccaagagctgctgagaatgatgaattagggaaccactctcagagagcagatctggatgtgagataggaacattttctttctcagggtctatgaaactggcaacatatgctctcctgaatttcagaattgctatggaccagtgactgtgatatgctttctatatttttcccttttgaatgggtgcatctatcttgattatcctctgtctcattattgtatgttggatttgtgtgggacgataacatgtgtttttagttcctaggttcccagaataagaggagcacactcaaagagcgacatttatgagatactggatttttcacttgatatcataattgggtgagacttgaaagaaagtgaacatattttgcaaatgggagggatgttaaccactgacaaccacacccacagggtccactgtattagcctatctgcaaagacggctgccaaaaattccttctgtccatatatacattcccttttttaatgtgactgtttcacctgccagcaactgaagggctttatttccatttccccttgtgacttgtttgactaacagcaagaagcaaaagtaatgctattccaattctagacctgggccttaagaggcatgacagcttctgcttttactctcttgaaactcaatgtcattttttaaaagctcaggctagactactcatcatgagggaccacatgaaaagagataggcccagctagtttccacccattccagccgctccagatgagatgccagacatgcaaatgaagccatcttggatatttcagccccagctgagcttccagctaaatgtaagtacattcagttgatacctcatagagcggaactactgagctgacttcatccaactcacagaatcataatgaataacaaatcattgttgctttaagtcaatacatttaaagtttttttgttatccagttgtagatgaattatacagcctggggggaaaaaggagatagcacactgttagttgcctcatcaatattcatccccaaattctttttcctttttagtaggtctcacctcccacctggaagctgaaaacacctttcccagtctctctggaagctacagcacaggcatgttgcccaattctaaacaataggacatgataggaggtctgctgggtgggatttttgaaaatatttttttttctggttaagaaaaaagaaatgcccaaggaaaacctacaaatgccccttccattcttgcttttggacattttttgggagagggtatgatgcttagcactcctgcagccatctcggggccaacaatagaatccttgttgctacctggtgatagtgaagtagaaagctacaaagctcttgatttcttttcttttttttttttttttaaattttattattatactttaagttttagggtacatgtgcacattgtgcaggttagttacatatgtatacatgtgctatgctggtgcgctgcacccactaactcgtcgtctagcattaggtatatctcctaatgctatccctcccccctccccccaccccacaacagtccccagagtgtgatgttccccttcctgtgtccatgtgatctcattgttcaattcccacctatgagtgagaatatgcagtgtttggttttttgttcttgtgatagtttactgagaatgatgatttccaatttcatccatgtccctacaagggacatgaactcatcattttttatggctgcatagtattccatgctgtatatgtgccacattttcttaatccagtctatcattgttggacatttgggttggttccaagtctttgctattgtgaatagtgccgcaataaacatacgtgtgcatgcgtctttatagcagcatgatttatagtcctttgggtatatacccagtgatgggatggctgggtcaaatggtatttctacttctagatccctgaggaatcgccacactgacttccacaatggttgaactagttcacagtccaacagtgtaaaagtgttcctatttctccacatcctctccagcacctgttgtttcctcactttttaatgattgccattctaactggtgtgagatggtatctcattgtggttttgatttgcatttctctgatggtcagtggtgatgagcattttttcatgtgttttttgactgcataaatgtcttcttttgagaagtgtctgttcatgtcctttgcccactttttgatggggttgttttttttttcttgtaaatttgtttgagttcattgtagattctggatattagccctttgtcagatgagtaggttgcaaaaattttctcccatgctcgtgggtaggaagaatcaatatcgtgaaaatggccatactgcccaaggtaatttacagattcaatgccatccccatcaagctaccaatgactttcttcacagaattggaaaaaactactttaaaattcatatggaaccaaaaaagagcccgcatcgccaagtcaatcctaagccaaaagaacaaagcttggaggcatcacactacctgacttcaaactatactacaaggcttcagtaaccaaaacagcatggtactggtaccaaaacagagatatagatcaatggaacacagcagagccctcagaaataacgccgcatatctacaactatctgatctttgacaaacctgagaaaaacaagcaatggggaaaggattccctatttaataaatggtgctgggaaaactggttagccatatgtagaaagctgaaactggatcccttccttacaccttatacaaaaatcaattcaagatggattaaagacttaaacgttagacctaaaaccataaaaaccctagaagaaaacctaggcaataccattcaggacataggcatgggcaaggacttcatgtctaaaacacgaaaagcaatggcaacaaaagacaaaattgacaaatgggatctaattaaactaaagagcttctgtacggcaaaagaaactaccatcagagtgaacaggcaacctacaaaagctcttgatttctaatgacatcatatgggatgaaccaacccaggaacagcctgactctggacctcttttaatgtcagaaataaaatcttatttgtaaaccactcttagttgttcaggttgttgacacaggcactgaagtgcctccaaatggtgatgaataatgaggcaaaagtcaaagacagcaagtctagtgtcaaattttttgatgcctatgggtaagaagttcaagaaagtgagctattttctttctttttaaaatttatttttatttttgtgggtatatagatgtatacattagtcagctattttcaatagtgagaagggatgttgccacttagtataatgcctttttcatagctatcatagaaaccatatatacatatagtatagaaaatgaggatagatttctgacttaaactgcctatttcatttgtgtgcctggttacacctaattcaagactctacaatacagcattgctagcaattactgtgagaatatttcaagctccctatttgctggaaatacatttcatttttttgttccaagtttatgaatattagaacctatctaaaaaggagcttttaaaaacttgaggaaaggaaaagggagggcctacttttcttgcctgtgttatttcttgttactgctgattgagatgctagagatcatattgggtgagatgtgtcttagaatacagctgagcaattcacttttaacagtttccatctgagtacaaaaaactggtatgtgcagaaaacttgatattctgacttggcgggattctaggatttgttctatttttttctgtaattgttgtagggacatatggccctgtaccttttgggcagcaggagccagaatagcaggaacattctgacaaaattcccactcagcatgagagggaagcagtccccttgatacactgatgatgtgcccacttagcattacaagtgtttgagaggtggacacaactaaaactcacctcactcaaaatatatattgacacggagaaagtaaatacaatttgctgttattaacctttcttctcaccattgagacatgttaaatatctgaaattaataaaggaattaaatttaaaaagtttacttatcatgcatttaacacatttattgagcatctgttatataaatgcactgtttcaggcacaagagatagagccataaataagcagattaaatcactattctcaactgaggtactaatctgatataagagaggagacagaaataagtaaacattataaatcaactacatacttttacatggtgtaaagtgcaattaagaaaatattattgaatagaggtcaattttggaatggttgggcagggaagaccttctgaggtgacaagaagttggcctgggcaccatggggagctctaccatggtgaaaagtgttccagacagagtagacagcaacagcagaggccctaaatgagaatgcacttggcttatctggagagtagaatgaaggccagtgtggtaggacacatactaataataggagaaaactgatagaaaagagggtttgagcaggtgggcaggaattggacaacatggtgtctcatatgtcataatagaagtttggattttattctacctgcagtgagaagttcttaataaaaaaaaaattctataaactggagtttgagaaagaactatgttgatgatagcataagccctcaatcacttgtcacataaactccaaacttcagcagagactcagggagatcaaagggactaccacaggattacccactggctaaaattcagatccatggcagttggtcctgactggaattagacttccttgtctgttgccctcattgcagtgggtctgaatgtctctgtcggctgtgaatttttctccctctatctgtggcactgagaaggtggcccagacttccagagtctgtctcattggcctattacttggggatttgctgcccttcttctggaagtttgggtatttgttttcagagcatacttaaaggcctcctgaaagcaatgttaacaatagcaggatatattttacagtcttctactcagacttggatttttaagaaccagggatggagactgtgtttccagatctagtcaaatcccttccaaacataaagcaacaaagtgccttttaaactaggacctgtactgtttaatgctctggaaacaaatacccaagcttcagccaaaggagggaaagctatgttcaggaagcttcctgaaagttttttgaaagcaattttcatgcattagtattttacatatatatatatatatatatacacacacacacacacacacatatatataaacatatatatatatacacatgaatcactaatgagacaattgatcttcaggaactaacgtgaaataattggggtatcttggtattattgttatagataaatgttgaagaagttcattctttcagatattaattgagcacttactgtgtactaagaactgtgatagatactggggatttaatggtgaacaagataaattctctgccatcagggggcttatattctaacaaacttaaaatttactgagtgttctctgtatttcagtattgttactaagtacactaacttagtggggaagctagacaataaacaaagaagtatgtaataagaattaatagtaagtgctgtaaagaatactaaagcaggttatggtagagagattaatggcagcgtgaagatgtccatgtttcaatccccagaacctgtgaatatgttaccttacatagcaaaagaggctttgaaaacataattaagggttatctgggcaggcccaatgtaatcataagagtccttatctaagacgggggacaaaggtcaaagacagaggaaaagagacgatttaaggatagaagcaaagaggagagatgttagactgctggctttgaagttggaaaaagtgaacatgagccaaaacaaacaaaacagaacaaaacaaaatccacaggtgacctttagaaaaggggtccccagtctctgggccatggaccagtacctgtctgtggcctgtttggaaccaggctgcccagcaggcggtgagtggtgactggtggacaagcaagttttaccacctgagccctgtctcctgtcaggtcagtggcagcatcagattctcatagcagcctgaatcctactgtgaactgcacatgcaagggatctagtttgtgctccttatgagaatctaatgcctccaaaatgctcaccccttcaaactgcccccatccgtggaaaaactgtcttccacaaaaccagtccctggtgccaaaaaggttggggactgctgctctagaagccagaaaagaggagatatattttcctctagagcctacagaaggaatatataggcctgctggcaccttgattttagtcctgtgaaactgattttggatttctgacctccagaaatgtaaaacaatgcattggttttgtttcaagtcactaaatttgtggtaattagatacagcagcagtaagaaatgaatacacaggtttacaggatggtgaattatggagggtgctcaggaatggcctctttgaggtggtggcctttaaacagaaaaatgagcaaagtgaaagaatgaaccatctggtggggagaaaagcattccagtcagagggaacagcaaaagcgaatgctctgagaagggattattcttctcaatgtgtttgaggactggcaagaaggctttgtgtgaatgagcaaggggaaaaagttagtaggtgatctcggagacatagccagggtccagattataaaggacctctcgccttgctaagcattttgactttattccaagaataatgggaagtcaatggaaggctgtgagcagggttatatgctctcgttattttttaaaggcacaatgtaactccaaaatggaaaattggctctgggctggaggtgccagcacaggggaaaccgaaagcagagagctgggttgggagagcggagactgaagttgtccagctgaggggtgcagaagtgcagactgcaatgacagcaggcagaaaggactatatgttctagacagaatggacaggatttgctggtagattggattgaaggcatgagacaaaggagacatggatgatatcaaggattttgatactacagatttgaaacattctgagagggacaggtttgtgatggaaaatcatgagtctggttttagatatgttttagaagcttattggacagccaagtagagatgtcaggtagggagctggacataatacctaaagttcaggagagtggttggagctggtgacatcatttgcagaaccctggatggtacataaagcacgggacagtgtgtggatagatcctaaagagagccctagggcactccagccctggaagaaggcagcttatcaaaggaaaaagaaagaaagaaggaaacacaatccttattacttccatcttcaggacaattcaaagccagtgtttttgacttcctggcttgagtgaagcttgaaaaatggcaacttgcccctttgcaaagctcctaaggagtagccattggcttggcctgtttgcactggctctgggtgagcttttaaaatgccagtgagctctaattgtgttgattgcctaacagctgtgaatacaagatgctgactccagaactgcaactcattctgcgaagggcaccgtccttttccctctaatgactgctgaacagagccacctgaagcctgcatggggtttagcagcagctgcacttctgctctaagaaatagctcactgcagtcagatcaaactgaagctcttccttgcttttcctcgaagcttgggtacttattgtcggagcattaaacagtaagagtcctagcttaactggtgcacagtgctttatgtttggtagggatttggttaggcctacaaaccgtctgagctaagaaccttgagaaactcctgctatagttagctctttctgtgactctgcagtgtgaccaggaatgaggacagaattaagaatttgctgcctctatgatagaactgtttaggcactagaacactggaactagatctacaaccctatgaatttaatttccttttcaactcccctactccttcttttcaatatgatgataatgatcttgtttaaaaaaaaaaaaagccttctgctttacttcccactctgctcctcttcccagggactcactttcttcttgactgcttccccattacaagtactcagctccctgttttatcaccctgcttagagcagccattatcagccttggctgaacattggaattacctgggaacttttaaaaatccggaagtctgggtctcgcctccagagattccagcttagttgtcttgagcgtggcctggacatttgggttttcaaaagttccctatgtaactttaatgtgcaaccacaattgagaatcactagcctccagactctctgtgttatcaaaattaatgagcagctgattttagaaatctcagttatcaggagaaaagggtgaacccccccagggctcttctccttttccaggtgacacttctttatggcagtgcgtgaaagtgaagccctgctgcttgtaatctccctcaagggagtgcaagatccaggcaaagacaagactgcagaggcgctaccttgggggaaagtaggaccctaaatacttacacctggaggcacttacctttaatactgaatttgtcagatgcaaatttgtctatgcaaaccagggccttatctctagcttcccctcaggggttttgggaagtgcgctactactctgaaacagggttgtaaagcgtcacctgtgctctccagggaaccctctggaaaggaggtggaaaaacagaggcttccacccttgcaactctaagtgtgttccttggccagtgggatccatcacctagtattttcttagatatgtggtatctgggggccagtcccacacctatgcaataagaatctccatttgaacaagatgcccaagcgattatatgcaagtttaagattgaggagggctggtttaactcgagggtaacgaaaagtacgaaatcgtactttacaggagaagctaggcggagggagccacttattcttcctcttgcagctgggtctttttgtggtgagtggcgaagcggcgaggctggcaggccagggtgctggactgggtcaggcgcggccccgcctccctcctgggtccctgccctgcgcgccgttgctgtggcagcgctggacgcggctagagctggggctgccgcgccctccacctccttctccaaaggcctccccggacccctggctcgggcccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgagtgcccggccccaagcgtcttcgcctccctccgcgcttcctccctctccccggcccaaggcctacacccacgagcttttgctccaccctccccttttctcgcctcccctccccgtgctcgcctcactgcccggacaggttaccgagtccccaagtcgccgcctcctccttcccaactgggaactcacgcctctcgccccatcccagaacccccagggattctttcgctacctagccttttcccgcctccgagaccttccccgggcaaacgtcacaagcagcttttgctcagagtctcagcagaaaatcttgagccccaaaggggaggtaatttacaaatgtgagaaggtcaactactcctcccctccaagttgaaaaagttttaatccattaactttgatggtacattgaaactataaacatctcacagattatgcctacacaagagttctgaatccaactctcattttgctgacttgaaaatgtaactccagagctttgggagtgtttctgggtttttttctgcccctcaccttccttgccattgtctagaattaagacttcttcaggctcggtctagaaacttttgatttttaatattgaccctagattattggatcacagttttgcgatgcttagttacgtcaagcggtttgcttaacgtttgccttttattgacttaaaattttagttacctaaaaaagttataatgctgtagtttacaacaaatacttcgagtctattttcacgtcttagtcaaatagccttatagacttaacagatattttataaagaccattttgcaagtcttataagtagactttcatatagtcttatttctaagtccaaactcgagaaatactccccattgttgaattagcttagatgtgagcggtgaaagacagatgaaatgggggaggaactacatcaaggttactctacttgcgaggagatgacttgggggagatggaatttggtattcaacctcttttagctaaatacaaatttatgaaattaaaaaaattgccttcccctgttggaaaacaagacacagtgtggtatttatgttacagaatagactcactgtcttaaagtcttgctcaaaagtctaacaaaatgaaaccaactagccagggattcagcactggttgcgattgtgaattctgcctgtgctgcatgtgccatgctcgctcgcttcacgaaaacagtctttgaccttaaagtgttttcaggtgttttaaaaaccaaggtgtagtattttcttgaaccttttaagttaaaagctagggatatagctatggaattatttgtaagtctttcaggcaattcgagttatgcaatatagaagtttataattacagtttggattagcccaaagagccagtttaacctacagtgcagctgaaatgctatagaattaaaatgagacattgtgcaatgagaggtcatacaaaccaatgttgcagtatttgtgtacaaaaaaagcaaacaatgacatgagaaaagaaatgctgttttatattgagtggtgattaaggtaaaataggtttaattagtgcacccctggcagtagagtttaaaatacatcttgacagatttgtaactttaaaggttgcaagtactgattctttgtttaattatgccctaaaaccatttggtggtcttttccttcatacaggtgtaccctttttctttgtaattaatacctggtattcaaaccactttgggcctctaaaattgggggcacagaagcctagagccttagtaagtacttctgtttatggaagaaaccaagagatgttttatttaggtaaaatatagccaggcgtggtgtgtccctgtaatcccagctacttgggaggctgaggcaggtgaattgcttgaacctgggagttggaggttgctgtgagcggagatcacaccactgcactccagcctgggcaacaagagtgaatctccatctcaaaaagcacaacaaacaaacaaaaacaaacactgggaaataagaaggagatattaagagatgatatatttaaatgttagaaatgctctgttgttgaataagcttagatgtgagtggtaaaagattaaatggaagagggagctacatcaaagttactgtacttgggaggacatgatatggtaggatgtggtggggggagagcatgtccattgctggttggcaagtgactggctgcctcagaaaaggatgagggtgggtaggggagatcactggagattattagaacatacgtatgttttcaagattgcttagtttttaaacctcatagtactttgttttcactgatgaaataaaatactatgtgatctttttctaattttccatcttgagtaataagcaaagacattaatgtattttatgaaggctctgactgccaaaattgggacaaattgatggtcttgttggcagggtaaatgagcataaccgtagtaattgtagttctttttattgggttcagggatgacctggaataatggatgtgttattacccttccctgtagaagtgaggctttcgaaaagaggctataagtcaatttgggaggcacaaagtatcagcgctttttggggattttttttttttttaagtagagaaatattttaaatgtgtgatataaagttatgcatgtgcttcttaagcacattaactcaaccagatccaacagctggtctaataactttttaattgtttaaaaaaatttaattgacacattgtaattgtatatatttatgagatactatttgatgttttgatatttacgttgtacaattatccaatcaaagtagttagttatccttcacctcacactttcattatttccttgtgggttagaacattcaaaagactctcttctagttattttgtaatatatagtattttactgttaaccatagtcaccatactatgcaacaaaacaccagaatttattcttcctacctagttgtaactttgtgtcttttgactaacctctctccatccttccttctcccctccccttcccagtctctggtaactattctaatctctgccttatctatatcaaccttttataatagaaaaagattctacatgtgagtgacatgtggtatttgtctttctgtgtctgggttacttctcttaacacgatgtcctccaggcttagcattcacaattgacaggactttattttttaatggctgactagtattccattatgtttctgtatcacattttctttattcatccattgttgtacgcttaggttgattccatatcttggccattgtgaatagtgctgcagtaaatatgggattgcagatctcttcaacatactcattttatttcctttggatgcatacctggtagtgggattgctggatcatatgatacttctatttttaattgttttaggaacttccatgctgttttccatattgactgtactagtttacaatcataccaccggtgtgtaagtgttcccttttctccatatctgtgtcagtacttattttcttttgtctttttggcaatagccattctaactggagtgaggtgtatctaattgtggttttgatttgcatttccctgatgattagtgatgtcaagtatcttttaaatgcacctgttgatcatttatatgtcttcttttgagacctatcaattaaagtcgtttgcccatttaaaaaatcaagttggccaggcacagtggctcacgcctgtaatcccagcactttgggaggccgaggcgggcagatcacgaggtcagaagatcgagaccatcctagccaacatgatgaaaccccgtctgtactaaaaatacaaaaattagccgggtgtggtggcacatgcctgtagtcacagctacttgggaggctgaggcaggagaattgcttgaacccaggaggtggagattgcagtgagccgagatagtgccactgcactccagcctggtaacagagtgagacttcatctcaaaaaaaaaaaaaagtcattattattttatctgttgaattaattttcttatatattttggattttatccctttgtcgcatgtatagattgcaaatatttttctcccattctgcagctgttttcactttgttaatagttttcttcaaggtgcaaagttttttagtttgatgtaatcttattttgtctatgcttttgaggtcttattttaaaaatccttgctcaggtcagtgtcgagaataatttcccttttttcttgtaatttcatagttttcaagttttacattttaaatctttaatctatttttatttttgtatatggtgagagggaggggtttaatctcattcttctgcatgtgaatatctgattttcctagtaccatttgttgaagagactgtctttttcccagtgcatgttcttgacatcttaaaaattcagttggctgttgtaggtgcaaaaatttatttctgggctttccattttatttcatgggtctgtctggttttatgctagtaccatgctgtgttgatatagttttatcgtatatttcgaagtcaggtagtatgatacttccagttttgttctttttgctcagggttgctttggctatttggggttttttttgtggttctgcatgaattttcagattgtaacatttctgtaaagaatggtgttggtattctgatagcaattgcattaaatccatagatcactttgggtagtatggccattttaacaatataattatttcaatccatgaacatgtactatcttcccatttattgatgtgggaagataatttctttcatcaaagttttatacttttcagtgtagagattctttcacttccttggttgtttatttctaggtatctttttttttaaaaaagtactataaatggaattgttttcttgatttttcacatagtacaatattagtgtatagaaatgctactgatttttatatgttgattttgtgtcttgcaactttactgaattctaacagttcttttgtggagcattttgggttttctatctataagatcatatcttctgcaaacagggacagtttgacatgcttctttctaatttggatgctcgttacttctttctcttgcccagtttatctggctagaactttcagtagtatgttgaatagaaattgtgtaagtggccatcctttccttgttattgatcttagaattgatctcgttattggtcttttcccattcagtatgatgttagctgtggatttgtcatatgtggcctttgtgttgaagtacaaactttccatacctaatttgttgggtttttaatcatgaaattatgccacattttgtcaaaggcttttaatgcatctattaaaatgatcatacagtttttgtctttgttaatgtgtatcacatttactgctttgtgtatgttaaaccattcttgcatgcctctgatcccagtgatgaatcgcacttgaatgtagcaagttatctttctaatgtgctgttggatttggtttgctaatatcttgagaatttttgcacctatgttcatcagggatattgtactatagtttcctgtgttgtattgttatctgattttggaattagggtgatgcttgactcatgaaatgagtttggaagtattccctttgcttcagttttctgaaatattttgagaggaattgatattggtttgttaaatgtttggttgagttcagcagtgaagccattcgtttctgggcctttctttgatgaaagactttattactgattcaatttcctcacttattattggtctggtcagattttatgtcttcctaacttaatcttgataggttgtatgtgtcggggacttcgttttttctatgttatcaaatttgatgaaacttgttgaaaaccaactctaaattttgttcatcttttgaaattatttttagtctctatttcatttatttctcctctgagttgaattacttccttacttctaccaactttgggattagtttgttctgttcttttttttctttctttctttttttttgagatggagtttcgctcttgttgcccaggctggagtgcaatggtgtgatctcggctcaccgcaacctctgcctcctgggttcaagcaattctactgcctcagccttcctgagtagctgggattataggcatgtgccaccacacctagctaattttgtatttttagtagagacggggtttctccatgttggtcaggctggtctcgaactcccgacctcaggtgttctgcctgccgtggcctcccaaagtgctgggattacaggcatgagccacaatgcctggccgattagtttgttcttaattttgtagtgccttgaggttcatcattaggctgtttgtcagaaatctgttgtcttttttgatatgggcatttaatactataaacttacctcttaaaactgcttgtgctatgtttcgtaggttttgttatggtatattttcattctcacttgtctcaagaaaaattttaatttcctttttaatttcttcactgacccattggttgtttaggagcattttgtctccatgatttgtgaagttgtcagtttttctcattgttgatttctagtttatttcttttctttctccttccttctttccttccttccttccttccttccttccttccttccttccttccttccttcctccctccctccctccctccctccctccctcccttctgtattgctttgtctcccaggcccaagtgcagaggcacgatcttggcttactgcaatctctgcctcctgggctcaagcaatcctctcacctcagcctcccaagtagctgggactacaggtgtgtgtcactgtgcctacaggtgtgtgtcactgtgcctggttaaatttgttttttgtttttgtttgttttgttttgtatgtttagtagagatggctttcgccgttttgccatgttgcccaggctgttctcaaattgctgggctcaagcaacctgcccaccttggcttcccaaagtgctgggattacagccatgagccactgcacctggcctgatttctagtattataacgctgtggtcagtaaagatacttgatattatcttaatcttttaaaatttgttaagacttgttttgtggcctaacatgtgatctctcctcaagaatgttccatgtgcatttgagaagaatgtgtatctgcagctgttggacggaatgttctgtaagtgtctgctaggtgcatttggtctatggttcagcttaagtccaatatttcttgatctctctgtgtgtgtttgtgtatgtatgtctagataatttattcattattgaaagtgggctgttaaagtctcttactattattgtattggagtttatctctttaggttgaatatttgctgtatgtatctgggtacttaggtattaggtacatgtatgtttataattgttatatcctgttgttgaattgatccctttatcatattatgaccttctttgtctctttttacagtttttgacttaaagtctattttgtctgatatgagtattgctactcctgctcacttttggattctgattgcatggaatatctttttccatttcttcactttcagtctgtctttaacggtgaggtaagcctcttttaggcagcatgtagctgagttttttttccagtcctgcagctactttatatcttttcattagataatttatttacattcaaggtttttattgataagaacttatttctcccattttgttacttgttttctggttgtcttgtagattctcagttcttctttctctcttgtttacctctgtggtttggtcattttctgtggtcctaagctttgttttccttctatctcttgtttatgtatctgttgtaattgctttctttgtgggtaccatggggctaacataaaaagtcttgtagttataataaactattttaagctgatagcaagttaactttggtcacataaaaatactctagacttttttcctccgccatccctaatttatatttttgttgcctttatttctttagtatgtgttccctagccattgtagctgttgttgtttttgaccagttgtactttaaaccttcatctagaggatcgacaggtttacatagtaacatgatatcactggggaattctgagttggatttatacatttacctctattggtgaggtttatattctcacatgtgttcatgatagttatcattttttcatttacagctgtagcactcctgtaaacattgcttgtaaggctggtgtaggagtgaattccctcagcttttgtttgtctgggaaggcctttattctcctccaggatagttttgctggatatagtatcttttgtccttggccgagactcgtttttttttgttcttttagcatcttgaataaattatccctttctctcctggcatacatcagtaatttaatgttactgatgagaaatctactgatagtctaattaggattcccttacatgtaacttgatgcttttctcttgcagattttagaattctctgtcttcaacttttgacagtttgactataatgtgccacagagagaatctttttgggtttaatctaattgggaatctttgtggttccttcatctggatgtctatatctcccccaatatttgggaagtttttagctattatttcattaaataggttttctgtgcctttcttcaacttttctccatctgccagttctataatgcaaaaatttctttgcttagttttttttaaactttgggttatttcacaaaacctattttcagattttgaaattctttcttctgcttgatctggtctattcttgaagctctcgattgtgtcttttattcactgcattcttcagatttctgtgttttaaatgatagatcttgttttaatttctcattttataactttcctgatttcattgggttgtttgtattctcttgtagcctgctgaatttttttaagatcattatttttaattttgtttcaggcattttataaacacccttttctttggggtctgttactagagactcactgtgttcctttggcagtgtcgtgtgtccttgctttttcatgtttcttgtgacatctgcacatctagtggaatagtcacattttccagttgtatgcagtagctttcacagggagagacttttcctgtagatgggtcctagagtgttggttgggtatggtacattggctttggtttggggtggattcagtaccatggtctctgtgtagtttcgtcagctgtaatcttcacagcaatgtctgatttcctcagtggcctaggctgcaggagtttttgatggtggtatagttttgctagggacaggcatgtcatgctagttgtcaggctggacacttgcaggctcggagggctgacaagctgtcttttgggctccccagggaagagaaagtatgattttccagcttttcttctatgtttatttaaaactttgttgtctggctcacagtgttctttatctaaagtctagccagtggtggtggtcatattgcaatcattattacagcttcagactttctagaccttttccattttagtgaccttcagccttcattcgcttccattcatgaccacagaatagatgtagtcatctctattgaaggcaaacccatcccatctcttcagcttcatctagaaatttgtttcatctgttacactttctttctttggtttttagccttcattctctaccagctctttcacttaagcagagatatgttcaagactctcccattctaacagttccctgccttgatcctacaagcttttctctttagctgctaccttgctttttatttttatttttttctcacttgctctgataatctcctagaaaaattggcttactctgaccatctccattagttcacctcttaattattcttcaaccatctgagacctggctttgttctttctctactgaaactcttcaggcagagattagcagaagtcttctaattgctcaatgaagtggaaattttcagtccttattttctgtatttctccttcatttgactttgacttaactctcttggtttttgtaataccaccagcacctagtttatcagtctctcatgggaacttcattctatctgcctgccaaatggtggagtcccaaggactgtggtctgatctgctgttcctcattacatgctttctggtcagtattgcacactgtggttctcatctaccatcatctacctccagaagtgccatatatttagtaagtttacaagaaaagcaactttccttgctccgtagactaactctgatcttttgttccctatcatggttatggaactcactaattattcagcatcagctgtcagaatgtttaactttgctatttaggtttgtgtaagttatgggacaataactaggataactagaattagcttgtagcttatgtgggttagataatacaattgcatatgtaagtagtgaatattttggcttaataagtgaaggagtatttaggaagctatctggaatgttatctaagtcaggattctgaaggtaactctagcctcactgtcccttactcactatttctaaacacccaccaatcctgcctactttatttacttggtatttctccaatctgccatccttctctgtccgaccaatcactaccctagctcaggccttcaaagtctctcacttgacctactccttcacctcctttgaacctgtgcacaaatgttagcttcttagtaaggctttctctggtcacctgtataaaattcccatctgctacatacttcctggttccctgtattgccttatattcctcagtggcatttatctccttgtatactatataatttctgatctctgtcctttctattaccaccccacttcaagatggcaaggatttgtctgttatattagtgactgtcctaataggaaaaaaaatggcacatttatattagagtaacttgagaagaatttttaaaagtcagtatttataaagctgtagatatagagatagtgaagtactcttgggactagtaatcattgggcaggtgataccatttttaagcccaaaagggcatagtgaaagagcaggtgcctgaacctggattcagagagactatgtagaggaggccactaggcaggagctgtggcctttgcctcagcttggctgattacctcactaatcctcactaatcctaaattacccaagttccttcttttctggcccatttcacagtccaaagccaactttaagccagagggcaaggggagcacttgatgcagtccatgcagtatggcctcccagtgaacagggcaggtggaggatagaaactaaatctagatggaggagagggaagatattcagaatatgttttttctttactgtcagcaccttgaagagtgcctggcatatagataatatttattgaatgaatgaatttgttactggtttactggcctcatgaactttagttttgcctattctattataacttggtgactacattcctatatacttgataccaactcctcattaactacaaaggcagtattcccctctccccctttttaaacatcaaaactcttttttaaaaaaaattcttaaatgaatcgccagtatataacacataaaagtatgggtgccttgattggagtggtgggtaaatgatcctgagtctgtctgtttgggttccctctttgcctagcaggaatgtgactgtcttgtttaaagcccactgaagtagaaaacaggatgagagacacactcttcaacatggcataagatttccatgcttggctcctgcctatctctgcatcctcatttctcagtagtttcctcatattttaccatcctgtaattgaaagaattacaaaactagttctctacacaagctttcttgctgttccagctgctgggaattagcttcctttgtgcttttttttatttgaatgattcatgtttacattcattaaaattaatgaagattcattacagttgttttctctttaggcataattggatctcctatactgagacattgaatgcaactttgattgtttttttcccccattatatgttaagctccttgaggttcttttcaactttgcgttattccaggatttctatcgtaagagttaaggttcatccacttctctgatgtgaggttcatggcaggaaggttccatgttgctcagctgcagagtagaaaatactgagcagggcttaaatagattaggatgctgccattataatataaactgtgtttacgaaagagcatcatcaattcagaaaatatctttttcattgactacagtggtgcctgatgatctttctattacaatcttaaattatggtcattttaattatagaatcatacatgggtttatttatgttaaaataaggtaattatcaagctagctgtgacctatgagaaaaatcctgaagaaatgatgaagggatcaggtgactgtttttgaagtcaagtgtgaaaggtcagaccactctgggtcatgggaccctgccaaggcagagcaggtcaagtgctgtgcccagtggggccaacccccagtatggtgccagggactgggtgtgagaagtcaaaaattaagaatacacctcagaaaggggacatggacagatgccacagacttatttgcgtatttcatgatttagcccttagcttgtgctgatactggatcagatattttcagagttcagtattttcaaaagcatcgctgatcacctgttggcattgttttacatctcaaccaaggaaaaacttttgggacatctgtttaacaaggggtaagcttttatttgaaatgttcgattaaagcagaagagtcaggcatttttttgtgcctccccaaagaaagatttgtttactgtcctgtgtgaataaatataatgtcattatttcccgtaaaggaaaagctgatggggagagtaagtaatgggtaagattaggcaatgttaagctcatatattagtatgtttaagagtgatcaatttagggatctctgtgacagagatgccaaatgctcacagtgctatctcatgttggaaacatgtgtctcctccacttttcctcagtcctctgaaatgacggccctttagggattgacagatactatacagatttctgtgctgatatgtgatttgtctaaaacaaaagtttcacaaaacaattcttaccattgccatttaagagtcactctgatatgctctgtttccattgcaaacaaatgctcattatgatttgtgaaattaacttcacaatttcctaatggataacaccttgaagtatgaaaagcactacaggatcttttatagcttccctcctccagctctctataatctgctcccatctgtggtgtaggaaagatttcagcagtggccgctgaaggccctaagatcttgtctcaacagatagcaaggtgcataacagactttggacaggttgtttaacatgtctgagttactgtttattcactggcaaaatgaagggcttatattatattgtctctaagtactatcagttctgaccacctatgaactttcattttaaagaaaatacctatttctatggcctttaggcattagggaattttgtcaaattaaataaatctcagtaaggtttgatggtcaatggggcccactgtctggtgtgtgtggaggggtgttgtattttacatcaggaacttcagagccctcatgaatttctaattagaggaaccacctgggaaatataagtcaaagccctttgctcgccttactcagctttagggcacagtgactagaggtgggcaatcgctttggtgtaggtattgtcattggaaaggaagaaaccattttctggaggaaaagaattggttgaggctagctttaagcagctatttcatgatggacaaaaggactagctcatccattcttcattcgtttctctgtatcctctatcaaatttctgagtaaagattttatacaatgcttgattagcattcaaatagtatgtttcaaagattttaaaaaaaataaaactaggcctttgaatcataattatggcttataactctatttttcatatacttactatctcaagttacaaatttcatgttatgtttttttcaaaagagtattcctgccacaactcagagctcagctgaattagagcagtgactagaaaatctgagaaggctgagcttcaaaataaggtctggaaagtgtttcttattgttacaagagagtcaaaatgattttcttgagctttaagtttatgtaagtatttacttgacacttagcagtttaaaagataatgtgcaaaaatatgaaaatgagaaaaaacaatttcaaaacaagagttggtgattacgtgagacttagtagagcaaagtatattctaagtattaatctgtctaagctgtttgggaacagatgtacgtgaaatggataccgggtgttctgttgtgtacaccccaagtgagacatctgttggtagactgtgtggtcagaaataatggaagcaggggttaaaccccaatatgacctattactcatgtgaattattgaaggactaattactcagtaaaacatgatgctttgattcatcagtctacacgttaagaaaaaagcctctttagaaaaaaatttagttctgtttctaagctgtcaaatttgaggaaatttttaagatgtatgcaaagactcaaatttccatagtaactgcaaatactatctgcttataaagttttaaaatgttttgacaggtctactaatttatcataaaaatagcctcaaaagttttagctttttgttagggtaggttgggtctcacagaaaacaaatgtagagtgaattttctaaagcagggctgtccagttagacttcctgaaatgatgggagtgcactatatctgaagtgttcaatacagttaccaccagctacatgtggctattgaacagaaacatggctagtgtgactgagaaactgaatttttaattatatttaatttttattaatttgaattcaataactgcatgtagcaagtggcaactgcattgtacaacacagctctgacacatggagagttgaaaatgtttgtttactttcttcccaagttttcattttagtctttgtttctacatagaaaggaagatatagcttttgaaaaatgaacctgaatgtagaactgatatggttatgcaatttgagctgcctatttaaagataaagcaactgagtttagagatttcaaagtggcagagtcctttaacatatttcgtgggctggccacggtagctcatacctgtaatcctagtactttgggaggctgagatgggaggattgcttgagcccaggagttcgaggccagcctgggcaacatagcaagaccccatctcagggaaaaaaatatgtgtatatatatgtatatatatatatatatatatatatatatatatatatatatatgcatacacatatatacatatatacacacatatattaacatattttgtgtgtacaaaaaatatttttattatgtgtagattagttggttactagtaaagttgaagtcttgtctatagaaatcattgtatttttcatggtcattgtgatacattgtttgaactgaaatttggcaaattcaatctgtttcttactacaagaatagtacatagatttgaaatggtaactctcttagtctgtgtactctgaccctgtgaacgtctggagactaatgttattcctaaatatgctatgtccacatggcagcatctgaaggcaaacactttttaaaactgatctacttttgtggacccttcctctctctctttcctgcatcccggatggggccctctggggctggaactggcacagaactattcccctaggagtgggttcattgaagccaagggacacacaaattgagaatcagatagactggaccaaggtcattaaaccagagagggcaatccagatggggttgtccaaagtaggaagttctgaagtgaattgcagaaatccaaacatggcaaagctaaaggaatagagaaccagggcaatggatatagagaacagagcaattgggtatgcaggaagatgctattgcctagactggatgtttttgtaccctctgtaatttgagaaaatggaccgtccttgttgaaatggtcagggatgtagtagataaattcattgcagttgtgtaatctcagcactagaatactgatcataaccatatcacttgttatcccacctagcctgccacttgattgggttattagattacatttcagacattgacaagtctacaagcatcattaaaatcctaaacacagacttctgaccgtattcctacccaagttttagaagcactatgccaatgacgggggtagtatatgctgagcaggtgagttttgattgtgtgtgtctacatgtgtacgtgggtgtggtgagcaacaggaaggaactctcagccatgactctaaatgctcttgtgttggccaaaattggtataagctaggaggagaaacacaaaggagagagaggcatgaagttgaaggacattaaaccatttgcaaacttttggcatgcaaaccagaatatgaggaaacttagtgtaatgggtgactgaattcagaggtagacaggcaatcaggaaggtataggcaccaaaaatagttaccattggtgagcgtttttgtttttgtcattggcatggtgttatgaacttatgttaagcctaagggtaagtctaaaataatgtaccagctggcatcagggaattcccatgtacattcctagattttcattagaaacagtgttctggaaactaccactgctgctacacagcagtgcccagtgcttgactgaaaatagtgaacacttagatttgtttactctgccaggttctgtgctaagtatcttatcttgtttaaccttagcaaagaaactatgtagtctagatagaatttttatccctagggcccagaggtgttaaataacttgcccaaggtcataccagtaatttcagttgctggggttcaaagctaggcagtctgactccagagcctgcactgtccccatttggttatgttgcttccccagttaagcaagcaagagtctatctgacatctgagttggtggtagtaaagcatcatggtctgaaccaaaataataaaaacctttgaaacaacattatctgacttctttcaggcttttaagacagttccatcatcaacagcttattccatttctctggccacttccagtttctgaacaaatgaagaaaatgggagtgataaattggagtttttaacaagtttttttaaatctaattttttttatggaaaccaccaaacatacccaaatgtaggaataattatgtaataagtcctcatgttcaaccctaagaggggtgaagctctatgtgacccattactgagtttaaacagttttcaatttatggccagtcttatttcatctatactctacccacatcccttcttcccctggaatgattgaagtaattcctaggcatcatataatttcatctgtaagcatctcagcatgtatctctaggagataaagattttctaaaaaatcatattactactcttcaaatttaaaataatctttatagttttacatatccagttagtgtccagattttcctgatattttctctattttttaaatatgtcaaccttgaaatgaggtccatattatagctgatggctatgccttttaaattttctcatccacagattcttcttccttttttttcctttcaatttatgttttgaacaaactagtttggcctatagtttctcatgggcaagaataaccttcagactgggatggccatcactctgatacccgtaaaggggatgaggcaggttggggaagggagagcctcagaccatgatcagatgtcacaagatttttgcttacctagggtgaggacttgggaaaaagattgcccattaggagtcctgccttgggcaaaagtggccaaacttcagctgtgctgtcacaggctgtgggctgccttggaaatgtaggacctcaactcctctgaagttgaggtggagcttgagggtacgaatccctggtggccattataatgactacactcattgggatggcatggcaagttcatcctcaaagatggatcctagcatccaccatgaccaatgaggtttttttattgttatgatcactataaactcaaggatttaaacctattaaatgtttttcaattcacagcaatgattatttttactgatcttcaaattgtcacattttggatttttagaccaatgggagccccttcatcttgacttctgagttcttttgacattcactcagctgtctgatagcttccctgctttctggaatggcaagatattccaggttcatcttgaacatttcatgcttgagatatggaatcaagctcatcatcagagggtcctggttccttttactggatagtggtattagagacctcaatttgagaactaagcaacatcattgctaaaacttcccctatgtgtaccttgttacttaggtttttcaaagaacagagctagaaaatatgttgggtttttttgttttgtttttaaagaaaaaatgtatcataggattatgctgatacttccaattcaagtgcaggcctaagcttttcacattgtctcttttctcctacccttaaagtcctgattcctaactataacaacatcattactcatttgctttatcctgcattatgtagacacaatagagtaacaacaccaatgctgccaatcaaaagtataattactgaaacccacttaagatagtcctgcaatttttttttttgttcatagagtgtacactactagggaggtgtagtcaaattactatgttttaaagacacttggaataattcatatctgtgaagttatacccccaacttatttgttttttgtattattgtttcattttgcttttgatgtttaggcatttcttttttaaaaatcaattttataattacgtgaaatacttatatggttccaaaatcaaatctactaaacaaactatattctaggaagtatagcttttatgtttcccttctatgcttttccttccttcctgtaggtaggaaagcttatttgttcctcaaagctctgggttgttcttttattttatataaataaacatgtgcatatattcttttcattacccccacagtacccaccgtcttaaacacatgtacaatatatgtgtttttctaccttgatttctttcttacttagcaatatgcccagaagttcactctgtagcgctttacatcagcatcaaaatccattatgtactatcgtttattgacctctctgttggagaaatttggattgtttctagtcatttttgttatcgcaaatagtggtttaataaaaaactttactttccgttttttgtttttcaatgtgcttttaggatagatgcctagaagtgagattgttgagtcaaagaataaatgtgttaataattttgctcaatattaccaaattctttcaaaagggttgtgcaattttgctttttaaaatcattattgtataagggcatgtatttcctgaaaatttctccagaagagtttattgccaaactttaaaaaaacagcctgatacataataaatgatatctcagcatagtttaaatttgcatttttcttgttaaatcattcatgtttttactgtagtcctcctaacatttagggagcaccaattatggggtctctagaaggttccaggattctgtaatcaatttgacatgatttctgtcttcagatattcacaatcttcaggaagatatattgacaaaagaataactacatgatctattttgtgtgcaacttagtacttacagagcattataaatgcacatggaaaaataggtaaaggagaaaatcattctctgttgggcgggctgagggggaagtcaggaaaagctacagagaggttcgagggtaaactttaatgtgggccttgaagtatgatttggagttagcaagacagacaaaggagcaaggaaaccattctagaaaaagaaaattttgaaaaatctccagaaaaggatgctttggcctatttggaaaataacattgtcttatttatgggggagatgacagtgctttgtttttagtcagtagtttatacaggactttgaatagcatgcaaggaagttggcgtctcaacctgaaaattgaggaaggtgtgacaaaggctgggcattaggtgagatcaagtatttctgtttttttttttggtaaattaggtagcaggatagattataaatgggctccacactgaggagcccagtgtgatggctgatccagcagatcagggggcagtggctgcaaagctgggagaatggcaaggtaagcctggatgcaagggatattgtcaaagacaaaatttgggggatgtgaggcttaaaagggaaataaataatggtgatggtgagatttctagcttgggcagtgggatagatagtagacgctgcgcaaattcgtttttaaatcagcagaatgagaagcatcttatttgaaatatattctaccaaatcttagcatcaaatgtgctagtgactagcaaaatatgtaaacagaagggaagtagcttgaaaagtacacaaactggagaaattgctcctgaaggactgtaagttgaacccttttaagcctaagatctgtatttcctatgagccctaggctctttccttgtgtatcctgtttcttattagagtagaggctacttaaaaataatcatagtttaaagcgctctattttcagaaaacattattcattagatgttagtaaataatgtaatctttatacattcataatatttctgcattattggagtgtaaaaagtcagtgaaatagtcatttgtaaagatgtcagtttttatctgtggaaaatagctgttcataccattttaagcttaaaagttcttcatttacttcttaaaatatccatgttggtattattttgtctaatacaagtaattaatatttaccccaaattaagcttttaagtttactaaatgttacaaacataattcaaagcactgtttagtgtccatctgtgcaggaaaaataagatcaatacaattgagcagctgttagcatgtattggtttccttatattttaagtatgttttcatgttttgaaggtgtaaagggatgacagtatgttttgttgtggttttcatcatacagataaaaacttattacagttgaaatcttggtgaacataatacattttaaaatttccattcctcacccatttatctagatatttagacacagtaaaataaataacatggatacatttttgtcatgtgatttatgttttttaaaaagtagaaataaatttctctaaaagttatttttattttttaaatttagcatttttcatatttgaggaaaaaacaatatgtcttggtaccctagcttctgaactaataacacacctgtcattttacaggttattttaatgtttttcattgggatcaaacctactctggaaatatctcatgggtgagctttatttttatgaaatgttcttggcacttgaagacctttgtaggtacatgccagactcatcttacatccagttcttctgcatggaaaatatgtgcattgaaattctaagtgccttttcaaatttgaccttcttagagaataatatgagtcccaacaattaggaaaactatggaatgccttttggcctttacttttcaaagattttcagtcagtaatgtttaattagcattcattgtgtacattgtccttttttgtgtgatatggctagttccaaaggaatattctagaagatctcagccttctgctattgaaggtgataatacactactaagttatgtgttgctttacattaaaataatgttgcagcagttacttattgcttaactagcgggtataggacatcaggttgaaataactgattttgaagtgaagagttcttgtttatatcttaaactaaccaagtatgttcattaactttgagaataacaatgatctttttcattattcttgagtagactggataaatcagaaaacccatgttagaggtccctgtaaaaacttcagtcttatttggtaagtccctttataagagtttcaataaaatcaggtaaatttaaactctgaaaattctacgtactgtctatcatgttcaatttactgttaaccagtactatgcactggaaaaaatttttttcaccttaatgagaccactggtcattactgctgctactgatgctcttttgtctgcacatactgttgcaacataatgtgttgtgcatttgatacggatattatcatattgccataaggagctgctattattttagacaccaactgattccatgatagtgtcagatttctttaacatatgcttatgtttttgtacaaatgaccccaagaaacatctgctagttttgtggtggtatctactgtttcttttttagaatttgacctgtcagtcactttttaacgtgaatctacaatatttgagttgtattcctttctcgtttttatgctattgatattaacaaaattgagtcagttttatggcataattcagagagaaaccgaagctgtctatggatgttattttaaaaatacctttttcatgatgattgtgcctttaaatttttgtcattgattgacactttaaaattgaaaagtgcccttttaatggatcctttaggttccaaaatcttaagttgaaaatttctgtctattggtcctgaaagtactctctgaatttgataagtatgtagtagttgtggtgtatccttggtcagtttatatcctgtgctaattgctaatcttacttagtttctttgatgcgtgtgtgaagacaggcaaagaaaaaggaagtggaatttctacaaaactgtgaaatctttactttatggagactagagaaatttctaagtaaaagaagacactcattctattgtagttaggatcccttcttttacttgcttttcatgatcttgactgaaaagcaacaattgagatttccattgcccgacgctttctcttctgcttttctttttgtttctcttgcatttttaaagacagctatttattcaaaaacaatatgaacttttatttattggacttaaacctggaacatcaacaaaacaaagaacaaacaaaactacctttccaaatttattttattagaggatgctatcaatacaattttgtattatgttcacacttgataccaaacctaaacccaagaaagtgtgtcctgtgttacagcctatccctctgtttaagataataactagaacaatttacttttattttctactcatctgctttctgtgtatcagctgttgtcctccctcagcctcgaagcatgtcatcatttccatctccgtgctcattcagtcatccttgctgctcttagtcccctttttgtcccttgggtgacttatgtcattaggacaaccttctgtccccacttggctgaaactgagctgaggcccttgccagttgcattaggtgtggcacctttcatggctcagtttgggcctctgtgatatctgtgtgccttctactccaaactccattctgccagaggtggcagggtgactggaagctttagtttcagtgacaaaacccaagcgtggctatgctgagtgtctaagtagctttcatttaggcctgaaataggagagtcaggcgcctctgtgtcccctgagaaagagagatttccctcagctctctgggcccagcactcaaccatttaagtcagctggttagtataatttccctaaattgtggtttagtttccctatgagtaggactggagtaggaccaagtaaggaaagtccctagtgacctttctgcctcctgaggagcaggccatttactttgagttgtagcttcccatctgtctgtccccactaccctatccaaggccctggaggagccacaggatgagggaggagattcatggaaaagcgccttcaggtactgggtatgtctggagtaacatttaaagtttaaaagactctttaacaattttcctctgatacttactactgcctatacttgtttggttttagtacagtaagttttgcctatcgtgggggtgaagaaaatagaaatattcccattaactttgtatggtgcttggtatgacaccctgaacaggtgcacccgtaattgtttacttgatgttctttttaataagtcaattatatcatcggaaattgaagaatagcaaagttaatttgtttaatcattctatgggaactcttgcatgctcgttcactagaggaacattgcgtttctcccttaaaggacaaggctttgttttgtttttaataagacacactctttataattaaaacaaaatcccagtgttaagggatttctgttttaaataattggatttctttcctttgttcctctaatccctctatatgagaaaaaaatctaatggtgtcttaggataaatatttttagattaaaaagttctcttaaccactgaaatttaataatacttctcaaagtttatggatgatatagaatgtaatgtaaggttgagaattttagatttggcaaaggcaaagatacaaaaactagtgaaaaacaacaaactggaaacacttttaaaatactgatgtatttatctttgcaataaattattcagaaatataaataaactcactatttacatagttttatttaaatttgtcctcaaaatactaaatttagtactatatattttcttctttcagataaatgctttcctgaaaatggtattttaatatctacagatggtttagtttaacaatggttggggtaaaaatgacatagggaaaagcaaaatgtgacagcccagcttggttacctttagagaaactcagaataaactctattcccatttccttctctttcccctttccatactcgagagcccttttctgagactcttaagtcatgtttgggccttggagaggataaatagcagggtgggtggtaaaaggggagagtgctttgcttgaggcaaagttttcctccatatgggaccttcctcaagccctcccttcaaaccctttaaatgagagcatgagctcctaggacagaggtcatgtggaaagcagcattagcatgaaggggggtgctgtggaggggtgtaaggtgcaaaaagcagcattagcatgggggaaggtggggtggaggggtgtaaagggaatgagatgtgaagtggttaaagggccatttttctagttggcctctgggctttgatgaaccttttccagtgtgcctgtttctccacttagccctgggctaatcttgactcttaactttccaggtgtgtatctatgctgatttctcctgggtttggaagctctgagaagctctggttctagttcaatcacaagacttttaaagaaccagaaaaataaaacaattttttaaaaagtaatgaagaaaagacttttaaagaaccagtgaaaacctgggagtaaaaatatagaagacttgagaaatttcatctttacctttcaagtgggcagcatgagaaattcttgtaaatggtgctttcaaatcttacacaaggttctcagttacctttatttgtactccctagactgtattgcatcccttgctatgttgactaattcccacctaaaataattcaatggcctcccaatataatctggcattctaattaataagctaagaaattatttggtttttcactcattggcgttaaatattcttcagtgcccacatttggaaatattggaacacagaaatgaaaaaagatacaatcagtttctctgcttgccatgttttccttgatatggcaatacgacaacaggtcaccctttgaagaaaattcagagatgctaaagtagaaattaaaactgaagataagtcaaggcaggatagtataggagtctgctacagctgccatagcaaaatactacagcctgggaggcttgaacagaaatttatcttctcacagttcttgaggctagaagtccaaaatcaaggtgccattggggttggtttctgaagagggttctcttcctggctttcaggtggccaccttcatacagcatcctcacgtggccttttctttttgcctgcatggatagagatctctggtgtcttccttgtaagaacaccagtcctattggattaggaccctatgctatgacctcatttaacctaattaccctatttaaggccctgtctctaaatacagtcacactgggggttagggcttaaacatattttaggggaacacaagtcagtccataacacgtgatttgctatagttttcctttacctaaatcttttccaaccttgagagtggattttggccaggtgtggtggctcacacctgtaatcccagcactttgggaggccagggaaggtagattgcttaagcccagaagttcaagatcagcctgggaaacatggcaaaaccccgactctgggggggcagggggagtgggggaattagctgggcttggtggcgttcacctctagtcccacctactcaagagggtgaggctgaggctggaggattgctacagcccaggaggcagaggtcacagtgagcagagatcacaccacttcacttcagccctgggttacagagtgagaacttgtctcaaagaaaaaaaaaagtgggttttattcttccccttaaattcctattaatagtgaggtgaggcttcttgtgttttttttttttttttccaagacaatggttaatgtgtgattacttaaaaatgatatataacactaagaaataaagaattgttaagtgagaaggaacatattaaaatggcttggaaagatgggtaattttttacattttaagtaggttttctcaactctaactctgtggaacttggtcaatctaatcagtctaaatatagcacaaataataatagttatatggacaggagaaatagtagccctcaaagatagtgaaatacatctgaatatcactaacaatgtcatgaatttgcttgttctaaagttttctgaaagtatgaattcataactgagtttttttttttttgcctatgactactaatgtttgaggagagagtagtgtcagaaccacccccccatttattacatgtttatttcatattttggtactgaaatcagtgtttattttgtgtcttcctgataaatcttgccaataagtaattaccttccatactgaaaagttcttaggattaccaggttgctgggggcaaccttaaaaggccatgcagaacattgacttaggtggctattaccctgctttattcaggtctgagcatttactttcctactacaatcagaatactgacctacatttaaaagtgcaacactgccctgttatctaaatccactgtgttcctgagaggaaataccagaaaagagggcaccaatattatttttctgctgttcttgatcataagtgattacctttttttttggttaggcattctgcttctgaaagataactgaggttgaagttaatagaactaagattcttatataaaatcataggaaagataattttcaggattattgaatcatattgaaaaatgatataattgtgttaaaagataaggactaaaatgagttaattcaatttggaaatagttaaattagaatttgcttctgtttttgatgaatactgctttttgaaaaatcttctgagtatttaagcttttactactctagtcattctctctaaagtagacatagaagcgtgttcttatcttgatttggtaaggctctgaaaatgcaaagcaacagatgttgtacccagcataattatatgtatcctggaaacacatctttattgagtgggatttgttcttggggaaacaaaaatttggcaaacaaaggacattaacttgctgatctcagcagtaattacttgggttagattataataatcttgtgtaggtggtaactgcatgcatatattacaaaatctaattctaaaatacgtacattaaaaggaaaatgaacttgcgcaaactttagatcatgtatccccttgaagagcagaaaagatctcaatttcattatttgaaagttgtttgaacagctttttggaagaggtttccaggattccaaatcctaatatgtgtattgatactgaggctttggactaatctttgggggttactgccttttttatgcccactgaaaatagagcatttcaaacaaatgaactgatctctgatctttaagcatgccagtaactctttggaacaaatccatagttatttttaccaatgactgtattaaaacagtactttctgtattatctcttccattccaaggccattttaaaacaccctctttctcttctcccaataggtaaagtacgacagagctccttaggactgggttatggagaattatctggaggtcaatttgagaaccactgtgcaaaccatttcttaaataagtagctacaaggttgtccttacaaaaatttctgaagttgatggtgttgcgttttggagtctgaagcttaaataagagtttgtcagtggtcatggtctaaatagctgattactaccaaggtcatctaatttttttttaacacaaaaaaatgttctgagcacaaatgaaaccttcaggacaagacatttatgttttgagaatgttcttaaatgattcctgtcgtgtatcttattttacatatcttaatgatcagcatgtattttttgttgttgatgatgattttataaatgtgctatcacctagtttctaattcctaacagctccttcatcagtagaatattgctgtagcacagttttgccatctgttaagaaaagatggtgactaataagagtggcacatttcagggctggtgtgctatcgcaacatctagtgttttagtactgaggacagtgatgtatgcagtgttccttacagccatggggtgtgggaatgttttcctcttcggcaaagtctgtgtatttctatagctgaactctcaggatccagaggaaaaccacaagatgatgaaaccagatgattgtcatcaaatttctattccccactacatgattattagttttcgtcaaaagaaatactcatcctatcctgggttggaattggtaaagaattttgcattgtgactaggacacctaaaagtttttaggatgagtacaaatggaatttgatagatttccccaaaatgtttgggaaaagatttattcctccctaggaacagcaagagtagcagcatcacatgaggcaactcctggtaattttttcttcttgctcttatttcaatgatatcttttcattcttttctgtatctctcaatttctatgtttctcctcttaatgtatcctgtaaatttcttagtagaacctttttactaatgagggtttcctagtttgctttaggaggcactcaggatgcccccttttgtaaggcagtaaattgaaaataagaacttggtgaaggtccacgtgacggttagtttccattctccattgtaccaaactgctacagggaaagaaccatatttaatcaacctcaaatcctcaatatttaggtcagaaaacacttggcatagaagagacactcaaattttgcagctaaatagattattgatagaaaatatgtttcttgcctctacaagcaatatgaaaccaatacaatctctaaatatcttcagactactaggggcaaatactgtattataagaataattcttcagaaaggaaaatccagctactctcatatcacctctctatgttgaaagctagggaagataaactggcttccagccagtgagagtccatgtggacctagtgctggctggagatccctaatccaaaggcaagagccagatactggttgtctgctgaaaatcagaagatgacctctctggtagtaaggccagtgactcatccctgcatcttttatcctcttctgatttgtataaggatctctcctttttccccagtacccactctcaagaattgctttcctttttaacatgatcataccaaaatgtatctaacagtaccttgatttcctttctgaggaatttagggagcatatttactttgtcagactcattagaggtttggcttcttggtcgggttcttaaatggacaacttgtttgggtgatttggcagagaataggagaagccagtcccctctgatagagcaaacctggggagctgtggttgacccacctgctaactgtcctgtacaattaggcatgtggcatcagtgggtgactgaccagagccaccatctcaatggcggctgttctttccttcctgtgccttctcagatctcttttttgttcttgttactccactatattggtttttcttgagtttttttcaagcaaatatcattattcacttctactgcagttcctctgttgttcgctttttctcttagtcttcattgttttccattttgaacattcagagatccatcaaaaaaagtaaaataacaggaagggagaggtaaacaccagtcaaatgaagtattataatagtgtattactatactctttaaagtaattgaagggtggttttttggggtcagaatatctgttagaatttggaatttgccactcttgagactggggcaagctatttaaactctaagcttatctgtccttcctcacaatctgtaaaatgggatcataataatggcacccagtttatggtgtagtgagcattcactgacacaattaatctaaacttatttgcactacatagaacagaatttttgtctattaaacaatatagcgttttaggcatgaaagaaactttagattaaattaaatatcatttttcttaccacagggtaagtttctgttttgtttgcccctgtttctctaactcctagaatagtttccagcacatagagattaaacaaatattcgttgaatgaatgaatgcatctattctaatcctcttgttttaggaatgacccgtcaggctcaaaagtgaaagcatttccctcaagattggtgacagagttggggactaaatctaaggctttctcttcctacaccagtgtcctttctgagaacacgatgccattttctcaatatttgtttatttatatggtaaattggtaggaagctgtgtggtactataagaggataaactttgataatgaggtatacttgctatcaaattctaacattctcatttaaaacatggcataccatttgtcttctacattttcatatgtaaagtgaggtgatttctaccttatagaactattgtgaggattaactgaactaatctttgtagagcacctggtcccatttattttttttttttgctcaccccaccccccaactttctagctagataacttatacattcactctgtttttcattccttcttgaatctcctgtggccagacttgacccctgtcactctacagcttactcgtcaaggtcagtcctcatctgacttgacctactaagagtctgacaagtagtcacactatgctccttgatacagctttcttcacctaccttcttggatgtcattcttttggttctcctcctaccccattgggctgctttttcccagtctccattcttgggtattctcattttcccatgtctgtcctctgacttcttattgtctctgtttctgttttctctggttggaccttctctagtttctggcttcaaatactatctaaatgctcatgtctttcaaatttgtaactctagtctagacctctcctctgaattccagttttataaatcttctacttaaatattagaggtctaataaacttctcaaacttatgttctacaacaaactccacattttctcctgcagcctctaaatatgtacctcctatagattttcccatttcagtaagtgggaacttcattattctgattgtccaaaccaaaaacacttggagacttgctacattccaccctttgtctttcattctacatccaacctatcaacaaatcctgttgcctcttccttggaaatatatccacgcttgagcagcatcattgtcaccacttggtgttatacactctcatttctcacctggagtattgtatttctcatctggagtagtgtctgtccaacgatgtcccccatcagtctgttctccatgtagcaatttcgtttttgtttgttttaagattgggtcttactttcgccttggctggaatgcactggtgatcatagctcgctgtagcctttaattcctgggctcaagtgatcctcctgccttagcttctccagtagctaggactacaggcacacaaccacacttgactaatttttttttttttttaacttttactagagatggggtctccctttgctgcccagtctagtcttgaactcctggcctgaagtaatccttctgtgccagcctcccaaagtgttgggattataggcatgagccaccatgtctggcccagatgttaattttaaagtgtacattagagcacatcgttcttctgcatgttcagcataaaatccaatgtccttaatgtagtctatattaccctacatgggctacttgtgcctgatccctctactcttatgtcttatccctctcctgctttctcactagcaccagccacatcttaccgttccttgaacacaccaagtatgcatttgccacaggaccttgatgcttactgttccctttgcccagaaacccttggaaccagctatgtgttaaaattcagatatttactgattttagagagctaaaatggggtatatataatatattacataacactcacagctggtttgtggtagcatttcataattaaataatatttctgaatgaaacattaagaatgcccatgctaagagggatgagtaaagactcaactctcattgtcagttcagctgcagaatgaggtcagctcaagatttgctgccaaatgacttaagaaaaaaatgtttttggagctttggggatttcagaattgcagatgagagattctagacccgtacctacacagcatgctcccttattttgttccaatctttgttcaacgattatttattgggtagtcaaggaagatctctgtctaaaaggcttctctgtgtggaacaagactggcatgtggaaggtttccaattaacgatattgaaagagtgaagctcaaatcatttttcactcaaatacatactatttagaagacagtggccagtttaagaataatcattattggaaacaaagtactatttgattagggatagttaacacaaacacttattagtattagggatatgtgaaatacttaatggatgagtcatgtgctgacataaaacccattatccattttagttcctggtagcctaactggttgaactctgttttattgatctattattgatttggcctgtaacttcaagttacattttaatgtaatttcatccttttctgatcaccttgtgtcttcaagcatttttaagcagttgatagatagttgaaagatattatcactatttcaatctaaaagatattatcactattttaatctacttaaaatttttactacattcattttaagtatgacttatggaacgaatcgaaaatacaagatagtgaaaaacttgtgaggatcacctgaaattttagcattcactttccttacatagaggaacttagtctctctaaagaattatgagtaataaagtatcataatgatatttgtcttagttttggttaagtgtactccacaggagaaagttaggcatgagcaggaattattgtagtcccacattctcaaacagttctccagtaagaaagattttatgtgtttccagaaatcattttcctcctcttcagagctttgggaccataattgtatttaaattgctaatctgttttaaggaatcataataaattgtttaacatttatattcaatcaactttgtaatttgtataaatttttcagggtgacatttgaacaatttttaagaaaatgggaaatacagaagtattcttagttttaatatattttaaaaagatgacatgtgatctactgactgaaatccttcaatcatttttgtttttctccccaagattagatagaatggatgtgattttatttttaatttgcattatggagagtacttttggggggttttatgaaaaagacttcatttattttgttagtggtacttcagttgcataagaaaatgttcttttaaatatagtggtcatttgtgtgcagccttcaagttagcaaacatgcctttgagtagtcactatttttgaaggtctttatatctgattgcaatggcttatattcaatagtcctcctactaaatgaaataaaaatggatgcctcttctgccacagaggcacaggtggacatgttggtagcaagccccatgcggtgtgacacatggcacagcccaacatgggggcaaagagcatgcggcttgagctaggagtcactttatggctactttagtgtagatttgtgtttttctgtggaacagccattattgaagacatttatatagtatgatgtttgtttttcattaaatgctgattgtgatttcttaaaaatagttaagacttgattagcagaacctatttagaagccagagttcccctgcttcacctcttgctatctatataaatgatatttttgactctgtcctttataatgttggcaccctgtgcatattagatgtaatcagggctgaaaggaaacttgaatccatctggaagcaataaacttttctaaaagactgcacagtgttatttaatcctgtgacttcttactgtgagtgaaattaaggtttgatgcagttgtgtcacatcgtattgatatcaaatttatctttctaaaaaaaaactgacagtattacagcacagaggagaagatggcttgctgtaatcctgtaagctattttacattgattacatgctacataatgtacctaagtatataaaatacttgatctagaatgtttatgttttctccaaaattttctcatcaggtaatactttctcaacttcacctttagttttggcttcttatcatagtactaactatgcggtagtaattgtgttatgatgaaaggcatggagaagaaattataattttaaaactattataaagtggagacacacttgtataattaccatctatgtagactgccaaggtataaacatttagcttattttagtatcagactctttgaatcaatttaaggctttttcaataaaattggcttcctctaatttctactccaaaatggttaaaattttgttttacttcaaatacgttgtagggtatcatatttcatgtgactaggagcctaaactatatcagctgactggcataatttgtgaattatatgtgtgtttattaaaatttaaagtttttattaagacttacaattttattaagacttaatttttttccttacattttgagtaagtccaactgaaaataacttagagacttaggaaatttgactacattttataagtaatttccttgtaatttttctttcttgtggaaacaattcttactgatttacttaactcttttttcaatggcaaaaatgaaaaccaaatatatttgtcaactatattcttttaattgtggaaatgaaaggttcatatcccccatttgcctagcatattaaaaataaacatgacctttgtcttgaatgttgttaacttggattttaaaaatcaaaccaattataagctatattaaaattgcttatcaccttccctttgtcttcagtaagtctgggcctaaaaatactcatcatatgaataaataaagttttacaaatactttttagaacatcttgaattatatgtgtgtttgaagcttacttttggatgttcggtcaacaaggcttctgacagtttctttttatcttccctctattccctgccactgtgcaccccaaagtgatccctgaccacagtggtcccattgctggcatcaggaaggtagactgaggagttcaggtatcctagaggctgttaggtgaatctcttctacctctttcctggtcctaggaccactggacacttcaagtaaaaataacaattactttaatctctcaggtaaagtttcttctcccttccagcaacacagatctgcctgtgccgagttcaaatactctgaactttcaacagttgttctgaatacttttttgtcatcttatgatcaaatattgagagcattgaggggataactgaatgggcatggtataaaagtcagacttttagtgtttctaagtagcagaaccctttggacaatttagagggctgtgcgatatcctcaccgtgactgctgggaagtaatgggatctgacctgcagaggtactaccttggctgacaataatgacaaaagtgagagcaaagtacatatgactatccttgaggtcctcaggaaaaaaagagtattagtgagttgaactgtatgtaagggtctttaccaataaggaagcccatgcccagacataatccttacaccctggcaatagaaaccatcattgtggtttacatctcatcctgttcctacagtccagcaagttcaggccacaaaaggtttaagcactttttcctttgttctcatagcaacagttgcccatggaggttcagttacactaatattaacattttaatatacacaaagaagtgcctcgaatgtagtaggtattcaaacttgttaaatgaaagaagtaaactttcagacttaccttgaactactacagttttattctttctctaacctctcccactactaccatcttaaaaccaccatttaattagtattttataacaagttattaaaggctttcaaagacctttgaaccttcaccctctggtaagttaataacttctgatatgcgattaaatgtcaactgagtagtagtgggccctaagagctcagagggactgagaaatgaaggttattgtttagaagagtggctcaatgtgcttcgacagttggttaatatttgaaaagactagagtcaagaaagccttccatgtgctaggaaatgaaggagcaaaggtccagaggtggaaatgtatacagtgtgattaagggattttctgattgatagtaaatacagtcaataaaaaacttttattggaagcctagcctgtgtttgaagcattaagctaggtgctgggatacagagattagagatgaagataatgatgaagatattgttgaagtgaattgctgagaagctggagaaagggccaattaccataatctgaggctcaggaggaattggtgcaaagatcatctggtatgatatatatgaactgtatatacaaactgatctgtgtagctgaactgataatgccaaaaaaaaaaagactaggtttttgattaagatgaatccattaaggtcatgttttctgttggtgccattcttggagacctcccccaaccctatacatttataaatgtttttcctgagggactgagatggaagtggacatataaaaggaaaggtctgggcaaatacataagtaggtagtaaaatcaaggaacaaatgatctcaacaaaattgcccttcttgaaatgaatgaaaatgatgaaagccaatcacattgcatgatgaacttggggtatagaatatgaaatatttaaaattgctttatttcatgatgtttcagatgtagtaggaacttgttgcatagatggtgtaaaaacaatctagtaataaaatcttaggtatttaatacaaggtgaagaaagatgcaatgcataaatcatgccattttaggcttaattttcataaggctatgcctgtctttataagactatataccaggagttctcaagctttttggtcttggaacccttttatactcttaaatcgttgaaaaccacaaagaccatttatttaagttataaccattgatatttgttgtattagaaattaaatagacattaaaaatatttactatttaaaaataaccaaaaagatgggcatggtggcccacacctgtaatctcaacactatgcgaggccgaggcgggtggatcacttgaggtcaggagttcgagaccagccaacatggtgaaaccctgtctctactaaaatacaaaaattagccaggtgtggtggtgggcgcctgtaatcccagctactcaggaggctgaggcacgagaatcacttgaacccagggagatggaggttgccgtgagccgagattgcgccactggactctagcctgggcaacagagtgagactctgtctcaaaaaaataaaaaaaataaaaataaaaataacagtaagttcattgcatattaacataaataacatatttgtattaaaaataactattttccaaaacaatcaaaaaagcagtaccactcttctattttaaattttttcaaatctcccttttctaaaaaaaaaaaaaaaatattgtgtaagtttaaggggtacaagtgcaattttgttgcacggatatattgcttagtggtgaagtctgagaatttagtgtatcttcacccaaataacatacgttgcacccattaaataatttttcaacacccacccccttctcactctcttgagtctcctttgtctatcattccacactctgttcctatgtacacattatttagtacccacttaaagtgagaacatgtggtatttgactttctgagttttttcaactctggcttaatagaagacagctgaaatctcagaatgcttcttcatccagtctgttgtgaatatgttgctttgattcaagtatctaaggaaaatacagttttacacagatgtgcagctgaaaaggaaacatcttttaatatgttcagataattgtggatattgtcctttgatactatagcaaaacttatcaagtgctaatttcttaaaggctggttataatttgaaatctgaaaacatatctatttaattgtagtttgctatttgaaaatttattggtctgtcttgtactttgaatggatattttgcccacgtatgattttataacatcctgtattggccttttggaaaatttggtttactattatacagtttctaaatgttgataatttttattataatatattttaaaaagtctaatgtcactgccagtctcatcagaaaattctttgagattagaaagctgttaagatcatcatcacacttacaagttttacaaaattttaattttactcaaaactttatattttatcattgacaaagctctcagttgctttgcttagtgactgactcactttgttcattttccagaaagtgtttaccaaatgctgctgcctcaataccagagtctgtattgtcagttgatctttcaagtaaaaagtggtgttctatgaaaaacagctagttcagctgcgactgaaatgatataagtgtttctcctggagcaaaccaccacttcgatttgtagcagaaatgctgtatgtatactttccattgttattactcataacatttttaaaaatatactcaagggtggagatttttttaaaaataagtgttattgcttcatcaagaacagttaaatgaaactggattttttaaactgagtttgagttaatgaagaatgcagcaattattagtaaaatttggtgctccaccttgattcatactgacactccaggagttttacccactatttcttttgtacctttagtgcaaatgttaatatggtaggaatggtaaatgacatctttagtattattataaaaatcgtttttaccctgtatactctttgagactacacattgagaattgctgatgaaggtgttttaatttatcataagcactgaaaagatttacttaattcaccaatttctcctgaatatttgtttatataaaacaagactatgtgtatacacctacctttttattaatggtagagatctaggaaaattaatttctaagaactagccaggatatttggaatgtgaataaatcatatatccagaaaaaagctttagaagattgtctatgattgaaagtcaaacagctctcatttctattatactgttctttttcaaagaatttaccaattttatgtggtatttatgattaaacatacaccatgtaatttaacatttttaatgtcacttttacatcataggtattaaagattagcatttttattgtctgtattttaaagctcaaagaataacatttaggctgggtgcggtggctcacacctgtaatcccaacactttgggaggccgaggcaggcggatcacgaggtcaggagattgagaccgtcctggctaacacagtgaaacaccgtctctactaaaaatacaaaaattagccgggcatggtggcgagcgcctgtggtcctagctacttgggaggctgaagcaagagaatggtgtgaacctgggaggcggagcttgcagtgagccaagatcgcaccactgcacttcagcctgggtgacagagtgagactctgtcttaaaaaaaaaaaaaaaaaaaaaaaaatttagatttttgactgtttcattgattcatcttagacttcacatgaaaatatctgtatatcctcaaatgcttacattcttaagaagtatctcagccatttacacatgatagaaacaactaaatggaaaaaaattgcagttggaaattcactattttttatttgatccgataacaatgtgacatttgcgattggactgtaattttctgtctttctctctgaaaataagttcaaaaatttccctctaattcttttactagataagaagcctacttcgttgtaactcttgatatatgtatgtatttaggaacttaagcttttctgctaataaatgttatgtcataattcttgaggatagtattatattgtgatgggttttcagtaaactacaggagcagccctatttgtttaaaccctagtttaacctgattattaacaattaaattgtgttttcttctaacaattaaagtgtgtttaaatttattggtcccttgcttcacagatttatctcagtatgtggtgtattcaaacagaattttgtatttttaattaggggattagataaccaattctgaagagccaaaaaaattgttagacatcacattgcttaaccatctaatataccataagtgtgtgtatacactatgttgtgggagccatctatcaggcaggcctgtttttcaggcagtattttaaaaagtggacatgtgcagaaactgtgagcacaattagcgccaagcagataaatccagctctaatcctgtttacggtctacatcagacagatgtgccaagattgatttagacaagcccgaggcttacagtaatatttttaaaagtgccattcgctgttctatttttgttaaacctttgctaaatattcttaagtcttgttggttttgctcttcttattaaccaccgtaagtaacctactttaagcaggtcccgctttgctctcatggtgacaaggtaacctgccaggagaggttatctttattccctgtaattaagttgacttttccccccaaaaaaatacaacaataggaagtgggtgctgaattaaataaatagcatgatacccagtagatgtatacttaagttccttgcaagaacagatggtccccagtatctctgtaagtaatgtgagaggacagttaatgttctgaaacaactagctataaccagtatgatactaatgaaccagtagatttcaaataataaaccacatgccgccaagcaaaattatatgtcattcataaggatttaattatcataacttgcaaaaaagtgtcaatagatgatttctatatttttatctactgatatcaaatatcaatttatgaatagagtttcacttcatattttttaccaataaaggtatgttttaacattaaggtagaattaaagttatatttaaaatacatgccccaaagtatgtggtgatttttttttaactcctcttttactatactgtctgtatgtattgggctgtatatggaaatgtagcttttacatacaattaggaaaacaattgcttttatttctagcagaaacttgtactataacagaagtggctagcatgggaatcagagtagttatcttgtagatgacaactgaagcagacataaaagatgtaatattttttcagcactcaaaaatttataagtaaaattttataaacaaaaagcagtatttttgtgattcatatggaaaataaaatgagtctgagtcattcttaaggtgataccgtaaaggtgtatagataagaagtccatttttaaatatacccaagacaacagttttttctctcagtatggtttgttttcccttttttctctttaattatgtttcccataagtatttgtatattctaagaatgtccaaaaaataaatgttttgcagtgggggttgaaaagaaagaaagacctttttagatttcagctgatcttatcagatgatctctagaaccttgaaccttcaaccttcactgaagttagctggagggcttttcacctggaaacctgagaaacctcagaagccttctgctttagctctctctcaagtctaggaagccagtggcctgcgaccccacagagccagctggtccactcctcatataagaacttcggtaacaatacaaagacatagcaaagcaccatctaatctgataactcattaaacaatatttagatggctcaagactttaaataaaaacattttaagcttgtttatagaatactaacaagttttattcccaaagactatattcagagtgagaaaacaattttccttaaaactaatattatatacatgttcatatatgttaggaactagttatatgcaaaatcaagtgactcttgtgattagaactggtcacatttattcatgtagcataaatggttaatattgccaaaatgagtaatagatcagattttctatgtgagatattgacacctgagagatttacagtgtttcactgttgtgaaaaatggagtgctgaagaacatttgtctattgttatacatttgtaaaagaattcacaaattactaatttcaaataagaactaaatatttcttctaagcctatagtttttctttttaatttcttctaagcctacagtttttctttttaatttcttcttgtaacattggcaaaaagaccattcgtgtgaaaacctcagattttgatctgtacacaaatgcaggagtagagattggaagcttgagctggaaaagcaggaaatactgctcagagccttacaaggattttcagaattttcactgttgggtcctcctggttgctgcagtctaacctcgcatctccttgaaggcagccccagtttctgatgaaatactcttcagttaatttatacatatgctgtcttgctgttttcctaaggactgcaggcagaactgtggttcacctactgttttaaatttggctagatttaaaaacagatgatctcacttatatgtggaatccaaaaaagtcaaacttatagaagcagagagtacaattgcggttgtcaagagctgggggaggggaagcaaggggatgatggttaaaggtataaaatttcagttagacagaatgaataagttctggatctattgtatagcattgtgactatggctaataatgtatacttgaaaattgctaatacctgaaaatcactaagagactacgtcttaaatgttcttacaacacaccaaaaaaaggtgtgaggtaatgaatatgttacttagcttgattttaatcatttcacattgtaaacgtgtatggtactgatcttgtacctcatttcattttccatatgaatcagaaaaatactgctttttctttataatatcttatacagcatagatacaatttttagtggtcaattatattgtaatatatacataaatatatatgattttcattggtcaattatactgtaataaaacagcaaaaaataaagttgtaattaaaaaataatttggaagaaaaaattagcaagtggttggagattgaggaagatgggaccaataagtcctccaaggagagtcatacattagttttttttaaaagtccattattaatcttataatatttaatatgtttaatttcttgacacttattaatccaattaagtatgagaacactgtggataaatctaaaaaccttaaagttgagtaaaataaaccagatacaaagaagcacatactttatggttacatttatatgaagttctagaaaaggcaaaacttagctatagtaaaaaaatcatggtcctgagggaataactagagagtggtatgagggagctttctataatagtgggaaaattctgtatctttattgggatagtggttatgtgagtgcatatacttaaaaaaactcatggaattatgcccttacaaatctgtaatttttgttggtaatttataccttaataaaaaacaaaacagatgacagggttagtgattgtttccttgaagaaggtctttacatgggtctgttgttaacgagttgtagtaaaaatcatccaaaatgcttggattcaaatcttagatctgttcctaccagatgtgtgaccacagacaagttacttacattccgtcttcagtttcttctcttttaggaaaaagcatctagtttttgttgtagagattaaattagataatacaaatgaagtacagagaacagcgtttggtgtgtaacacatgttcattattagctacccttattttttagagaatggaaatttttaaatttaaactaatcaaactattttaggataagcaagtgaaacaatctttttttcaatcgatcacagaaatattttcactgaagacaaattagacatttatataagcaaactacagtgtcattaccattcaaattttcatatgcatattcatgcttacatgcatatgaaagcattacacatatgtattctataaatatatacaaaacagtaatggaaatgtgctgtactattttgaacatctttctagtcagcccggcattttatttacttttgagacagggtctcactctgttgcccaggcttgagtgcagtagtgtgatctcagctcactggaggctggaggtcctgggctaaaggaatcctcctacctcagcctcctgagtagctgggaccacaggaaagcaccaccatgcccagcttatttggtttattttgtttgtttgtttattttttatttttttgtagagatgaggtctcactatgttgcccaggctggtctcaaactcctgggctcaagttatcctcctgcctcagcctcccaaaacactgcaatcacaggcattagccactacactgacctctacattttaatagctgagtagccttctgttatatgaatatacttttttttaacaaaaccaatactccattattgtacatttaggttgtttccaagtttcactcaaataatgcttgggtaagtaagtatttttatttattattattatttttttgagatggagtttcactctgttgcccaggctgaagtgcaatggtgtgatcttggctcactgcaacctccgcctcctgggttcaagcgattctcctgcctccacctcctgagtagctggggttacaggtgcacaccatcatgcctggctcatttttgtatttttagtagagatgggatttcagcatgttggtcaggctggtctcaaactcctgaccctgtgatccgcccacctcagcctcccaaagtgctgggattacaggccgtgagccaccacgtctggcctggataagtattattttagctaaattgtgcatatttattcccttagagtaaattcctggaagtaaattgctggatcaaaaccaggtatattttaaagaattttccttttctacattaaaaataattataattctgattacaagaaaggaaaattatggagcttcataagaaaaaattagtctcatatttcatacctcatattgcatatttaataggtaaccagtgttaaatttgttgtgtgttttccactgggatttctttttatctcctttaataaaagcaggatcagatccctcagattactttgtaacttgcttttattctactttttcatacctcttagcatgaatgtctttccagaccagaatacagagatttcacttactcatttatgagctgcagaagatgactatgatttattcaaccattctcctattgaagagcatgaatattgcttcagatacttttgttattataaatattagtgcaattaacattttaaagtcttttgatacatattcccaacttgttctccagcaattaccatttttgcattcccaccagcactggggctacttccctttagttgcaccatcatttagcattatttttgatcttgtgccaatctaaaaggcaaaaagtggtatcttgttgttttaatttgcatttctttgattactaattagattgaactttttcatttgttcattggtcaatttgcatttcttcttttgtgaaatgcctgcttgggtcttttatgtactttaccattaaagtgtttttcttgattaaatagattatgtaactgtcatatgttgcaaatatttctgtccatttggcctttgcttatgactttttatgagtctttaggacttttgaggtctttattaggtattcaataattttaatgttaaatatattgatgtctgtcttcctttgtgtcttacggcttttctatttaaggttacgtaaatttctaatatacaaatattggtgtatattatgaaatagggccctatttttctttacaaaagattagtcagttctaaatcatcctttgctatttctagcggcgcttagatgccaccattatcacatcagtgaatttttaaatgtgtaattgtttcctgatctattcatttctctattcctagatacttctattgtaatagctttaccaaatatatctgatagggtgtgtactccccctcattacttcatttatttatttatttatttagagacagagtttcagtcacccaggctggagtgcagtggcatgaacttggctcactgcaacctccgcctcctgggttcaagggattctcctgcctcaacctcttgagtagctgggattacaggtgtgtgccactacacctggcaaatttttttttttttttttttttttagtagagacagggtttcaccatggtggccaggctggtctcgaacttctgatctcaggtgatctgcccttctcggcctcccaaagtgctgggattacaggtgtgagccactgtgcctggccccctcattgcttttaaaacattttcttactgtaatatatttattccaagagaattttcaaatattttatgagattccttgtccattccttacatcaaaaaataccacggagattttgattgaagttctattataagtagttacttggggtggggggaggggggagggatagcattgggagatatacctaatgctagatgacgagttagtgggtgcagcacaccagcgtggcacatgtatacatatgtaactcagctgcacaatgtgcacatgtaccctgaaacttaaagtataataataaaagaaaataaagagaatactggcatggaaaatatgtaatcttggaacttgttgtatctccacttattcaatcctttgtctctcagtagattttgaatggctctttatcccacacgagtctagaatcattttgctaagtttattcctagatataatatgctaattgatatgggaattttttttatctccattataccttcttcttgggtgtagacatatttgtagccagcttcctcactgcatattttttattaggcctaatggcattaagtttattattttggattttacaaaaaaaattatgataacatctttaaatagttagtttcaactcctcctttccccttaaatccatcaattactgtcttttatttcactttccttatgtactgactagaatgcctagaataattgaatgctatgagtaataataggtattcttgccctgtttttggaaatccttctggatttcagtaagtgtgatgttggcttttggtttagtatctttaaatttgcaatttacaagatattttacattggaatagtcattgagttgttaagtaaagcacaaacatgttaaattcagactgaagtacaggacttcaatgaaaagttaaaagagtttatttcatcactttcattttttctttccctcagtggctgtttgtcccctccccccaccccgctccatcccccagcttccttcctttgtgctcttattgttctaggtttgactacataaaaagagactctcaatttatatgtgatacaagaccataactaatattataaaattagtctagaagaagttatttgcaacctatataataagggactaatttcaagattatttgaaggactttaaagattggtaagaaaaaaatagacaaccgtttagaataaggcaaagcatgtgtagaggcaactcttaaaaaaaaaaaagtgagctgggtgtgatgatgcacacctgtggtcccagttactagggaggctgaggcaggaggatcacttgagcccaggagttcagggctgtagtgcaccacagtcacacctgtgaataaccactccattctagactgggcaaacataagaagactctgtgtcttaaagaaaaagaaatgaaaagatattcagtttcattaattgtttgactagctgatttttggaaaatacccacaaatataaccaagcctacaagttattttaaggtgggtaagagatacatcttatctatatgcattcacctatgtgaagcggacacccagtaacacccccgtgtggaagacaagcttccttaaacttcacaggacagtatttcccatgtagtccatcatagggtgaggatttttcaggacctttggtaagcctgcttgctttcattcttgagggtagaggaagggtgcaagacttccctggtctctcccaagcattttggggaccctggccataagcctacttgctcaacaggtgcaaatgactggtaatatgctgaccagatgcaagtgtaccaccaatgatttgctgtgactgagtttggtttcctttgcatatactatccagctttttgtttctaatatattcttccttaagggaaccaggacttcttggggaatccagatgagcttgaaacactgtttttataagagaagggctgttttcaaaaacatctatagttcgtaacaaaggagttagattgaagggactctcactgttcagtctgtgacaagcatgagtgttaaaatggagacaagaattttagttaattgtaatgttgaatttgtaaaaggctataacttcataatatgatcaaggggaacaagcaatctaaaatgtgttaaagtagcattttcaaagtgcggtccagggactctcagggttggtgaggtcacaactgtttttataatattgctaagaatgtatatcactctccttctctccaaggatacggtggagttttccagaagctatgggatatgtggcgatagccttgccctaatggagtgtgtgctttgtgctttgcatttttgtcctttaaaaatgcttggttttaattttgaatacaataattatagatagatataacctacataaaccaaagttatttgcggccctcagtctttaagggtgcacagtggggcctgagactaaagagtttgggaattgatgttctagagaaaagtcagtcttactgatgagggttaatcaattagtatttactgaccgggacaggacaaaccattcattttataaagacacacagagcatttcactaaaatacttttactctgattaagtggtgattttagtaatagtaatgattgtttgattttctgatacctgaaggaaaaagagcctgttgaattgatactttgagggtgttgagttttaggtcactgggtgactgtagaaatggaccaggagaagaactgaaacttgagccttctaagaaatagaagaccaaaaaatgtttagtgttaccctatcccatgaccacaataattgagaaaaaggcctttccgttccctcttccctaccctcccccttctcccctaccctctcctcccccctcccctccccctcctctcccctaccctctcctcccccctcccctccccctcgtctcccctaccctctcctctcccctaccctcccctccccctcctctcccctcccctctcctcccccctcccctccccctcctctcccctcccctccccctcctctcccctcccctccccctcctctccctccccctcttctccctccccctcctctccctaacccctcccaacctttcccctccttctctgtccccctccccctccctccctgtcttcctcccaccccccactccctgtcttcctccttgtcttccatcctcccttccttcctttccttcctgtctttcttttcctttctttcctttttcttctttccttcctgtcttccctcctctccgtctgtctccttctccttgtccccttctctctgtcttgcctttcctttccttctgtctttttctttctttctctttctttttcactcttcctttttttaatttcccttttacttgccttctctctttcattccttccatgctttcttttttttagtggtatgtatactttgtgagcaatcagactatagcttgcagaatagttgggagaggccaaaaatgcccctgagaatgcaagcaaggaacttcttagtgagcatatgaacatcctcactccaatcggaggataacattgttcatacttcaaggactaaaaagctgagagagggtctctgctttctgttacttttagcactcgagtcatttctgcatgtatttctactgattactttttctcctattttggttcatatgttttctgcttctttgcttgtctagtgattttggattagatgagtgacattgtgaattttactgtgcaggatggctgaattttttttctattcctgtaaatatttttttggcattgttctaggatgtagttaagttacctggaaaaagtgacatccttttgagaggcttgcttttaagttttgttaggtggaatcacagcagtctttagccagctcactaaggaccaatactcttctaaatacttaccataatgtcatatgaatttccatgtttttccacttcagctggtaggaacacctgtgtcatctctaagcattgtactgttaattcttctagtagttcttatctggctttgtacatctgctgatcaatactttcagctaaagtctcaaggggacctctgcaaatctacagtgttcactgttcagctttctcttctgtagtaaattgcacagtgaactctagtccccttagccttcctgaacccccagttctccttaactcagggagatcaccaggccccaccaggattcctgtatctgccctgtgacctggagattctctgcaggcaataggttggggcggtcgtagggtccactttgttttcctcctcttcggcttcactgtcctgtgttacctgatgtccaatgtctgaaaactactgtttcacgtatcttgtgtgcttttgtagttttaggtgaaaggtaaaactagtttcttattattccacattggccaaagcagaagttttggaagtctttttttaaggtctaaaacacttctactttgagagtcaattgaaatggtcttttccacaataattattttctgacctatggtttaaagataagtcatgaaaattttatgccactatttttttttaagtctgattatggttaaattcagggggctatttcctcctagattgacagagtttataatgtttcctactcacaataattgtacttctgcttcctctttgcatgtgttactttaatgggaatgtatatttccttttcgttaaggctgccttcaacaatttgtcataaagtcacttctgttagtgaattctattttttctgttactttactctatccttagtaccaaagagctccttatgtgacaccaatttattactaaaatgtcgctttgtttatgttcttggaattcttcatacattgactatcctcagatgtcgaatgttgtaggcctgtgtggcagggactctcttccatttattctatttttaatctaattcttgacaaaataaacccaatttttcttttcttcccctttccatctcacgtagggactggcataaagggcaatccataaaattacaaatgatgaatttttttggttttaactattattcatacatttaagatatggtcacaatttttatttcttactagtaattcattttattttttaacttttaggttctggggtacacgtgcaggtttgttatataggtacatttgtgtcatgggggtttgttgtacagattatttcatcacccaggtattaagcccagtacccattagttatttttcttgatcctctccctttgctcactttctaccctctggtaagccccagtgtctgttgttcctttctatgaaacacaatggttttaattggaaaatttatttttttttcaggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggtaagtactcctcatgggaaattttaatcagcccagtttccttgatatacatgattaatctagacatgttttgagtaaaaacaactttagtgatgttgagatagtttccttctgttcctagtttttgtcgtgagaaagtgttgaaatttgctaaatactttttctacattaattgagataatcatatttttccctacatcctgttaatgtggtatcttatattaattgattttcatatgtttaacatccttgcattccaggaataactccccaatggccatggtgtataatcttttaaagatgctattgaatttggtttgttaatattttgttgagtatgtttgcatcaatattcataaaacatattgttctgtagtttttctgtactgtttgtctgactttggcatcagggtaatactggcctcatagaatgagttaggaagtaactcttgaatgactattttcatgaagaagcttcaataatctgaaataaaatacttaaataatttagttcacctgagagttgtttttagaagcgtatttatttttctattaatgtcttttttgaactatataagaatgtattctccttccactcacacattgatggcaagtgtgtatttgtactctgtggcctgaaaataagatttttttgaataatcttaagaggccatgctttatactctggtaattgagaattacctatttcacagtagctttttctaaaggttaatttccagagaaaagagaacatgtttattaggatatatctcttaatgaattcagtgtatctgaaatttctaaatgacattttcatattttgcatactaaataaaattcataagtacaaatataatgcaattcataagtacaaatataatgcaatttggatttctagaagttatctagttaaaatatgatcttaggatttattttttttgtcttagatttatgaatcttgcttgtttttctgttaattcatttcttcttgtttgctgcatcagtcagatcagagtagaggcagcttgtatagttgatggcacagtttagggttagatggcacaggatagaaatgggtgctagacaaagagcagtcacagaggcatgttagaaatttccagttccagcatcattgatgaagaaaaccatgaggacccaagttgatcaaaggcagccagccaataaagctatgctcatgcgagatgagctgaagtgacattacattaaaattggaagaccctcttactaagtggctccatgcttccctgctagcccctttgggacttccaagaagacttggttatttcaagaagacaagaacccacagaggctgtagtttagtttatctctctggaaacatagagaatatgtataattaaataaaagcactttaatagtgaatcctttacagtgttatttgaaatttatgtcaagtgatttaaaaagtaaaaatgaaaattaataatttcagtggaagtaaattgattaacatgaccaggaatacataaaacttgcatggtcttgtctataaaataaggatatgtcatttaattaggagagtcaaagctcattcttgcgcttaaggtctgaggaactcttctcccatggggcttatgaagggctacactgaggcaacttcctcaatatatctcagccataaaaccaagagaaagtaagaagcagaggacatcacaacaaagctcaattcagtaaaagcaattttataggagtagagggacttgtcaaaaacaaaaacaacaacaaaaaacaatgtccaaatatttattcagcttaatgagtgatgtttttgtttgatctagggttaaaatctagacaaattacagagatgaataaactacatatcctttagtctaccatcctctgaaaatgttactttttgaaactttgattttgataagagctggaggcactcagggagtcattctctggcatggtctttgagtacagagtgattttgctgattaaaagcaaatagattgacttttaaaatcaactcatacaaacaaactgttaaaatcctctaatgagagtgaagaaacctaaccaagactgactgatacattactgctccatctctgcaccaaagtggactcagggaggcctgtaggagatgccaactccttatcctactccccacaaagacagttcttggctatcttcatcagacacaaatgaatggttgaggctccaaagctctctaccaattcttgtgttacactggcacttttaaaaaattttgtttattttttatttttaaatggagtctcactctgtcaccctggctggagtacagtggcgtgatcttggctcactgcaccctttgcctcccgggtttgagcaattctccctgcctcagcctcccgagtagctgggattacaggcacccgccactacgcctggctaatttttgtattacttagtagagatggggtttcgccatgttggccaggctggtcttgaactcctgagctcaggcaatctgcccaccttggcctcccaaagtgctgggattacaggtgttagccaccgcacctggctggcacttctcttaaaactaatatctcaagaagttttttctttaagaatcttctttcaattgcaggtccatgtagttctggtattcattaaagtgcctatcccaggggttttggtatgttgtgtttcaattttcatgtttcaatttttttgatttatgcattaattttgttttttcagaattcaggtgcaggttgtttagtttccatgtatttgtgtcgttttgagaattcctcttgttcttcatttctaattttatttcattgtgacctcagaagacacttgcattgattttgattttttttatcttattgagatgtgacttacgactatgtggtcaattttagagaatgttccatgtacagatgtgaaaaatgtatattttgtgttgttgggtggaatattctgcagatgtctgtcaggtccatttggtcaagagtctgatttaagtccagtgtatacctttgttagttttctgccatggtgatctgtctggtgctgtgagtggggtgttgaagtcccccactattattgtatagctttttttccccataggtctagtagtatttgttttatgaacctgggtgctccaacattgagtgcatatttatttaggatagttaaatcttctggttgaattgaaccctttatataatgccctcctttgtctctttttgatgttgttggtttaatgtctgtttcttctcatacaagtatagcaacatctgttcttttttaattttctatttgcatgctagatctttctccatcccttcactttgagcccatggttgtcattacatgtgagatgggtctcttgaattcagcagaaggttaggtcatttaaaaaatctaatttgccactttatgtcctttaagtggagcatttaggccatttatgttctaagttaatattgatatttgaggttttgttcctatacatttgatatttgtgtattgttaagtagttgctttctagtttgaattgtgtaattgctctataagatctctgagccttgtacttttgtgtgcttatatggtagcaagtattgttcttttgtttccatgtttagaactccttggagtatttcttgtatggcaggtgtggtggtaacaaattcccttagtgttttcttgcctgggaaagactttatttctccttcatttatgaagcttaatttggcagattatgaaattcttggctggcattttcttttttctttaaggaggctaaaagtaggcccctgatctcttcttgcttgtaaggtttctgctgagaagtcctctattagtctgattggatttcctttataggtaatttggcccttttctctagatgcctttcatattttttctttggtgttgaccttgcatagtctgatggactatattccttggggatggtcatcttgtatcttgcaggtgttttctgaatttcttgtatctggatgttaacctctctggcaagattagggaaattttcctgaattattgcctcaaatatgttttccaatttgcttacttcttcctcttctccatcaagaatgccagtaagtcataggtttggttgctttacataatcccatatttatcaaaggctttgttcatttttcagattctttatgtttgtctaactgggttaatttgaaaaggtggtcttcaagctctgaaatcttgtcttctgcttggtgtagtctgttgttaaaacttccaagtgttgttttgttttgttttgttttgttttgagatggagtctcactctgttgcctaggctggagtgcagtggcatgatcttgactcactgcaacctctgcctcctgggttcaagcgattctcctgcctcaccttctggagtagctgggattacgggcgagtgccaccacccccgactaatttttgtattttttagtagagacaaggttttgccatgttggctgagctggtctcgaactcctgaactcaggtgatttacccatcttggcctcccaaagtgctgtgattacaggtgtgagccaccatgcctggcctgcttccaagtgtattttgatgttccctttagtgaatttttcaattccaaaagttctatttggttttatcttaatatggctatctcatgtttcatatcctgcattgtgtttctggtttatttgaaatggattttaaatttctcttggctctcactgagtttccttgcaatacatattttgtttttttagtctgtcatttcaaagttttcaacttggttaggatccattgctatagagctagtgcaattctttggaggtatgaagacactctttttgtagtgttggagttcttgggcagattccttcttatctgagggagctgttgattcttatttttgaatttcctattggttgggcgggacttaaactttttttttttttccccttgagggtatgactatggtgtatgttgtgtgtgatcattcaactttgtttctgggtgctttcagggggccaaggctctttatggattccttgggcgtggtagctttcttaaatgctgcttattgtagcaatgtattggatttgtgagctgacactctatctcatgtggggctgagggtgcagaagtctcaggaagcttattttgtggagtagtgctaagcctttctggtagtgggctttttatttgatagtacagttcaggctgcaatccagtagatggcacttaaaaaataagaaccagcttgccctcagttaggctgatgtccagtagaagcacctgtcctgacaggggagtgacaggaagagattctgttggtgtgtgccgaggcctttggggtcgctggttggggggagatagggggaggtgcactagctcctcatgcaggaatgtgatctgcttttctatcataccccatcagagggctcatgaccttcagttcataaagattttttccttgggttcccagccatagtctgtctgtaggttatgcatatgcccctctgaaggcaaccaccaaaatggtcttggggcagagcctcttcccccagtctagggcagacaactccatgacttgtatgtcctccattgctgggacactgctgctctgtgtagggatggggagttgggccccaccctttatgtaagcctaagtggcattctcactttcagcaggggtggagccatcttgaaaaccatgaaaaactctttcttcgagtacctgtgctggcccccagtgggaagaaccactgctgcgtcttcaacagcgtgtggggtgggagggtattgccacagatgaccccctctccatatccgttccttgacatggtgttgccccctttagcgattggcactgtgcccacctttcctttgtcccaaaggggttttggcaagttgtgtccctctcccttataggtggcctacactaggggggttagatctctagaggttccatagctccctgggaacttgctggccccctgggcttttcaaagtcagaacaggttatgaggtatgtttgctggggatctggtgctacagagactcaagggtagagaatccctgggcagagcagaggcccaccactggtgcacaagcaatatggtgaccaccatctcagtttgtgtctgaggggagtatgggaacccctgcaggagctggccacccagttctctatccctgggaaattcctaaattaccaccaataacattgccctgggtcacaagggtggggccttgaattctttgggggttgatctctgccagactctagctacttttcctttctgcaccccagcttcttcccatgggcactccaaaaggtcctggctctctttccccagttttccattagaaacttgtccatttgacagtaactttgatcttctttctaagaagagctggcatccaaggtctgtggtcagctatgttggaaaaaagaaggagaaaaaaactagtttgtattaaattctgaaagactagtggcactggttaagtctttaaaggattgttaacaaaagaaaatctttttaaaccaaactcctaattttatcagaattgtaactgaaaatataaatgtatgaaaacataggtattatgtaaaatttgctcaataaaagaataggaaaaactactatttatcttggactgatagcatgttagtttgagatttgaaccctttctactctagtaagtagtggtgggaaaaattcactgtaggagtctgcagacataacaaactatcattagactgccaagacctccacataataaagcaagcagagaatgtcaaataagtatgtgaaaaatgatcaaaaaagagaaattgaaaatataaatagggtgctattaaaaaaggatagcatttatgttatgacatatgtacacatgaatatcactttttagaatttcatccttcttaggacttattcctgagtccgaggattgagaggttctgataaaataagtctcagtgggttccaggcatgggctttctttaaaagtctctccagggattctaatgtgttgccaggaccaagtaccatggacagccaagatctcatcagcacagtttgattgaatgaacttatgtagaaccctgaatgccacacttaaccaaagaaacctttccagggattaattataggtgacagaacatgctatattcttattaaatattattaaaagttaagcaatacccattcctgattcatgtaaaattctcacttattttccaagagttttactgtatgactggtttatgggatgcttggaaaaggttgacagacatggcaaaggttcctgcagtgtttctctttgtccatcaacagccctagctcataacctctaccctttcagctaaaagcaattagctcttcagaagtgattcattctatttatacttgggataagtaacatcaggcagtcttccctagggcttctcacgggccctggtggcatttttattctaagagagggttatatttttacatgtaattggtcataattatactaaaaacaagtaattggtgtcttatacaagaaaattatatttctgctttagtcattgacagagtatcctgagaataagagttaagaagtatattcattgtcatcttatttctgatatatttcaaattcttttgctaggaagaagcccttttgactgtgctttgtgtaacaaaacttcttcggagaaacaatttagataaactttgtcagatcttatgtgattatattcaaaatgctaattgaagattctctaaacattttcagtaaaatgttgaattgttttcatgctgttaaataagttaacatgtcttcctttactaaagtcattattataaaaatgtaaatcctaatgataatagctgatgtttattaagcatttagtaggttccattttttgatagcaacttttatgaattatctcattaaatcttcataataatagcatcaagaactacaaatatgttttcatgtaagaagggaaataaaattatgagttttgctgtgaggtttgaagaatgaaaacaatgcatgacttagaaaatagtataattaagtgaattttattatcattatcatctcttagtttataaatgaaaaaactaaggcttacataatgtaaaaatcagttaacaaggttaaacaaccggtagatggtagaggaggagctgggaataaatctgtacatgtctgaatctggagcaggaacccttaactgatgtgtcattctagcaggtcatcagttactctacaatacctattaagtatactttatttactgtgtttagatttatagtagatttagactctactgtaaaaacaaggacttcatacacctgctagaaagtatccatatcatcttgtttgaaagttgtcccgctctagtgttcttttctaatcatgatgattcagaactccaaactcttgaagcagggcaacccgtagggtcagcattcataatttctcaatacttaaaaaagtttcctcatgactgttgctattattgagatttctcaaatgtcttggcctgaattgggtgtgcactatgaaaaaaaaaatggcagacatttctttttgttaaaggaattttaaaaacacatataaacacactgatttgtgacagattaccaggctttatgtttagcagggtttcctaagcaaaacacaaattctgtaaatctacagaattagataaaacattgactcaatccttagatgagagtataatggattatcacttaataacttctgtcactgaaaataaatgatgtaaaaagtaataaagttctactctcacagtatgaataaataggaaatacataatactttaaattaggcaacaaatcattaagcccccagcattcattagactatcattaatgataataaaattgtgtggtatttatacagatattatatgtaactccaggaattttgttataattgtgtatgaatatatttgttgtttgaggcaggtagatggatatttgcagcagctatgtgctgaagcattctggtaatagttttcaaatcaaccatttttttctccttgtcgatcatctttaaagcaaaagcaccgttttttactatattttttgaaaaaaatacattaggtgtaaaattatatattttgaagaagttcactttctgtttttactagtttcacacctttgttattttttcagtggaaggagcagagataggcaaaggcgaagcctgtgtgtgtggtcaggttcctgggcccttcatagcatctgatgccaagctgtgttctcttttgtgtcattgccttcccacttgctaattacgtgacagagctagggacttccctctgtctagaatgccccccatctcttgtttgcctagtgaaatctggtttgaagttcaaggtctgatacaaaccaggtgatcctctgcaaaactaactgtacctgagcaaaccaggcacttactcttttatatgttcctggcactgctgatactctgatagaaaacatcatcacttaatgctaactgtgggctcacaaaggggatacttctactgtaagaagactgtaactcttcttagcacagagattagtaagtacttgaaacagagtttcacatataataagtgttcaataaattttattttttatttctaacacttggcacactgcatagctcagtaaatgttggtgaagtgaactgagtattctccttatctattatgtggtaggcattattctagttgcttctgttataaaccaactcatttaatccttatcacagcacttttattgtggtcaatattttttaatcctcacagatggctaaggaatcagcactctgagagattggttgacttgctttgggtaaggtgcttataaagtggtagaacaagattcctatccaggccttctgattcaaaaatacattctttttttttttttttttagtagtgttttctggaaaggcagggtataactgactatgctgtgtatttgggactaagtatattattgtcaagtatattaaaaatgtcgcaacactggaaaggagtccatcaatgggctatgcaggttgagggatttgtagatgagaaactgataaatttggttagcaaggaaagccatcaagctgtgaaccctttatattggcaaaagagagggtcctttgaaatctaagggaacagaactttcctgttctccaagtttggagcagaataggtaagctctaggcagtctaatgcccaacttttaccagtggtgttttagttttttttttttttccaaaaggaaatgatggaattctttatatacttctgaattgtctatcttttcaaaaataaaaattttcattttgcagtacatacagaatcaaaagactttcaagtcctaactccacaaatgtttattttgaagctctttaaactgtttaccacggatattagtaaatctgtcagaaatgaggtgacttacttatccttgtcccaccagatatgtgggaaggatgatcacgctagatagcatggatgggtcctctatttatctctttttacttgaatggaaaacacatcattcagattaatcaattagtcattgtgactgatagaatttttatatggataatctgggtttggtccctagctttaccacttacttggggtctttatgtcttctatggtctcctatctgtaaagggaagttgataatgccaatctagctaggttactgagatgcttaaatgtgtaatgtatgcaaagcagcaggtactcaataaagggtaactcttactattattgtatagctctccaggtatgtattgagcttctatagaatccatagccccaaactctttagccctttgagaccaagattaagcattgtctttccagaggagagggtgagagagattgccattatactaatagaattcatcattatcaccgtcatcatcatcatcatgatttcttggtgtgtcatggaatgtactgtgtttcacattaccaacagatgttaattttcacaacatccctgagacaagaaactatgattacattttacagataaggtcatgcagctataaagttgtgaaattgggattcaaactcaggcagtctgtccccacagtccatgttcttaacccaccatgctctcctgacacttgaaaagttaggaggcgtactccatagcctgtaatgttgctgcagagagaatctaattttaaatccagtgaagcatattagttgctgtctttgatatgccattcagattgtgctatccttatgatgcctaccttggttgtatatgtaactgggcgtcaaatatataaatactcaaaaagtgataggtgccaataaaatattttatagttaatacttatgtaatctgtgttctctgtgtttgagggctggttctaaaatactgctctatatttgacttctggttaaaacaataaactttgctcatattagttatatagttgataccattctcatgttgctaacatgtctgtaagtaacagttgaaattgatctggcaattttagagctgtcagacccaggagatgagagaaacatttaaaatgtttataacattaaatcagctgagtcaagagagagaaagagaaagatgattcagatttcttgtactggtggatgtaagtgcttggaactgaaataaaggagaaggtgtagggagggagaaagataaagaagtcttccctttatacaagttgaaattgagttttctttgagatatagaggtgaagacattttaagaaacttcttaaaactctctaatgtggcttttcaacctgtttccatcaatttggcacatctcacttttcggcacaacagaatattctaggtttatctcacaccttccttgccccagcccaggaatcagccatttctctaagaaactcttgtttattttggtggggaacagtattgggaaaccaacatctgggagctaaatatactcctagtggttaggaggtcataccttgtagactcttgtagctgacggagttaggacatatttattagaaatcataagtttatattgatcttgctaggatctatccaatcctacaagattcttccctgtgtctctcctttgtatttgtgtatcctttcttccatattaagaactgtggctcccaacaacaaggcatgtgcccatttgcccaatcgtatgatgtataaaaactactttgagaaaagtggcagccaaaccactaagaaaaataaacttgctgaaatgagttcaagatttattggcagctctttttttggcccctagactgaaagtatatatttcaagtattgtgttcaaaaattatttgggttagctttttccacctttcataatagtaatattatttacttgaaatacagttggctttgtttctatattcagtttttttctctctatcttcattaatttcattatatatatttaatatgtaggacattaacatgtttccaaaagaagaaaacactccttcctgtatcatttccacctcatctctcttaccccttataggtaaccaattgcactggtttctagtttatcttacttatattcctatttgaaaagttacctcatatatgtatgttttttaaatttttatacttttttacacagaaagtaacgttcagtatgtactttgccactttccttttaaacttaacagcgtatactggaaatcactccatatcgtgtcacagagagcttccttatattttttaatagctgtataagacttcattgtgttgtctgtaccatattttattcacttccccatgtgtggacattttgactgtttctagtatctgcaattactaataatgctgcagtaaactttgtgcatatcgtaccttggtaaatttctagacatagatttctgggttaaaggttaagcacatgtgtagttttgttagatattgataaattcctttccatggggtttatatcatttttaaaatatttaccagcaacgtataacagcgtccattacttcaaagcctcaccaacagattgtatgttttaagtacttttatgttttagaatttttccaatgcgataggtaaacaatggtatatcaatatagttttaatacattaaagttcagcatcttttcaagttcggctagtctcagggctattcttaatatcttgtgaattatcttcatattattttcccatattccataatacttttggttttttttcctcctcaattctgacaagttctttatatttcaggaatattagccattttatttgatatgttacaaatatttttctcccaatatataacttttctcttataacgatttttttttcatgaaaagtttttaattaaaaccttttatgggcccaggtgcagtggctcacacctgtaattccagcactttggaaggctgaggtgggcagctcatttaaggccaggagttccagaccagcctgaccaacacagtgaaaccctgtctctactaaaaatagaagaacattagctgggcttggtggcacatgcttgtgatcccagctactcaggaggctgaggcatgagaatcacttgaacccagcaggtggaggttgcagtgagtcaagatcgtgccactgcactccagagtgggcaacagagtgagactctgtctcaaaattaaataaatatataaacaaaaccattatgggccaggtgcagtggctcattcctgtaatctcagcactatgggaggtcaaggtggttgaatcatttgcgccaaggaactggacagaccagcctgggcaacatgggaaaaacctctctctaccaaaaaagaaaaaaaaaaaaattagctgggtgtggtagcatgcaccagtagtcccagttactcgggctggtcacatgagcctggggaggtcaaggctgcagtgagcagtgattgtgccattgcactccagcctaggcaacagagtgagaccatttctctaaatacatacatacatacataccttttgtggagttaaatttacacactttttctttattggctctggcttttgcattgtagtaagactttctttacactcaacttatagataaattcacccatgttttcttctagtacttgcatagttgaattttagatctctagtccatttggagtttattttttgtatggtagaaggtattgatcctattttttcccaaatagttgttacccagttgtcccaaaacaagttattgaaaagtccatctttgtcccagatagactggaacaaaatgaattaaagacttaaatatgaagatttttacttgtgtatcctttcttcctagaaagaaaacataggcgtaaagcttcatgacgttgaatacttcatgccattggtctggcaataatattactattatgaaaggtggaaaaagctaacccaagtaacttttgaacacagtacttgaaatatatactttcagtctaggggccaaaaaaagagctgccaataaatcttgaactcatttcagcaagtttacttttcttagtggtttggctgccacttttctgaaagtagtttttatacatcatacaattgggcaaatgggcagatgccttgttgttgggagccacagttcttaatatggtagaaaggatacaccaatagaaatatttatatttaagtctggcaatcatttttaagatgtgaacttgaacaggcaacaaaagcaaaaataggtacgttggattacatcaaacccaaaagctcttcacagcaaagggaacagtcagttgagtgaagagacaacctatggaatgggagaaaatatttctaagccacacatctgacagagggttaatatccaaggtatataaagaactgcaacaactcaatagcaagaaaacaaataacatgaataaaaaatgagcaaaggatctgaatagacatttctcgaaagaagacataccaatggacaacatgaaaaaatactcagcatcactaacaatcagggaaatgcaaattaaaaccacagtgagatatcgcctcacacttgttagaatggctgttatcagaaagataaaagataagtattggtggggtgtggagaaaaaggaactctagcccactgttagtgacagtgtaaattagtatagctgtgatggaaaagagaatggaggttcctcaaacagtttaaagtagaactaccatatgatccagcaattccacgactgggaatatatccaaaggaaatcagtatattgaagagaactgtattttagtgattattgcagcattgttcccaatagccaagataagggatcaatctgagtatctatcaatggacaagtgataaagaaaatatggtgtgtatacacaatgggataccattcagcctttgaagagaaggaaatcctgtcatttgccacaacgtggttgaacctggaggacattagctgagtgtaataagccagccaccaaaagaaaaataccacatgatctttcctatatgtggaattttaaaagttgaactcaaggaagtagaatagaatggtagtgaccaggggtatgcgataggctgagggatcaaggagatgttggtcacgggatacaggatttcagttagataggaggaagaagttcaagaggtctattgtataccatggtgagtatagttaattataaagtatacttgaaaattgttaagagtagattttctgttcataccacaaaatgataagtatgtgagataatgcatatgtaaattggctcaatttagccatttcacaatgtatatatatttcaaaacaacatgatgtacatgataaatatacagtttatttttaattaaaaattttaaactctctaattggtcttcaacatatagtacacaagtcttttcacgactctttataatggaacatatgttcttggaatgctaaaaattattttttttggaggccctgcaaataactaaaaatttatcttaaaagccacacctaattacttacatatgatccagaaaggatactttgaaaaagctttttaattgataaaatcattaaggtaaaacatattcataaaagtgttctctaataattttataattttctagttcatgaaggattaaatatacaactatcatttgaattggattttttatgaggttaattgtatttaaatgctaattattttaactaattttgtggttgacttctatgtagagtagggaaaaagaatttcctaaagccagttacgtatatctctttttagtctggatttttaattaggaaaagtgatatagttaaataggtctactctatagcatcttctaaaatgagtaaaaattcattatatcaggataaaaaatgataaagatatatggatgacacatttggctgaatttttcttcttcgctgttctcttgctctctatttaaatagtcttagctcttttatcatttaaattctgaagtattgaggtgattattccggcagcaggtgattctgctaattactgttcagtcagttttagctattagaaacagagatatgtttacattgctgggctgcatgtaaatttagaagttacatggctttgtttttactttgacttacggcattaaaattattttcatctgtgtatgtaaagatctgcatctataagcttttgtggataataaggtgaaattgatgcattttaatataaattgccaatataaaatatctctaactcagacctctactggaaagttgtcaaatcttatgtaggaaaggcttttaccatcactgttacacattaactgggcatagtttaatattaatagctcctgagacttgtggttaactgaggtttctatttcctgtgtttgggttttatctttgcaacaacttggttgcttttctgtgtaaaatagtggtgaatatacacaagagtatgacaaggttctgggctcttaactttgatgaacaccatgccatttccatcatgctgcactcaaaacagcacagatgtgagtctgggagtggcgtccctgccgctctcatgagcctttgtttggagaacaccctgattaacccccacccttcacggttcattgactcactgatagatcaagtttaaactagtatatattagcacatttgttaccaacagaggaacagttggccattctgttttacattgctggttcattgcaaactggcgtgctaaaaaggtctgtactctagagtatgaattgggaagttaccaaaggactgagaaccaagtcagttgcatattaatgttgaattatacctatattttaatcttggattgtctacttgggggatgcttacactgttgtcaagttatgaataagtgataattaccactttgaaattcatctttttttttcaaggagtttaggggatttaggtgtctcaatatagctttcatattaaacagtttgtcataattggatgagagcagagcaaggtcatgactacctgatgccttgtgttggagcattttaaaaatgttttccagagagttatttgtacctaatgactttacataagtccttacattatactttatttctaggtcacctaaaaatgttaattgtttagtcaagagggttaggatgtgtgtctgttttctcatgaaaaaaattaagctgttccctttttatcaattttcttgcaatctaaaggcttttttttcttaccttcctaacctagtgactaaggtcatcttattgttacagttcctttcatgggagataggtttactgcatcatttggcagtttcatagggtgaattttgtcttggcttcatctttccttactggttgtcatcccctgggccacctgcttttttgcattttcctttctcttgtgagatgatgaagctctgtgccccgatggggatgagagacagcactctgagttcaagtctaggataaggcaatgggcttgcttttcaaaacaaactagtgtcatacgggctgctgctttcaggtccactgtctgattttatcactgatgacttgtttctggaaggcaaactgatttaagttctgagcaaaagggtcggtgtttattttcaatgctactattaatttagagttttaatttagaaaagattttttaccagttctcaaatatgatttttctattgactttaagtttgtagatataaggagtagacatgagatagagactgaattgcttttttgtttttaaaacttggcagtaataaggggttgcttgttttttcatgctaaatattttttctaagggatctagatacctatcagaaaacttaactttgataactctggttctttattaagtatttttgtcttattttaggaattaatagaaatagttgtaattttagacttcctttataaaataccaatttaaagagaagctttttgcttaaatgattgttttgcagtgttgtgcttttgttttctttaatgcagttgaaatcgcagctttataacttattttttaatttggggtttttaaaagaatattagttatttatttatatttattgggcacctactgtgtgccagacactattctaggaactagtaaacatagcagagagcagaatcatgaagttcttgacctcaaggagcttaaatcctagtggtagagggggaattcaaaaaaatcaaataaatgtatttctattatgtcaagtgatggtatgtactaccaggcaatcagatgaaaatatttcctcttctatacacagtgggcaaggaaggcttcattgactgtggagttttagaagaaagctgaaagtaatggggaaagagagccatatcgatatatgaaggaaaacatggtccaagcagaggaaacgaaaagtgcaaagaattgagcaagaaagtcatgttcaagtggagtcagcaggggaaagagtaggtcacaaatgcggctgagggtgggtcatgaagggccttacaagctttgtatgagtttttacttttattctgaaaaaaacaaaaacaaaaacaaaaaaaaccggggagctatttggggattttaatagaaaagtaacataatttccttttaaaatggatatgtggccactaagtggagagagtggtgtatatatgagtggatggaataattgatacaggcaagcaggagacaggttaaatgaaaaatggattaatccaggcaaaagatggtgacttaaattaagctgggagtgggagagatggtgagacatgcttagactttggattcatttttccagatagaactggctgacagagacatgtcatttaccaacatagacatggcagattttttttttcttttctgagacaaggtcttgctctgttgtccaggctggagtgcaatggtgtgaccatagctcatggaagcctcagactcttgatatcaagtgatcctcccacctcaacctccctagtagttgagattacaggcatatgccactgtatccagccaactttttttttttctgtagagacaatatctctctgtgttgcctagggtagcctttaactcctggcctcaagcattcctcctacctcagcctctcaaagtgctgggattataggagtgagccaccatgcctggccaatatggcggttattaagaggataagtcaaagattacatgaatattctgttatgaaaagtgtcaaacatatagaaaatataaacagtattccagtgggcacccatatttttatcaccttgattctacagatcttaacatttttctgtatctgcttcaaacattttattctgccaatgtgttctaaagtaaattgttgatattgtgatagttctctccaaaatgctgcagtgtgtagctctaaaaatagatatttttcagataaccaaatatcattaacctgccaaatcaatgaatgataattgcttattaacatttaatacttggtccatagtcaaattctccatattttccataatgtcttttatagttaacttttaccaactagtgtctgatcaagaatcattcatttaactaattacatttaaactgtaacattacaacatgttttttcgtatgttttattctctctgacattgacttatggaagagactagattatttgtcctgtagacattttatcatacataagagttactaggagagctctgattactagtccccactctcagaaattttgattcagttgctctttccagtgagctgctggtgatgctggactttcattctgaagaccatactttgagcactactgctgtaccactatccgatggcttctttgtgatatcgtttaacttgttgttctgttgcctgtatttcctctaaactgaattttcaatctaaaggcttactgagattcatgtttgatactttgggcaagaatacttcataagttctagtgcttaatgttaggtagcacttaattctgactatttcactattcatgaggctaagctaaggaggtgacagcctgatccttctattgtaatgtttcatgtgaaactactagataatttgttgagttggggggtgggtagggaagagatatctagttttcaataaatatttcacctaatggttttaacacacattgatcatccttgcctgaactaattatttaattagggatggcaacatggagactttctaattcaatctttttttttttttctaaatgaatggccttgtttttatttttaaatggatgttacttcgcaactggggttatttgattacccagaaatatagcgcatattaaaaaggtaggataaatgcttagttaactaattaagcaatttttaattaccagttttcacagtaaggcactaaagtttctgacttgagcaaagataaagtggaaagataaagtggtcgtttagtgagatgggcaagactgtggataggtagactaggtttggtgggaaagtcagaatatcagttttgaatatgttaagtttgagatgtctattagaaacatatgttgacgaggccaggtgcaatggctcatgcctgtaatctcagtactttaggaggctgaggtgggcggatcacctgaagtcaggagttcaagacgagcctggccaacatgtgaaaccctgtgtttactaaaaatacaaaaattagctgggcttggtggcatgcacctgtaatcccagtaatcccagctacttgggaggctgaggcgggagaatcacttgaacccagggggcggaggttggagtgagccaagatcccgccagccactgcacttcagcctgggtgacagagcgagactccatctcaaaaaaaaaaaacatatatatatatatatatatgttgacaatatttcagttgaataaaataaaatattctagctattttaggtagaaaggcattttataccgatactactactaaagggtaagaagatatgactgtagtacattaaatatgctgatggcctacaactgttgctgtgttgctttttcctcttcaccacacatatgcagcctcatgaaacattttccatgaccagcacactgaaggaaataaaaggaacctagtttagagatggttctgcatgatacaacaaaaatgagctgctaaagcattacaatcccactcaagagtattcccccatcaaatagtggggctggtattttaatcagttgatactaattgtcaaggtgtgatggccaagggattgatgtttatcagtgtatggacagtggttcagagtttggtgaattagtcgagttgaaagagaaagattggtgacaaagatgtatgaggtggaaagtatactttcacagaataagaacagaaaatgagatttatgtttttttgtaaacgttcaacaaagaaaattcattcagaggaggaaataggtaggcaagatgccctattctacagatgttagtcagcatcactgcaaagcaacctcagggcttatgcagtggacacttaaaatagcactggtgcagggatgggagaaataaatggatttaataagcactgctgcttaccaaggttgattgaattgccactattgccaagtgttctacctgcaaacagatcaaccttgagccctggatatggcaccatgtcccagagcaaccagccagccacctggtggcaggttgattgcattggatttgctccattatggaaggtcagtggtttgtcactgctgcgatgaatgcttactgtacgtttggatttgcattccctgcccaccatgtttctgtcagcaataacatggccttattaaagccttattcaataatatgacatcctatataatattgcttttgatcaggagactcattcacatcaaaataagtgaggcaattggctgtcaactacaggattcactggtcttaccatgttcctgttgtagcatattgtattctacctggaagatgaaaccttgtgacattaaagtagtttttagttccataaacataatacaggggtctatgaatcaagaagtggaggtagaagtgttgtcttttacttcacatctaatcacatgttcaaaatattttttcatcttgcctctgcaactttgaactttgctgacacactgaggttttagtgtgaggaaacaatactttcacatgggaacatgatagtcgttcaattgaactggacatttagaataacctggccacattactgaactgtataactgaaacaacaaatgaaaaaaatgaagatgctacgctggcaaagatgattaattttgattattgggagaaatagtattgctactgttaggaggaagactatatgtctagaaactaggaggaaacctgggttgcctccttgtagcagggtaaaatgagtgagtaccttgtctaagaaagggaacatgaccaaactgaacccagaagacataggaaatctaaacagatcaattaacaccaaagaaacgggcattttttggtacttctaaaaaagtaccagactgatattttcacagagatgttcgttatacccttaaggaacaggaacagaaaacttctatactatttaaactattttagaggatagaaaaggaaagaaaactccagattttatttatagaacttgcatgaaattgataccaaattctgacaatgcaagttcaaaaaggaaaactagagatcagtgttacttatgtcaaacagctcttaatagaatagatggatatggttatcaacatgataaatatgtttatcacattttaaagcctacatggagaaacatttgaggttttcttattctagaactgacaggaatgtcctttattatgagcactattagtcaaatttttctggtggaactaatgtaagtagactgctgaagaaaatgaatggtatgaacattggaaaggggaaattaaatgattattatttacagataaaataattgttaagctggaaaatccaagtgaataaagggaaggcctacaattaagcagttaaggaaagggctaggtatagaaatcaatagttttgatatatgcaggctatagccagttaggagatcagttaggggaaaaacacgttgacagcagcaacgaaaagctgataaacctagaattgttcaccacttatcttaaaatgtttaacatggtactgagggacacaggagattatttatgtggaaaaacataccatgtttctatacagaaaaattgaacatcacaaaagtattatttgatcttaagataatttatatttaatgcaatctcagtgaaataccaggagaatgtttttaagctagacaaacttatttcaaagatcatatgtaaaaataagcaaaaatagatgtgaaaaattctttaaagtaatgagagaccagtcttattgactattaagtcattataaaactataatgtttaaaagatggtactgacatatgaatagatcagtggatctcagatgggcagtgcagaaagagatccaaacacatacaaaaatttagtacctctaaaggtggcatttaaaatctgtggggaaagatggattttccaatgaataatgttgggataggtagatagccatctggaaaaaatgaaagtcaaatcccaactttttaccttttatcaaaatgaacttcagatacaattgaaaatataaaattgagaccataaaagtattagaagaaaaatgcagtttttaagtctcaaaaggggactcttaaatatcatacaaagcccagaggccataaaagagatgattgataaattcaaatataggtccgtgtaagcgaaaactttcagtatggagaaaacataagttattaaggcaaatgacacactaggaaaagcatttgtaactcataacaagcctagttttcttactgtgtaaagtactgccataattgacaaagaaaatatgaagaattggcaagtgacatacatagaaagttcatggaaaaaataactcttaaacatttacaaaattttacaacctctcatgaaaagagaaatggaaattgaaattagagtcacatacagtatttcacttttcatttgtcaaagatcaaaaagtttgaacatactgtgggtttatgtttataaggatgtaagaaaacaggcaatctaaattccttgtagagtgtaaattggtagtaataagagaaaaatttactgaatactttgtgccaggtgcttttctaagcactttacatttaattatctcaattaacttatccagaaagtaccattatttctgtattacacgtgaggaatttgaagaaaagttagacaagtaattcaaagtcacacagttaataaatgacagagtgaagatttgagaccatttcctttttctcaagtgtccacttttggtcgcaactctgctgtttctgtagtgagtgatttaacactatatgataaaaccttaagagtacgtactctttgatccagtgattctacttccagaagtttgtccattttgcatcaaatagatggagaatagcattcattgcattgttatttgcagtaaaggaagattggaaacaacctgaacatttatcctcaaggactcatccatacaaaagaattgaagtaaattcatccagatgaatatgaggcagctttagatagagtgagatggcatcctatgtagtgatatggagtcatctttaaaatacagtaaaaggaaaaagcaagatacagaatagcatgtagggaagctgctgtctatgtgaaaagctgtagaatatacgtgcatttttgtatatgcatagaatattcctagacaaggacaaacatggtggttcatacctgtaatcctagcactttgggagactgaggcaggtgattcacttgactccaagttcaggatgagcctggccaacatggcaaaaccccatctctagaaaaaatataaaaattagctgggtctggtggtgtatgcctgtggtcccagctacttgggaggctgaggcaagaggattgcttgagcctgggaggcaaaggttgtagtgagccaagatcatgccactgcactccagcttgggtgacagagcaagacaccattcatctctctatctcttttctctctctctctttctctgtctacacacatacacatacccccccacacacatatatatacacacatatatgtgtgtgtgtatatatatgtgtgtatatatatacgtgtgtgtatatatatgcgtgtatatagatacatttctagaaggattctcaaagtgatatcagtgattgttgtgcaagaaggaaactagatatcagtgaatgcgctaaataaggtgattttgaattctgtagcatgtgtatgatttacctatagagaaagcagtctagcatgagcgtgggtttctcaaatatagaatgtttgcagtgaggtcacttggtgaaaagtatagccatgtcagacagatgtaggttcagattccaggacttccaggactgctgaaagggaaaggggctttggatctccttcagctccaggcagcattgctcctttcccagctttgacattagctggagggaagacaagttcttagagctctatgtgcttgggacaagaccccttccccctactgccttactcgccaaccataactgctgcaaacaattcttacctcttccaccccatgtcactgcctaaaacccttcatcacctggcctcccatgcctctaagtctctgtacatcccctagcctgatactgtccccaaccctcctcaactccagacaccattttactctaccctctggaattgtccattattagcaaaatctcctttattttcaacctcctttctaagtatttcccccacattcttgttgtaatagagacacagctttcccaggactgtatagctttccttgcagtcctctaaagtggtaactggtttctctgccatacatttcataccactggtcctggagatattgtcaatatcttaatgtcttccttccatctcacttaaattttgagaccataattcctttttcctctcttaaaagttctcagtgttgaagctcaatccattagatacctctagctggcactactagttgcagtcctgtgcagactactgagtcattttctttactccctgaagacttaaactctatcttactctcactctctctgacattactcctattaaaatgttatgtttctttagctattctttcagtttttggtctcctctccttcaacgaggatgatttctagaatgttggttctcaaaatgtggcccctttgcagacatcgtcagcacctgggaacctgttataaatatgaatctgcagaccacaccccagactactaagcccaaaattctgggggctggagcccagaatctatgttttaagaagcacgtcaggtaattctgatgaatatgccagttccttagatcttgttattgtcattactgacaactttctctgagaccacaatttgaatctaccaatttttcactagtactcacccatcttaagtccttactttccccttaccagccagacatttgaatattccttgactcttctctttcacatactatatccaaagagtcaacaaatgctgtcagctataccttcaaaatacatgtagaatctaacttttaacctccactgcagtcacttcagtccaagcacaaccatttcccacctggagtattgcaactgttcttgtttggtggcccttggccctactttatctactttccgcaaagcagccagagtgtttctttcaacacctaaggttatatggcttcattgattgaaattcaccgtgcttcacctctttctctacaaaagccaaagtccttgtaaatgcctgtaaggctcgagggtgatctgaccttccctggcctgtcgtgtttcggtaaaagtaagctgagtctttcatagttaaaggacagcaatattgtcctgcatgatattttaaaaacccaatcaagaatcacacattgcatttaattttcatgcctttagtctccattaaaagtgtgccctttgtattaataattggagtgatgagggacagagtttaagaatatataaatattttgtccccaactgactgtcactggatggctttggcacccattggtgattcttacctgaatcagtaattattgtgatgactgaaaatagtgatttttctcactgtataattcttctatatttattaattaccttaatattatcctatagaacagaatgttcccttctcatcttttgtttgtttagtgtcagtattactcatgaagttgggtgtttagaaaattcaatgttgtataatactgttattattcaatattgtattttctcagtttgagtcttccatctgcgtcctttcatgtaaatagtataaagatcagtaatagaggaacatagagtaaagtgtgagcagagaagccttactctgagacaaacttcagagaggtgaactctgttgctgattaagaaaggcttcactgaggaagtgttgtttgaagtgagctttgaaaagtcataaaattttgacaaaagtggggatggggtggagcttaaaggaaaaactgtctgaacaaaggaaggcccggcagactaggaatttggcaataatacagtggttttggaccttgatgaggaagttgaaatggaacataaaaaccctctgcatttagctccatttatttgctcaggcagctctcactgcctaaaattttcacccctgctgttttgctcaggggtgggatgaggggtaatgagggaggaaattttagggggtgaaaacagcacaagccaaaaaccctgctcagatactcccttctcttgaagccttttccagatccctaataagaattaaccaccctctctcacacactctgttgtactttgtccttctctgttaaccagcctctgtgttttgtgctgtctgtatttgtggatacatcttcctcctttaaagcacgaatcatatcttaatcccttggcccttcttcccagtacttagcacaagtgctcaatacatgtttctttaacgcgtgtaacagaggaaggcgaggagagtgagtgggattgggagcaggaggattctgaatgtcattttaaggggtttgggctcgctcttcaggcagcaatgagccatagccgcctttgaactgtgcagcactgaccagagctgtgatgccaaaggatgcagtggaaggggaggacagccagcatgcctgggcatggtccccaagtcagaggacatcagtgggagaagggagaaggcatggaagcaagtggctaccatcttatgaatctgagcactcattcaaaggtggcaaggaaaaaggaaggcattgagcacggttttgaggtttccagcctgggtgattggaggctgatgcaggcttcttaccaaaaagggccctaggcagtttcaccaggaatgtttaaggagtttatcatgaccctatctcttcctcgtctaaaactctccctaaaatcaaaacagtatgtcctgttgaaatactttattgtatcaaatataatgagaagtaaaatattctctctacttgatgtatgaaacactgacttcttgtagtggacaattttcacttgtctttttagtaatggtttttattaaaaatagatgttaataactgcttgtttaatctttaaacgtggccctctgagagcagcttaccgtaaaagaaacggttgtcagctttctttttgctcctcagtccctcctgccccttcctaacaacagaaaatttgctttgcacctgctccaactgggttcgaagagataagcatcttgcaagcccagaaaattgtagtatcaaatctcagccccaactgtgaggcagcactatcattgaatccctgctgagaggcgttgctttcccaattcccaaaagagttctttctcccctggccccttttcaggcttgaactctgaccgaaaccctctttttaactcccagcatgcactgcacttggtactgacactgacccatccctgcttcctctgttctgcactggactcatcagtaggtcaggcgttggtagccctggggtcactggggtgcccaattccaataatgagcacatttagctaaggagaggaaatgtacccttctatttgttacagtccattgctttttttccagaaacaaatgctaaaagaacatttgatatattgtggtttggtaaatacacatagcactgcctaatattcacaaagttgcctcttttttttgcatcttccttcataaattaaatatattgttctaactcatgatttattttaagagggatatacctatttcacagctaggaaaatgttttcaaataaagttatattcagaatactcttgcaagaatttcaaataaaaatagcaaatactatttaaatgcatataacattctaacagacttgtgtgtcattttaaagggaaagaaaaaaaatgatgacaaggactttacaactttgtctttaaaatttcttcttaggctttccaaacagaccgaagtcattaaaaatactccttaacccccaaagtcacaaaaaagaagctacccaggtttattatgagaaggttgaacctctgttgaagcttgcaggaataaaaactgatgtaacaagtaagtaattttcagaatataatttcaccatctacaaaaacatacaaaagcaaaataatctgaatttgtccttaatgcaaacttgggaaactacttgtaatatctatagcatttttacgtcttcataacctactgcagccagctcgagggttataatttaattatttttgttatttttattagaatattaatattttctctttagaattttttcagatattttttcagacttaaacaattgttagatataattacaaaggaagctgtatacttgtttacatcttcatggagatgtttgctacttacacgttaattttgcagttaggcaagaaattgattttttgctcacttatatagttgatgtctttccatggaattcttccttgggttgttttcgttctgactctgacccctggtggttaggtcaaaactaagcactgaactgctggttttattaatagatgaatttagagatgctagaagcttaaatttgttgtctaaactaagaaatgtacttaggtttgtgccaaggaaaatagaaacttgttaatgctaaacttaatagatgattagtaatatcctttttgatttttttaatttggtagtcacatttctttgtttctttgagacttattttcgtatggtggggaactgagtagaagagtcgatgctatggagaatcgcaaccttcctagctttatttctatgtggcttcgctaacagtggaaatttgcaataaattttaattgatgaaaagtattataaaataagcctactcaggggacaagcccagagtgcaattggaacttcctagtcccagttatagattcctagggaagggattcacagtgatgtggctttactcagctgtaaacaaaggagataagtttcaagatgttaataatatcattgaaacctacacctagtgatctgatggattgaggtagaagaaagttcaaaaaaaaaaaaaaagcaagttttgtaggaaggtcagcccccatgaaatgtgcctataactatagaggttcgagagaaactaccatgaaaaactcaagaggaatttttgaattaaaataaagttatagtgaagaagttaacctttatgtttgtgaccttcggcttatttagaggtgatttacaagtaaaagagaaaattcagatttatgttttctttctactgaagatttccaaagattggctgaaggaaaagtttgagatttgtattagggtgagacaattaaaagttgaataaacatattggcatactcaatgactattttgttcattgcttttacatgtgaatactacaaagcagcttaacatggatattgctatatagcattcacttcaggaatctcattgtatgcttgctctgtgttcaacatagtgcaggatgcgagatgaataagctatcatacttggatgactttctacattattagagattcaaaaaaatgcttaaaaccattataactggggtatacataaaagaactttgatgtctcagaggtgatattttgatcggaagattcaagaaaagcatttgaactaggcagtttttaagaggcagacaaaaaatgagggaaggaagtcaggctaacaggcatgtactgtaaaagttgggagggggggcggagagagagagtgtgtgtatgtgagagagtccatgtgtgttacacccatacatctggagagtttgtgccataactttgctctactttcctcagtttttacattatctgaaatcttactctatcatcataaaatagctgccagtgaatttcatcctttcttattaatatccagtgggatggggagaggtgtgcatatgtgtgcaagagagacccaacatgctttaatcctgaagatgaattaaaatttccttttttaagtttgggcacagatactgtattagcgcagtcaatctggaataatcatttatttaaccatcaagactcttcccaggggctgaggacagatccccttttcctgatgactgaaatgcctcagctgaatctggattctgttagggagaagaaagggcaaaatgacttctaggaaggctctcaacaatgtatactacaggaggtataattccaggttatggatggatccttaagctgcactcagcagtttactcatcgtgtattgatccacagttggtgtaaatttttttttatcatactgttgcaatctggtttggcaaagatgactccaccagcagaattaaaattaaaaaggaagagagaaaaagagattggagacaagaaaactgatatacaaggcctgaactaaggcagaggaaatcatctaaatgtgctttccttcttaattgtattggagacaaaactattatgttctaggatttttttctctaaatttgtaaatattactaagtaccatatttaaacataaaacaatagaatattccgtaaagcaaatttagaatttacttacatttgtgcagaatggctaattattagctgcctaacactcctcctacaggcaaatttataaaattacatcatttgcttataaaaccattttagtatgcatattggctcaatatttatgaaaaatatttcttgaataaacctgtgaatatttgaaaagttttagtcttcctgcctatcttacagtgttatttttgtagttgaaataatatatttgaaactttgtatattatactacagaaaggtggtcataatactgttagtttcagtttcaaaaattatgtcatagtaagatcgaattcgtactttatttgaaagtatatggaagagtaaagcagaaagaggacatatcttctgcatgtccagtgggacattgttttaatgtatccttgtgtgaatgggtgagtccaaatggaattggaattacaaaataaaccctatatgatgagttaattaggaaatagtgctatataaatatgaagtataatatgaagaattacagctagatatatacactataaggtactgtaattttttcataaatttattttaaaaatggatcttaccacattaataaaaacacacttctttcattttgggttgtgctgaaatcctaactacttctgaatatagatcagcatcttttgaaatatttgtgctaaagttgcatccccactctgctaccaccaccaaggtagtatcttatctaatagcatcagaaaaacttccgggagaacctggaaagaattattttttcctaattacctattcgtacacaaatcaaagaagagtatgaacgataagcccatgctggcatatgatatcatttctcttgcttctgaaacaaagcaagttttagagattgtaccattaaaggtgtgacagatattttgaggatcagagatccataggataattcatagtacaatagagtgaaaaagttaaggcagcagagaaatcagactgaaaagaactttcgaggccatatggttcaatttttctccttgtgggtggagcacaggtgtgtggcactcaactttggcttggccacctacactagaggcagagtacgttgttactggacaatactgtttgacattcttatgaatgttcagagttactgtacctttgggcagattagaaaaggcacctcctctgtgctgacttacaaaaaggtgccctttcttccagactaattcatcctttgcttataaaaccatttcagtatgcatattggctcaatatttatgaaaaaaatatttcatactttcaaaatattcatatttcaaaaatattcagcccaaggtcactagattcagcctaaagtcatttgttagattgcaaatccgtcattcccgttagccaagtacctttgtgctaggcataaactgtacaaaatgagaacttgtcagctgacattcgcctctttgtaatttttatgtactagagttaatgttatctcttgtagtaatatgaaataaatgtgccccatctattgtataggagtcattgagatatttgaagagagatatcctgtctgcccctcatctcttgttcacgataggtacttccatcgccttcagttactttttgcattaacagagctgctagaccttatcatggtcattatcattatcatactcaaagacatttatctgaaggaaaccttgatctctgccagctcagggctcttgggagtgcctagtcaccagataattttacctcctgggcagagttgtcaagaaagtggtgtttgttatcattttccccttctttctcctaaaatcacgcttctaacatggctgttaacaagcctcttcatagtgtttctctggttgtttatggctctacttgaagccttccatttcttggaaatgcctcttgcctttctaaatctcacccagcagaaagctaggccatctaatgaaactgtgtcacaaaagattccagtagcctgaggcatcactccttccaattttacctgcattttaatacaaaatctgaaaagtaaatgttcatgcatcatatctagctagagagaaagataattctgtgtaaaagattctttttgttacctcttaaataattgtgggtgtatatggccagtcctgttcccagcattcagatgtgagttaggaagttggaactttatacctggggacgatgaagactcactaatggggtatatacaaaaaagtgatatgattaaatatgtatctgaaaatggttattctggctagagtgggggagaggtttgagggagacaagataaaaggctattgtagtacaggtggagtatcccttatctgaaaggcttgggaccagaactgttacagatttaggatgtttttagcttttggaatatttgcattatacttaaccacttcagcatctctctaatttgaaaatcatggacacaggaaggggaatatcacactctggggacagttgtggggtggtgggaggggggagggatagcatcgggagatatacctaatgctagatgacgagttagtgggtgcagcgcaccagcatggcacatgtatacatatgtaactaacctgcacaatgtgcacatgtaccctaaaacttaaaagtataataaaaaaaaattaaaaaaaaaaaaaaagaaaatactccaatgagcatttactttgaacgccatgtcattgctccaaaatttttagatgttgaagcgttttggattttagatattctggttacagatacttaacttgtctacacatgaaagatatttagtgatcagatcaatcagctaatttagggaattagctgggagaaatggaggaatgctatggcataatttaaagacagaaacaactggccttggccatggagtggttctggagagtggaggaaagggacactctagaaagaagtcattttcctgtcttggggtagatgatggaacacaaaaagaacaatatatttgagagagaatatatttgaaggtatacataatggattctgttttgagcttactaactttaaagtacctacaggacaggaaagaaaatgacatttcagtatcatatcccacactagaattttatcaccaaaccaagaaatgtttccttatgtccaaatcaaatctcacctgattttatttcaggtgattttctcatcaacattgaatatcaaccttaagactttcttgtcttcctgaggaagttgcatttgcaccaaagaggggagggggaaattcccagcagtgagaattgtgttcaaagacctgtaaactgtgaaggcttcacatctcctatttagaaagagcacaggttggcaatctcataggaaaaggcaaatagatgaaagaagaggctgggttacattttttgaaattacatttatctagcaatcctttctttgtttgtttgtagggggatgatttgaatctggctgtcactgattccagggcccacaatagcctgtctaaatacatatttggtcctttctactatatttaaatagtaatccagatcactctttatccttttgcctaacattgttttgtataaccacctattacttcatattataattcattatttcattagcatatattgtctatctccagaatgcaaattcctgaggccaaagactaattcattttgttcattttgctaatatattttatagatgtagatagtcaggttcttttcattttgtttctttgttctagatctttgattttattggacttttgcaatgttacttaaaaaattgctattttcaggcaggttgcattagtgtataatcaaattccacccacaatatcaaaaaaagactattacaaattaaaaaaataaaaatagcattcaataataacacagttctaaagctcattattggatctgaaaaactttaccaatgtaagctttggtataaaagtaaggcttggtgaactgattcttagcataaatattttttcatgatattcttatttttaatgtgtatatgtaagatgttttattttgcattttaaggttgtaagtacttgctgtagttataaatgaatgatcagcacacatcttctttgataacctttcaactttattaatattaatgtttcatatgtagttttattatggctttcttctgattggaatttaatatagagaggttttattcatgtgagtgttaatggcattttgaataagctatgggagaattacaatgtaacactgctggatacagaatgattcttttagacaccaagactaataatttttaacaatatcgaaaaacattgtaggaaaagcttgaaccatgctggcaccagggacagacaagcatgaaagattaatgtaatcttgcatataatgacacacattcttacacaaaaaatccatctgcaatgtcatgtcagtcagcagaaatctttgatgggtggatacagctgggctgtctcttctggcagagctgccctggaaaatgctaaatgtggttgtgatgcttggtgccatctgcagtgtgcccgtttatcctgtcttcactggcatttacgatactgcatagggcatcagtgactgtggagacagcgatacagagtgacagattcatttcctcggagggtctgagctctggtgggcctgtgtgccaccctccttcttgggtctgggtctcttataattggtgttggctttactttgtattttcacatccaactcttcctctttttagtctaacagttccagtacacattcttctggtttgtaaatcttacactaaccttttgactaatttattcatgtaaggttgccaaaccgatttaagattgactgttcaatgccagctaatatgccttatttccaaaatactgctcctcctaagcctctgatttaaaggacatgtgtcttatttagggaatactaaacaggcaccaggacaaattgggtaaccactatgcgtgggatattcccaaatgactttatgtagttgaaacaaatatatgaccttctcttacataaagctataaaacatcaggccagtaacacttagtcctcttgcccatgattaaaatataaatattcaagaataaatgctgttttatgacttgaccatatgtttatcatattattttgccagaacaagttaaaaagtgtgatcattgtttaaaactgtcactttgtgtatgtgtgtgtgtttttttaatagtaatggaatatgaagggcacgctctgtcactgcttaaggaatgtgaactccagggatttgatgggtaggttatattattaatcaatatatgttatatcatttatgtattaaatgccttcactagttttagctacatatttggaacctaacatttaaaaatatttgtagtgtatgtactttggctctatcttgttcatatctatgtaataataattaatgataatatgacatggtcatctatctctcaggatctggcataggaaagcaaaaagaggaatctaattattaaaatactgggaaatgacagtgtactactctatacttactaatgtgcatacatttgcatctataattatttgcttttaccatatatctagagaagcactaatggaagatgttatactggtcacatggcataactatatgatgatcttcttttgcaaattaattgataggtttaatagctacccattggttaacttgtctgtgatagattgagggaagatattttataaatacaagtaaataaatacattatttccagaaacaataagaaataattttaattatctcataatgtagtgactacaatttaggtatgttattcacagtgggcatcggaaaccattgttcgcaatacattggagtgtacagagattgttcactggcatgcaaacgttagaaccaaggcaagtgatataaatttcattgccattttttaaaattaggtgaaccaatttgctaaagtgttggactgatgtgtaagactaaaacatattatattcctttagggaagttctttttacgtgagtagatatttgagaatttaaaaagttgacaagtgtgtgaattatttgtgttacatggtgatgggcagggggcaaagacccataaggtcaggaaagggagttaggtctgtactttcaccaaagtgaaaggcattaaccttcccaaagactgatttgaatgtgctggggagggaagtgatgcaatcaaaatggagtattggcagggctgtttttcagaaatgcttatttatttatttattttttggatgaggagaaaacaatagctgttgagaaagaaaatgtggtaagtaaaacatgatttttccaaaaggaatctaattgagggaagtaaatctagatagcaatattatataaacattgggaatcaaaaatatggggtaggagattacttcagaactttatacttagaggtagacaaaaacattaataggcttcatttagaaaattgtcttacaagtatacaatttaagaaaagtccttgtgggaatcatgcataccaactacctatttgaatatgctgcatagtccctcactagacctcatgagtacatgaaggtagctgcattgcaaatgagtacctgcttcaaaacttgattaaagaatgagaataaagatatcacagatattaaacttgttcttacacagcagcattacagaatgttctgctgaatgcagtatctatcaatatgttttactggtatttgtactgggtaaagggatgaaaagaactttgcagaatgaagaaagacgattgctgaagtgtagtacaataatatttttctctttacctgaacatatttaatccttatttatttttcatggcaggtgttgttatttttcagtgtagagctaaaagatgtatagatttttcagttattatattttataaaccaaatagtttggcctaaccattatatgaattgagttatgtaagtgtttctaaactctatggcatgctgatttatttcagacttacaataatttcaaatttctactgaaagtcatcttccgtgttctaagactctttaaatcaggggtccccaactccgagactgcagatgaatatcagtcagtggccttttaggaactgggaggcacagtaggaggtgagtggcaggagagggatcatttccgcctgagctccacctcctgtcaggtcagcagcagcattagattctcacaggagtgcgaaccctattgtgaactgggcacgcgagggatataactggtcatgcgagggatctaggttgcgtgctcttgatgagaatctaatgcttgatgatctgaggtggaacagtttcatcctgaaaccatccgtctcccaccccaccctgcagtccatggaaaaattatcttcccacaaaaaagtccttggtaccaaaaaggttggggaccactttaaatagcttatttatttttgtggggtcagttttcccagtagaagctgatatggtagttggagtaattatcttaataaactggcaattttaagtcactgtacttagaattacatagagagatatatgaggagaataatagaaacatagtttcttcaggtacttcaaaggaacaattctcttgcaagtaaaattgtttgaaaatggaatattctacattggtgagttttctattcctgaacctgttctaaagagtggctaaaggaaaattttgggggaaatttatagaaaaggtgcagagatgagagaaggttaaccccaaaatgctatggcattttgatgagagacagactcaaatttctttaagaactttggcctgaagcacctccgtctgacactagtggaactattaatagggagtgattaggaaatcacctaacagtttggtttctagatacaggctgaagaagttaagagccaagaaagattctatgtatagtatttagtaaagcaaaacaatttggtaagtaatgtttaagaaatgctatttcctaagattttggagttgtatttattttttttaatgaattacatatgtttctatgagacatcttgtgacatttctaaacccaacagaaacagtgtatcagcacttatgacagctagttctccactgcagtgtgtcctaggaaacactctaagatccactgttaaaccttatgagagcttcagattctatattgctccctattttactgggcatgagtaggaagttttaggaaggaaaataaaagaatatcagctgcatagacttgaagcagtaacacttgcatttataagtgtgagtatagttttaaaaatctatagattttatgcaattgtaaatatatgaattcctcgctattaatatttgtttcagaatttttaaaaaaattgttgagttacttttcttttgttcatttcaccattaattagacccataatgttgtagacattatttggattatattgacattttatcagattgaacatatctgtattacttagtaaggtaaaaagcaaaaacaaaaacaaacttttccagaaagaaaaaaaactgtgaatcaaaactacaacaatatattgaacatttcatagatgatgggttcatagataagtataaaaacattcattaaaaaaatctttatcactctttgaaaaaggatatattatcacccagtgtttcttttctagacagaataattctgtttggagccatggcaaggagtttacttattttaaaaacaagatttgtcacatgcaaaggattagttactctaaggtttatgttttagagtgacacaagtgtgattaactcactataaatgattgaatactttgctttttgcctttcttgtatatttagactcttgtgatatttttgtaagaagctgttgatgaaaaaaaccaaactgtaaaatatttaaagaggtttattttgagccaaatatgagtgctcatggcctatgataaccccaggggggtcctgagaacatgtgcccacagtagttgggttacaacttggttttatacattttggggatacagaagttatagccaaagacataaatcgataaatgtagggtattcattggtttggcccagagaggcgggatatcatggagctggtgggaaggggagctcacagatgaattcaatgattttctgattgtcagttggttgataagctttgctgaaagattagaagtcagcagaaagaaatgcttgagttaagataaatggggtggtgtaggctgggtgcagtggcttagcagtggctcacacctgtaatcccagctctttagaaggctgaagaggggagatcacctgaggtcaggagtttgagatcagcctggccaacatggcaaaaccccatctctagtaaaaatgcaaaaattagccgggtgtgatggtgtgtgcctgtagtctcagctacttgggaggctgaagcaggagaatcacttgaacccaggagggagaggttgcagtgagctgagatcacaccattgttctccagcctgggcaacagagcgagactctgtctcaaaaataaaataaaataaaataaaaaattataaaaataaagataaatgaagttgtggaagcacaggttcttgttatgtagatgaagcctccagatatcaggcttcagagagaatagatggtcaatatctcttatcagaccttaaaaggtatcaaactcttagttaaatctctcctggatcaggaaaagacctggaaagggaaggagattctctatagaatgcaaatttctcctgcaaatgatagctttgcagggccatttcaaaatatgtcaacaaaatacattttgggataaaatactttgatttcctctagggcctgctatttgttatttaatgctataccagagtcaggttggagttggggatcttattgctaccaagtctgttttgtcagtcttatgatctattttttttttttttttgagataaattctcaccctgtcacccaggctggagtgcagtggtgcaatctcagctcagtgcaacctctgtctcccaggttcaagcaattctcctgccccagcctcctgagtagctgggattacaggcatgcaccaccatgctcagctaattttttgtttctttaatagagatggggtttcaccatgttggccaggatgatcttgaactcctgacctcgtgatccacccttggcctcccaaagtgctggaattgcatgcatgagcctggccaatgatttacatcttaatgccagtgctggccatttgcgcctaaactccaaaagacaagagggtataaggaggcatatccaacctcccttcctgttatgacctgaatagtttttcagattttctttgtgaccttcatggccaaaaggggaggatccattcagttagttggcgacttagaattttatttttgttttacaaaacttatttcctaggttgagtcactttacctgaacatgatcttaatgattgaatagttgttaacataaataaatacatattttttctaactcacttaatttcacactggttctactggtaaactgtttttcaaaataataagattctcataaggctatttttattaggtttcatatatagaaaaggtatctaatatattgaataatattgtagcttctaagaccaaaatgtcttatttcaaatccctgttctattacttactagtggtacaatcttgaaaaagttactttatctttctatgttttagtttcctaatctgcaaattgaaggtaatattacctattgcatacagttatttctccacttaaatgagttaatacatggagagtgcttaggaaaatgtctgatatatatatatagtaattattcactaaatatttctttattgttataattgtcatttgtattagtttcaaaagatttaacacagaatgtattatgacaaaatttcagatgtttcagaacatgctcatagggaggccacctctaataactctagcaatatgttaacatatgcatgacgctataattgtatgcaacattctaggagttaagtgttcgcatcctatgtatgtaagggtcaagttatttggtgctaaattagatttttttgggtatgactccacatagtctttttggtcacacccatatgtcagcatttagacagccatggattgagggttacgtttaagttcacagattagaaatctcatagagatttttgaaatcaggtaagtttcaagtcaaaccttggtttttttcattcataaagatgggactgtggcctattttgcagacttctgaggatttaatagaaattagtaaacacattacctgatatatagtttgtccttagtaaacatcattccttttctctgaataggtggtcatattgcgaacctctggaatcagtttagacataagaataaaacacacctaatcaaacatgacctgggtcatatcttgagtcttctaaccagagtagccttggattgcccaggctatgtggagctagtgggatgaggaagatggggactagagggaatagatggccgagagaaagatggtgggaactgactggaaagacactttcagcctttggtcaccaccctccagagcttcctaaacttagagaaccagtaactactgctgactgtggcccatagacagttttgtttgaaatagtgtttttaaatatattgaatgctagttgcttagtatttacaaattaggagactcagccttaaatcagaatctctggcttctgtagaaaaaccagatctgggtccattaggcctcacacgtgatgtgagtgggccacagcaaagaagtggctgcgcctttagattgagcctactcttccattcctgctgggcccttgtagcccttgagttgtgacacctgctttcactgaggcaaaatccactttccattgggttaactggtgacattttgatacgtaagaatattttgcttcttttgaacataaatgattatgaaatgaatttctggtacttctgtgttattttaatggattctgcccccatagtctacttgatataaagtcttaaaaaatatactagtagtactatctaggatcaaaggctaatagtattacatctagaagcaccgtatagcaataatgtcaaggagatgaaattcaggtcaggtttgtaattactacattcatatagtaatgataattagcagtttcttaaagcttcatattttatatgatttttattgctatctgtcttttcagagctttattgagaattagcaggattttatgactttggttggtgttagttaaatgaattgcagatgacagtattattaacaagaaatgagaatgatatgcttttggatgttaacagagcaaaacgctggtcagatgtgaattaacatgttcaaaagttttcatatctcttaacacacttaaagctattttgtctatggggaattatctagttattatatttgtgaagtaaacttacctgtgttgtgtttgtgttgtcttacccattgacacatattaacatgtttaaaggtacatgtgagcagttatgcacatagactacaaattagtaaactattttgaagtctagatttcatgacttattaccaatcattctgaagttttgccttctttgcttgatttgtatttttctagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggcaagggagtggctacagattcattaaactgacccttctccctcttttcctttcttacttgctaatctagacagcacaacacagaattaatgaacagactttgaaagatccagacttctggcatccccactagcaaatgtgagacttttgacaagtcatttaatctctttgagccttatttttctaatctatagaatagggatcacagatatattattcactttattacaaggttattgtagtactaacgtttggtttagtaaagggtttaatatatagttaaaccatcagtatatggaatggttattattctcccttcgcataaaaaatctgttgattacacagtaccaggtaagaagtttcaaaacagggccactccagtctagctgcttacaattccatatgaggtgaatatggtaacttgcataattgatgtataaccagataaccttgagaatgccaaaattacttgtgactggaagggaggataaggtttggaagggtgagattcttaagggcaaggctttttaatctttctactcactgccatttttcagcatctagaatagactatgccacagtgatgctcagtgaagcctattaagtgaatgcatgtaaagaagactttatatagtaaatgacacttggattaggtcttaaaatgggttggagctggcctgaaaaggtgagaatgagttattttcttggctgcaaaagtaataaagcaaaggcaaaacccaggagtgtttgaggaatagtgaaaaggccattcagtggaagataatggtatcaaaataggcccaaccatggaggctcctacatgccacagtaaggtctctgaattgtatttgataagcagtagggaataatgggatgtttcagagcaagggggcaacctgattggagcttgttccaggaggattcattttgcctcaccgtgtggaatgattagaggttgggagcaggagaaagtagaggtcagagacacggagaaccgttagagcaacactgtgatccagaaaagagggaaacatcattcaaaagctgattgtattacacaatcactcatccctatttaacgaacggtgctgggaaaactggctagccatatgcagaaagctgaaacaggatcccttccttacaccttacacaaaaattaattcaagatggattaaagacttaaacattagacttaaaaccataaaaaccctagaagaaaacctaggcaataccattcaggacataggcatgggcaaggacttcgtgtctaaaacaccaaaagcaatggcaacaaaagccaaaattgacaaatgggatctaattaaactcaagagcttctgcacagcaaaagaaactaccatcagagtgaacaggcaacctacagaaagggagaaaatttttgcaatctactcatctaacaaagggctaatatcctgaatctacaaagaactcaaaagaatttacaagaaaaaaacaaccccatcaacaagtgggcgaaggatatgaacagacacttctcaaaagaagacatttatgcagccaaaagacacatgaaaaaatgctcatcatcactggccatcagagaaatgcaaatcaaaaccacaatgagatatcatctcaccccaggtagaatggtgatcattaaaaagtcaggaaacaacaggtgctggagaggatgtggagaaataggaacacttttacactattggtgggactgtaaactagttcaaccattgtggaagacagtgtggcaattcctcagggatctagaactagaaataccatttgatccagccatcccattactgggtatatacccaaaggaatataaatcatactgctataaaggcacatacacacatatgtttattgtggcactactcacaatagcaaagacttggaaccaacctaaatgtccaacaatgatagactggattaagaaaatgtggcatatatacaccatggaatactatgcagccataaaaaatgatgagttcatatcctttgtagggacatggatgaagctggaaaccatcattctcagcaaaccatcacaaggacaaaaaacgaaacaccgcatgttctcactcataggtgggaaatgaacaatgagaacacttggacacaggaaggggaacatcacacactggggcctgttgtggggtgggggaaggtggggagggataacattaggagaaatacctaatgtaaatgacgagttaatgggtgcagcacaccaacatggcacatgtatacatatgtaacaaacctgcacattgtgcacatgtaccctagaatttaaagtattatatatatatataatatacagccttatgaacatatatatatataaaggaaaattaggcaaaatagcattacttgaggtactcaatagcctggcagagcagacattaagggtaagagagactggacttgaatttcagtttggtacttgactttgggtgggtaattagcctttattagtcttgattacacatttaaaaggtttaataaggccgggtgcagtggcttatacctgtaatcccagcactttgggaggccgaggtagtggatcacctgaggtcaggagttgaagaccagcctggccaacatggtgaaaccctatctctactaaaaatacaaaaatgagctgggcatggtggtgtgcgcctgtgatcccagctactggggaagctggggcagaagaataacttgaacctgggaggcagaggttgcagtgagctgagattgtgccactgtactccagcctgggcgacagagcgaggctgtctcaaaaaaaaaaaaaaaaaaaagtttaataatgtccatccccatagggccattacaagaatcaacttttaaaaagtcacacattatcactaaaaaagcaaaatatttttccctatgattatagaaaataatgcacattgttgaaaaaaattcatattttgataaccctattcatttagtatggattttagaatacttagtattgttgataagttgacagagcataagatattcaaatgcccttttagagtgtaaagtctttcagaaagtcagaatttaaaaggagagagatattcagatataatctgataattctagagtatataggaaaacctaaaatggtttctaagtagaagacaccaagatgattttgactcaaagagaaaaatgatgcattttgggccatcttttcatggcattttatttcttgacctttttgctttactttagtagttctgactataatggtggaaactttccaacatttccttccatgcaaagtggatgtgcttaggacacttcattagtacttaaattcctgaggtcattcattgactgccatacatcagaaatagaaagatgggtgtccctacaggtatgcctttgacataaatttggtggttggctataaaaactggtggttattcttatgttttagtatgtaattcagattttataaagaaatagcatttagttttatcactattataattttgaagagtatttctgatttggggagcattttatgtattctttggatatttgtagtaatgccattttaacctgtcttgtttagaagacacagtatgctgccaaaattctggtcattgcataggagttctagcattctaattccatctaataggaggggaaagtcatgtgtggggtatatttaatatgatgactgtatgcctagtcagggcttttgatagagaatgggaactagaactaggcaggaagttttcaagctgaacatgaggagacagtgtgcctttgaagccatttgcctcctggagagagacacccagagggagagtgtttagtaaattaatccactgagccaacagactaagctgctgaattatggtcagactcaaatggatcagatgtggagaagcctgtatttgaactgctggccattaggaatggtgtttgttgctatgggaactggtgctaaggaactatactgagagactctgattaaaagggggagggggaatggagaaaaaagcctgagaggacataaaaataaaaaagcaatccagttgttgtaaaacaaggctcaagccacatactgatggctgtgaaccatatattcctatagagtttgcataaataaattcatgctttccaattaatttgaggagaataaaatattgccgagggactgttaatttctatgatatttcaggcaaagaaccaaagtgtaggtgccgttttcatgagaattttagatatgcttgactaggaagtcattacatcacatttatctgtttggatgtgggagacattaacagccttatgaatattcatggtatctggttaattaagttaattgttctgcagaagtgcttgcacttccaaggacattttttttttttttttttttttgcctccatagtttctccctggtatttcatcagtaattctttacatgaactgctacttctgtccttacttttttgtatttggaacattttagcagctctcaggaggaagtggtaggcaaagtttctggtagtgttaagaaaaataactttcaggctaattaaaatgtttaccttgaggtagaacatttatagcttttgtgagaacattaaaattacgccattgttatttatgtgagcagcatgttcttttggcatgtagacatcttttcaaatagagtacagtttcctgaaacaaaatgtaatccatctttcagattatcccaacaaaatatagaacaagctatcgttttgcaattttacatatactttctcataaactttccttttttcttcagagtgtcaaaaaccacatttaaagactaagatacagattaatgagtagtcaatgactaaaataattttctgacttctagtcatgtctgttatcactgccaacttctacagaattagagaaaagttgcaaagcctgagaagacataaacaatttttaaagccatctctagcattctaaaaaaattttgtacttgggcatacccaccgtacttcaaactcacagggaataaatggtctttattttcttaagtcatgatatgtgtcattctctattgcacatgacattacattatgttttttaatagcctttctagaggaatgcttttacggtctactcataattaaccatggtaatggaggaaatgtgtttcatggagtactgtaatccatcgataatcctaaatatctgactctaattatgtggcctcctccaaaatctttaccacaaatctgattgggaagcacaatggattgacttgtttcttccttttctcctgatccattccagatttattagcaattagatggtcaaagggcaggctgtagagggccacaagatcattggaaagaccttgataaagatccactgagtaacaggtttctacactacttgttctcaaaacttagggtccatagactcaccttgtgaacttgctaaaacagagatacctgggtcctccctcctccaaacacattctgagtccatgagttggaggtagaacccaggaatgtacgtttttaacaagctcccaggtaatgatgctgcttggaccatgcattccagaggagtttctcaccaagtcactgtgcatacaaaccacctggggatctaataaattgcagactctgaatcagtgtgtctggaatggggcctgagaggcaacattttaaaaataatatattttttacttccattaatactgctattactgttttaatacctattatccttatttttaaatggacaaaaattgtatgtatttattgtgtacaatgtgatgttttgaaacatgtatacattgtgaaatggctaaataaagataaacatgcataaaattgacataatgatcacatactgattttacattgagaacacttaaaatctcccttagaaatttccaagtatataatgcattgttactaactattgttttagcctgttctcatgctgcaataaggaaatacccaagactgggtaatttataaaggaaagaggtttaattgacttgcagttcagcatggctggggaggcctcaggaaacttacaaccatggtggaaggcaaaggagaagcaaggcacattcttcacaaggtggcaggaaggagaaatgctgagtgaagtggggaagagtcccttataaaaccatcagatctcatgagaactcactcactatcacaagaacagcatgggggaaaccacccccgtgattcaattactcctacctggtctctcccttgacatgtggggattatggggattaaaattcaagatgagatttcggtagggacacaaagcctaaccgtatcaactgtagtcactaggttgtataacagatctcttgaatttattccttttacctgaaattttatatcctggaccagtatctccccagtccttcccacccattagccccagtaaccactattttactcttcgcttttatgagtttaagtttttcagattctacataaaagtaagtatttgcctttctgtgcctgtcttatttcacctagcataatgtcctccaggtttatccacgtgttgtaaatgacaggacctctttaatgccaaatagtattccattgtgtatataaacaggctgattgtccctaatctgaagacttaaaatccaaaatgctacaaaattagaaatgtttgagtgccagcatgatgccacaactggaaaattccacacctcatgtgacaggtagcagtcaaagtgcagtcaaacctttgtttcatatagaaaaatattttaaatattatataaaattatcttcaggctatgtgtataagatgtataaaacttttatgtttagacttgggtcccaccccccagatatctcattacaccaacagtgtaaaagtattcccatttctccacagccttaccagcatctattgtttattgactttttaataatcgccattctgactggtgtgagtgtggttttgatttgcatttctctgatgatcagtgatatttagctttttttttatatgtttgttggccacataaatgtcttcttttgagaagtgtctgttcgtatcctttgcccactttttgatggaatttttttttcttataaatatgtttaagttccttgtagattctggatgttagacctttgtcagatgggtacattgcaaaaattttctcccattctgtaggttgcctgttcactctgatgatggtttattttgctgtgcagggattgttttcttgatttctttttcagatagttgtaagtgtacagaaatgctactgatttttgtgtgttgattttgtgtcctgcaacttaactgagtttgtttattagctctgacaattcattcatggagcctttagggtttcctaaataaataagatcatgcctacaaacaaaggcaatttagcttccgtatttatgatttgcaagccttttatttctttctcttgcctaattgctctggctagaacttccagtactattttaatgacagtggtgagaatgggtattattgtcttcttgaggaacaagacattgtttctcaactcatgagagtaattttaataagcactcaagtattgtcattcctgtttgacagtaggccgtattttgagtaacaagggtcacagcataacttgccttttggtgaatcagttggaaccagtttgccatttagttaaaataaacttttctttgcactggtattactagaagtaattgtgcttatttataattaataataattaaatatgcttattcttagttacctaaaaaattatgatattaatgacctcttggttgataatggctaagctgcctcagcttctccaatttagcaacccaagtacatatcagttcaaagtaacacaaattgaagcaattatgtatgatcacataggaatgcttctgattaacaaaatccagaggactggtctttgccttcataaccggaacacaccacatgcatggtttcacagctcttggctattattggacttacttattatattctttaattcaagaaaaattgtagcttcattcattctgttcttaataattttaaattctctttagcctcctgggaatgggaagggctagctggtatagtcccctgtatctcagatttcagttacacataaacattaaaggggcctgacttagggcgctctttgcctctgtggactggtggggaaaatccaggtgtgtcttaaattctaataatcatgaaaatcagaaatcataatgtttcaaatacaaatcttcatacatgggaaatacaattgaattaaacattttcttcaatgtaggagacatttgtcagataacagaggggattctcatttggctaagagcttacctctaagattcattaaatgtgtttagagcatattttttgtagtttgtagttattttatttttctgagttattatttggattattttctcttttatttatgtatgcatttgtcactgctccccagaggcacctcattttggcattgaagctaaaaacccattcattaaggttgggatggagtgggctttgatatagctagcatttgggaggtagaaaatagacattcgtgatcaaaaaagctgtaagcggttactataaactatttttaaatttctaagtattttaaatattgaacaaatgtgtagacatttgatgtgcatctatactgtgaataagaacttaaacttctaatattcacattaactttcctgattttataaattctcgtttatttttcatctgaacattgaagaatgacatctacataaagtaaaagcaaatgttagtttgaacacattctaccctaatagtgcatgttttaaaattgctttggcaggatctaccaatgtattggcacattctcttcatggagttcctcatgtgataactgcaacattgcacattataatgggtaagaattcttccaaagcagttcatattttataaggaaatgttgatttatataaggaaggccatcttatttccatcagactttaagaaaaggcaggttctttgtctcttagagtagagaaatgtttgactaaaaaaccaaaaggcaatgctttactatgtggattgcctgtcttttcaaaatacttgctttgtaaagagcagtaaatgaagttttattgtaatctgtacagaaaaaaaatattgtagtgtgctcaaaattataattttataaccagatgaagaacattaatgaatactccttaagtatatccaacactgatgtaggactgtaccaagactctaggactaggattatgttattaatgaaaaaacataaccagaaaaaaatttcagccagtagatgtctatagatattttattatccctattggtaaaaagcatataagctcaggtatatgtaacactaaactactgttaaatctgtgtttaccttgcctatctactttaacttcgtttctttgaccatgttttataggaaatagcaataagctgaaaaatttagtactctgtgtttcttcactagtacctgaacaagttaaaaatggtaattattgtagttataggtaaagggaactgaagagaaagtgaggatgttcatggtctacagtacctttagatattctcctataagccaataaatatgctctcttatgtttgctgttttgatacaagtcctactgtactcactgattaatatttaatgtaatattcaagggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaagtaagtctttttcttaaaccaaaaattgtatcccaggttcaatgactgttaataacaaatttcattacattttagggcagaagactgtgaaatatcatttttaccatttaacagctctgatgatgtgcaagaaaggtaggtaaaaactcaatgtaatacagataacctgtatctttaaagcataaaacattctgacaaacaattgatcagacttaggatctttggttatttttctaacatagtagtaaagaatatagaatcacagactcttacaggtcctagtaagcaaacaactactcactcagcctttttctctttttccttccttctttcctcccttccttccccctgtctctccctccctccttccgttctctttttcccttcccttcccctttctttcctttcctttgtttttttccctttctttccttttccctttcccttttcttttgagtgcctactatatgccaggcactttgaatacaacaatgcaccaaaaaatgaacaaaacacacagttttgtccctcgtgataattttggtctagtgtgtaatacaaatattaaagccatattaaagaagggttatagtctttaaagaaatagtacattattattccttataatactagtttacctttaaatgaatcaacacattatgttggcagcaacaaaattgtacgtttttacttactatctaattgaagaaagtatttaacatatataatgatgagttctctaattttctcatatttaatagatttgtgtgtgtctgtgtgtctgtgcgcgcgttatctgttttatgtctttgttttgttttctttcttttaggagggcacagggatctcccaaatctggtgagtcgaaaagtatctccttgagaactgtgccaggttctgttgacattttgttctggtgagggaaaataaccaatcactttcattacctttagactgtaatgatcaatggcaaatgatccagggtcagttcttgaatgtcagcattatggcaattccttgcctgtgttcagtggcacctagaggcttggcacctaataccaggttagtaagcatttttattgaattgttgatacatttcttatagaccattttttttccagggtatccaattaactgttggttagctagaaacttaacaggtagtttatctttgtatattagagattctaagggatttgtcatcacagtaggttgagaacaactgttgaactggaataattatcagataatcattgactatttaacgtcactgaggctaaaataatatttcctaagttttattgatagaattttatgcctactttacttgatttattcatttagttgtggagaacattatattaaatactgatatttcttgtgaatgtctttgctttccaactttaatgcaaacataaatatccttagcatgaaaatcacacatatgtatatttgatactgtattagtctgttttcatgctgctgataaagacatacccgagactgggtaatttacaaaagaaagaggtttaatggacttacagttccacgttgctggggaggctccacaatcatggtggaagatgaaagtcacatctcacatggcggcagacaagagagcttgtgcagggaaactcctatttttaaaaccattagatctcatgagacttattcattaccatgagagcagcacaggaaagacccacccccatgattcagttatctcccaccaggtctctcccacaacacatgggaattatgagagctacaagatgagatttgagtgggaacacaaagccaaaccatatcagatacttttagtcaaaagaaacatttcagttctatttaatgtgaatagtagtgcatatcaatctcctgcccacattttcaattgaataaaatatgagacatcttatatatatctttttatccatgggatatagacattccttctcttgcacattcttcttaatcagctgtccattatggggctgaaaatatttctttcctgaatccaatcctgtagagtgtaggagaaaggatcgtgagtgttgtgaaatataggcaataaacggggaaatattcaaagttagagaagaaaaaagagaaactgcaaacttcgatattgaaaacccagatggcaaggtcctcattaattacatctagtgctaaaacttcaaaggagtattttgaaccttgtgtgatttagaaattgagcctggtggttttccccgacaccttcagaaatcctagatagctgtgtgctttcataatgtagtttccctgactaaacttgaagacgtggctagctgaccaaggagctatgtttggcaggacttgagacaatgtttatctaaccctgtttgtttaaggaccttcttgggagggtagacctgctcttctgggaacaatcgattcatagctccttcaaagccactccataaatgttctgcttgactagaattccactgttgactctgcaggcttaatcagtattaatgaatttttcagagaaggatgactaattagagatttcttctgtggtttataatcacaacatgccatctttgcaaagaccttttgatcaagactcatttgaccggagatttttcagagatgtagcttctgatgattcaggatgattgaacaggagatttcactttcttctttttcccccaccatgataaataataatttatgttagaatatctcagtgcaaattgccagtaggaactaatattcttatattctaagtattctaagattaaatgtgttcatatatgtgagacatttaaagcagtgccagccatgtaagttgtgtttctatttcaagtaaatattgcaaagcaggcataggatagtgcttttaatgtttataaattatgcaattaaagatgcacagtaacactaccatgaacgttttggtgctgtttatttttaattgggaagaagaagcatgatggaaagcatactgagcacctggagtattggtgctgatgaccattttttctctgtgtgcctttgaacaaatcacttaaacttggagttgtcttttccctctacatgaaatgagcgaatgatgagataatctctaaggtcccttacagctctgacttgagctttcataagatactaagagctctttttttattttgttgttattcttaaattaacttcatgtttgcactgaaatcaagctagaagtcatttgtatgtatttctgcaaactgcattctatagcttgatgcatttgtgagtggctgttttggcactaaatcacacctctgaattttcactctcttatattggatggaacagttatgcaagattaaaatgttcagtcatttaactgaacatgtgtggcagcatttgttcactccatttcatccatccaaaggccactttgatttatttcatttcctatgtcacttagaccttctgtctataaataaatatttaaatcacactttagattttagaaaatgttgagctatttgttacacaacttgtgcatattaactcttctataatacatcttttaacaacatagtttcacatttagaatttctaattacattgtattttaaattatgtcttgatatgtgagtaggacgcttgatggtttgctttgtaaaatgctctaatgtaagagcttattgagaaggaagccagtgatttaataaaactcatttgaaagcctgcatcatttaaaaaatagcaagatacggtttatgaattttaggtaaacgtaacatggtgatttatctatcttgtccaatactttcagtaaacagtatacttgttataaggaacagtatgtcataatttttggtataatctcttagtaaatttcttgatgtctaatagaaatatttaatttcagattaaataatggaagtatggctcttataattgcccgaaacacttctcggccagaatttataaaacacctgaaaagatatgccagtgtaaaaaatcaggtatagtaaattctttttgttacttatttgcaaagctattaatcatgtagaaaaagatgctgcaagaattgacatcgaatcctgcctcataagaaggttttattttcttctgaatatattaatcttctttttcccaatctatttcatccaaattttgaaaagcatccgccaggattaatatagattggccttttttgaatgatgaattagtggttatgtatctgtaaccacaaagataaaataggaaatgtagtgttatattgcaatgtgaaataaattaaggataaaattccatactcaggctgttcttcagaatgaaaagaagtgaaatttgagagtttagccttcttgatattatggcagcagactttctaaagttatgatctttagatcttcctgacatttgtttgcatatctgcattgattgaaatagatctgtagatatgtatttaaaaatatgacagttttatacaaatattcattcaaaatgagaatatgtgaagatatacatttccacttaagtgatttgctttaaagagaaacagtaactattacaagccatattattttggcagctgttttgacctgattattaggaaaatgatccttgaactatgtgaatttctgaaattgtgagtctttgaagtacataggtatggttgtaaaaccctatagtttcacactttttctttttctttctttttttttttttttttgagttagagccttgctgtgtcacccaggctggagtgcagtggcgtgatgtctgctcactgcaacctccacctcccacgttcaagcgattctcctgcctcagcctcccgagtaggtgggattacaggctcacacctccatgcccagctaatttttatatttttggtagagacagggtttcaccatgttggtcaggctggtctcgaaactcctgacctcgtgatgtgtccacctcggcctcccaaagtgctgggattacaggcgtgagccaccacgtccggcccacacattcttaaaggtataaaatggtgcttggatagagttgggagataacagacgggaggaggaggagagtaaacccagccaatgactggcagctgaaccttgcttatgtaccttagccatagcaagtctctccatttttgcctcattatattttaaaactttcttaggccatcttcatgaagtttgatctgtcagtaacattatttgatcctcatgtattgaacaactaactgggctgcttaggaacttaaatcataaaaaattacagtcccactttctttatatgtcaaagtagatcagcaggtataatgtaggttgtgagcctacataacagttttatgtatgtgtttgggtggaatatggagatttattgattttcaaaggaatatatgccctttcacattttaataaatttctaaacattaaaaccaatttttaaaaaacccaaagcactatatattcattgctgtttttaagtcagaaaatagaaacaagaaaatgattttaaagcactcaaaattccatgttcctcaagattagtgtcattaccttggtagaattttttccgaatccttttttattaaataaatgagaagtaaagtaagtattaacctcattcatgtacctctatttgagaacttaaatagtattaacctattaatgtacccctgagaagttctgtatttattttggggaggtgtatgttgcacaaattgtttatggaaggtctcttttgaaattgcctatggggcaagtctctcaggcaatttttgtaaacattcttcttcttcatttttttaaatcaatatacctttcttctgattttaaaagcaatggttaccttacacataaagacagacatacagaaaataataaaaatctgtatcgataggaagacgttttctaagagataatattatgcaggatttatcatattttctcatgtactctacgaggcatatcttgcttttgacacaagaaacagttgcctgtgtgtgattcactggccttaactctgatttatttatcaactttcaaaaattaaaatccatgctattttttttttttttgcaaagaattctaaaatattttgcatagtgtatatagtaagaaagattgattcccagggtgactgctttcaagcaatgttaatttgatttgttaattatccacacaggtgtgtttatttaggctctttccttcatggtgacattaaaaatgtgaatttatataaattttgtaagattatgaaaatcagatctatgtaaaaatcatgtctactgcataattcatagcagtgctggtattcaggaaggaaaatgtggcaattcagtttaaggagagtaacatctgcttctctgaaccatttttaccaggttgaataagcgaatgttactgtataacactgtaaaatagattgaaaccaccatgtgcggagtggctcctgttccttccccatctctgtgtaaaattagatagaggctgaacactacccttcaaagtccttgcagctccatcctattgctttgccccccttctcactgtccacacttttctctttcattgtgaccatttttggtagggagtttaaaaccttaaatgtgagtgcttcccccaggatttctttgcagccctctcatcttctcaggatgccgtctcctggatggcctcattgcccctcacttttgaactgtctgaacatcatgcactcccaagggttctgtcatctcgtcttatctgcaggacctctgtcttcttgtatgctgaagaggttctgaaattcaccggcatctggaggccaacatgtctacagccgaccttatcttttcccctaaagttgttccttctgcgttgctctgtgcgggtcaatggcaccactttctacccatccaggttaccctgaactgttccttcttcctcattcctcactaccagtcccctaacttgttctgttggtctcctcttaaatgtttctaaaatttctccctcaccttaattcaaactttaatcctttcttgcttacagtagcctccttttggccttcaggttctctggtcttgtcttccatacctctttttagagaaacttttttctaagacacacattggatttctctcctgcttaattcttcagtgcctttctcttgttgtcagaataatatggaatatcctcagtctggaacacgtggcctttgtatccaggtccctgcctgtgttgcaaccccacctcttattaccaccctccaccacattcccagtgttttggcattttattcgttggctaaggttgccataacaaataccacagaaaagatggcttaaacaaacagaaatgtatttctttcatggttctggaggctagagctgcaagacaatgtcagcaggtttggtttgtcctgagtcttctctctctggctggcacatggctgctttctcacagcacccacaagtgagtggtctttcctctgttcatccccgatgccttttcctatgtccaaatttcctcttcttataaggacaccagtcgtattggatgagggcctaaagacatcattttagcttaatcgtctctttaaagatcttatctccaaatatagttatgttctgaggtatacagagcgaggatttcaatacaggaatttgagggccaaggggcatgatgttgagcacctaggagtcacactgaattctgtgtagttgcttgaccatggtttgcctctagttttgtaaatgcttcctctctccagactttcttctccaggctaaatcttatatgttctttaaggctcaattcaaatgggaagctttcccaacatccatagcctgtttgcctcctcttgtttcctctgttgaactccacacttgcaccatcatggcactcccctgtatcaaaattgtaactgtttacttctcctccccgtgccccaaacataccctcacacaggatactaagctcttggctcccgaaagtcccacttaacagcgtctgtggcttcacagttaaagcatttgaaggatggctagatcttcattttgtgaggagtgcacatgacaactgctgatttaagataatagacttactggtggtggctgtcaattcttgacattccttggcttacagctgcatccctccagtctctgactctgccatccttggcattcttctctcataaggacatcagtcatattggattaggtcccgccctaatgacttcatcttaagttgattctacctgcaaagaccctatttctaaacaggggacattcacaggtaccaggggttaggacttgaacatagttggggtggtggagggaaatataatttagatcataacaggcagttgtgtgttttaaatgaattatcaactaacatgaatgattatgtagataattctacaaggatgaggcatgtagccaaggctttatacccgaggtaggaggtctaacgcagttactgtcaaacagttttgcttggggccctctaattctgtacctcagtcacaacagctgatgccatcatatcatctactgtttaactgtgtttacagtataaactggaaagttggctggaccttggtatctacatatgtaaaatatgggtgttggggaaaatattagttttctgtcaacttttaaaactgtttcattgaggtttacatgtggaaaaggggaaaaactatgtagatgatgtttaattaggaatgtatctcatgtcatttttctgaaaactgaaatgagtagttatacatttctgctcaagttatttggctatattttcttaattatgtcagaaaatacatagtgctttttcagtatagtttccttaggcaaacaagaaaaaacgcaagttgaagtttaccttgcaccattctatagtggtaagtaaacagtgatcttgcagcttgtgtccattgttaaagtgggaatggggcaggcaaacaccttttaaaatccatatttgattggctttctcttttaaaagaagacatacatcccattttatcttcagaagtttagacttgcgttcttccaaattaaattccaagtgtgaaacttgtactagtttgctttatgtcagctaaactaattgacaagttgataatggattatatgtcttctgtatctacaggccagtattaaagattatctttaattgaaaaatctacagtatcactattttatgtaacttctcacagatatgtactatttgtcataaaacaagatttctaggtgctagatctaaaagaacccaaaaggctttggataagagattccttcttccaaaaaaacttggagatccctgttcatagtctcaaagctattaaaatgtcagcatacatgctgatatttacttgtgagagagggctcagtgaactttgattcgcgttagtagctagagataaaccaagtataatgattatttgtatttatttttagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattaggtaagtctatttatttcaccgcttattgtcaaccagtaaacataaatctaatattacaacgaaagctctcttctctgaactatcaaagcaggcagttggttagtttttaaaaaatcagtaaatcagggaagcataaagagacatgcacaaatttcaataaataaaaagcaactttacatttattcaactgttatgtagacccaaggcattttctttggttatgcgtgtctacattggctttctaatttattgttgtgcataaactacagataatgtctacaacttccattttggatttttaaaaatggatcaagatcttaaatcttttagtggagccatctgaatagtaaagtgttagatttttatccttccatcttagtttcctctcactcataattactgtaacatgttttgttcagtaatttgcttttattaggcctttacagagcattcaacttcccttgggaacaattttacatagcaactggtataaacaggtttaggaacctgcaaacgcattcttggtaggcattgtgacactcagtggttagaagaagcatgcaggggtgcccactagacatgggtgttctagaggcataactgactgttttacagaggtaatggagagcattggacaatcaaggaagtcagttaaggaggttttagagcaattattgttgttgatgatttatcaatcagaccttctcagttttctagattacagctctgttgggaatgctgtgtttgttatcaatttgtatttggcattggcattgtgtaccatacttattaggtgtatgtgaaaaacaacaaaataagttgatgaaataatgtattttctttacagattgcatccaagacttatcagtctttatggaggaagcatggaagaaatgattccaaagtaacatgtaattgtttctaaaagaaatgtacaaactagaattttaatataaagaaatgtggccatgctttaaacctgtggtccccaccctttttgggaccagtttcatggaagacaatttttccgtggatgggggaatggtttcaggatgaactgttccacctcagatcatcaggcattagattctcttgaggaacatggcactctagatccctcacataccagttcaccatatggttcgcacttctatgagaatctaatgctgctgctgatctgacagggggaggaactcagtaatgctccattgctctaacctcctgctgtgtggccaaacggatatcctaatagaaattgatgttactaacaattagcctctagggctttaaaagtcaagatgaaatatcaattcaaattctgtttttagatatcaattcaaattcttttttttacaatgtgtttattggacacacaaaaaaactttgcaaccatcataatacatcaatatttaacctagataattctgaaataatttggattctttcatttttcaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttcttaaagtggtagggttttaaaattcatgatacaagtaacaaagtaagttgataacaaatactattttgaactgggcaaaatctagcccaatatgtaattgtgttccccttgtatctgagaggcctgtgttggacaaccatagtactctgctttcactgtgctcagataacctgaaatatatagttgtttctgagtagttctgagtaggaaagaaccaaatgtaaatttccttagagaccatcctggagaagacagttctaaatcggggcttgatttttcatctatgatcctagatgttctcctgaaagaatgactagcctttttataacgatacaaagttttttaaaaatacataaatgtcataaagtttattcctgtgtatacacactctgggttcaggaggttttgtgcttacatttcactactcaaatgccttcgcaaatctcagaacattcctcaccatcactgcaggcctgtgaacagataactttcatcaattaggatggctggctagtggcagggacttcatataaagaaatctttcccagaattgtttttccacattgccttctaatttgatcactccctataacagatgttcaaaattcggccacagctctcttatgaaggcagagtcagataaaatgatattctgcaattatctagatcataagcataaaataaatattacaaaaatgattgtatttaaagaaattttttaaaatccagaaagtcatttaaaatagaacctcatatagtatgaacaaactataaaaatattttacatttca

SEQ ID NO: 21 - DNA, 145347 bp, Homo sapiens
  mutation 6069: a/g SNP in forward strand
attgctatttgggcaacaatatggctccttcagaactggtcgagaatttctgtggtctttgcttgaccttcaagttgggagtttcaaatcagaggctttgaagtctggaggagttcgcagccattaatccttccggggttgtgctaaaggcgtttctagaaagagatcggaaagacccgttcagcacaggcccattgcatcttctctttgaaaacgcttgtctgaatcaagtatcttatacagacccgagactgaggggagcaagagcgcaggtccggctgtggcgaggtgtccaccaccgtacttgtggtcaatgcctggactagagagccgaggccgtccagggcgggctggccagggaaccagaagcgtccctggactggctgagtgagggtgccctttccagcaacccagtggccatggttaaaaggcagaatacaaccgtcaaagaagtccccagctcccacataagagagcgcaaaggccaatggaaccaaggcctcctcgcgagaactagctcgctttgaggacaagatcctggggatggaggtggggactgacgtagtgagagggtctggaggaacagtcgtagctgaaggtcaggacatgaagaattgcacgtatggtagggatagaatggcaggtacaacttttctgtactgaaggaactgggagaggacgatccggttagggaggttggggaactaatctcaacgctgcgtttacagatgaagccgcttttatatggcgtatatgtttgcttagaggggccgacggagattaggagaagccatcctttggcgccaatgatcaaagcgtctgccaaggagaagaagccaagggatgggcctttcagagagggcaaggagtcatgctgctctggatgccagtgtcaggacaagaaatcgaaaggagcgaggactcttcactgcgtgcctcagtctccccgcttctgcctctttcacctctgtcctacttccggcgcgaaagcaggccactcgctctgatctagacctagttaacattagcttttcccttccttccctcaaatcccctcccccctctatccccgtcccttctgccgcctgaaagggttaatctctcctgcgggtaaaaacaggtccgcggagtctctaactggcgacagatgggccactttcttctggccacaaaggggccggaatggagcgctccgcggcatacaaatgggcaggtcacgtggttccaggctcttggctggaccgggaagaccatatggcgcatgccggggaggaaggaggaggggcgggggtaggggtggagggtgaggggagcggttgtcggaggagggcgggagacgagcaaggcgtggggagaagtggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaaggtaattacagttctttcatttttttgccccagaatagaagcaataactgaagactgatgaacctacatattctgtatgtgtgcgtttgcgagagtgtgtatgtgtattgagaccagcatccccctccataattgcccataagtactcacacataatgagtcgtgtcactcaagtaccccctgcaggctttctaatttaaattttaaaaatttgggtttcttttgtggatagcataggagcttcttggattttttaaaagaatgcacggtaactatgattatctgctagtgctgattttaaagtcccaaaagcaataatgacttcactttctcacttcttacagtaagaaaaaaaaatctatgttatcaatatatattttgtgtgcatgtattttacgcacattgggagtgtcaagctgtgttttcagtgaatgaaagggacatggataccttgagtattcacaccatggaaaataaatcaggttcagagatagtttagttgagaggggggaaagtggagaaagggagagggactcactcctgctacctgttaccgctccagaggcggccaagtccccagcagccactactggagccagaaattcagttgttttactaaaggctttttattttccttactagaagcggcaacttcgcggttgccaatcgctgaccattataattactcaatcttttaaagggaggtttgaggcgaactttgaaaagccccaataaagagcgggcggccctttcaatgggctgtttattagagaggagccttccgcacctgatccccggcgcgtgggagagcgctctgcgccgcgcccccagccctcgccctgcagctagcgcttttgtacaaggtggaaatttagcggtgggccagagatggaaggcaagaaaagaaaggcgagggaggggtggaagaccctgtccacttttgttgccaaatgttacattgatggtgaaacaatttggtggaaactatttttcctcctttctgcatttgcttttcagtatcccgtcgatgtaatcttcttaaaaatcgctgccagtattagtaaattacgcaatggctgttcaacttaaatcgctaagtatctggaagccaggacagaaatggaagtagaatgtgtgattttacagcttttttttttttttatggagttgtgagtaactttgaacacatttggataaacatgaagtcgctgaaatgtacagtcatttccacacacattatcctgtcgggcaaccaccataaacacatttaagttaatcactaggatacaaacacatatgcgtgagtggtgtacacatatacatattcactaccctcccccagtcctgtcctcactcctacgtactagcggggcacacgcacgcgccattataaaacactgcatttaactttttctcagaggcattcattttgtaatgggcaggtacttttcgcaagcatttgtacaggtttagggagtggaagctgaaggcgtatctggcttttgaatatagcgtttttctgcttttctttctgtttgcctctcccttgttgaatgtaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaaaccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtgagagcaattgttgcatttcttcttaaagggattctgtttttatttttggggaaagtagttgcttttttgctgagttaaaaaatactaaacactatatgtagaataaaagaaaagaaaaaagtttaccttggcatatgctcttgtctgtttatcttgcacagggagtcaccagttctatgtagataatgaaaagacctaactgatatttcattatttggaatatgggactggacggcagtacaaacagtgtgtttttttctttgttttaagtggcttagcctttaggttttttatttccatttttaaaaatgattgttacatgttttcttctatttctttttttaaaaggtggattttaataattattaacaagcaagacataaacaagtatcctagcttagtttgtctatacatttaagatgtataaaacattactattttcttggtcttctgttatctgtacatttttctgaactaaacagttttatcttgcaaactagtactgtcccagraaaatttatacacctttaggaagtaccaaagggaaatgagttaattaatttaaagaatccaagagaagtaacattttataattgttctattaacatcttgtgatgatttccatcatttttccaagaaaaagcataatggattatttgtactgaagaacacactatttgtactgtatttaggaaggtgtaattatttcctccccccaccctttggggcactattctgttgtttcatgaacacaactcactggaaaaacttatggatgattctgtctattgttaagtccacttcaaaaaaaaaaaaacagtttggcatttcttttcctctggatgtattgactgacagtcatgattcctagggaatatcattttggcacttgtgccctggctctactgtggtgctctgattactgtcattagtaactccattgtttctactctgattcgggtgccacattggatgactaccccccttcccaagcttgttcctttaatctccttctcattggtgatttaggggttccagaaagctgacctcatttagcaagctgctccagaaaaatgtgagtaatgtaatggacaggaacaattagccatactaataacattgccaatgaggctgcgtcaagctgtgacagaagcagtaaggaatacttcgacgttaaaaaaatgtttgagagcaatttaaaatatattattttaacatgttttctatcagccttcatcacatgacagaaatacttttaagttagtcccaactttatctaaaatgcagcaatctcattccaagtgaatcagagttgttattttggaatcaagctgttgctttctatatcctggattgttctcactgttcttactttaagagacataatactgatatgatacttgaatactaccagccttccagtgtaggaggtaatgaagtgagcattcagatctgatctaacctattaagtagctcaatttcacctgcaattaaaattagacatcttcatgcaaactaaaatctgttgctgtagtgaagagaagaaataaaagaatgccattttgagaattccagcttccaaaatagcaaacagggaaatctagactgtgttcttttgtaaggtagaaatgaagactaaaagttaggttttttttttttttcttcccattttgccaatacaacttcattctaaaacatagggattctttcagtcagtcaaggagtaactcacatgccaccatcttttattcaaaggcaggcacagatgttccttctgcaggggaggatttaatttatgaaaatgatattgtttatgcatgaatgaactgcatgcactctgcataacacatagcacttccatctgatcagagaaataccacagaaccagtgccaatgtcagaaacatattctacaaatttactcacttaaatgtttaatgaatatttggaaggcattttcaaaccataagaaacattttaaattatcttcttttatgaattcctacccatatttaaaagagactcttacagtttttgtaattggctaatgcttatacccagtttgtaagaaaagaacatattttactaaatgaaaaccaaccaaaaaaaaatgctggcaagtttggcttcactggaaaaaatatttcgtttagttttgctgtttaatgcttgtcatgaataatatttgggattctatctgtttcttcatcttgagccacgactattcctatcaaataagatgcttaggtatacttgtttaatgtgaaaatcctatgaatagttatttctagaaaaagctggtatgtaaaatcagggggaaatttcataaagatgaaattgggctaaatattgtaacatgcataattactattgaataggaacacttcacataacatattttactttatataaccaattgcagctatatagtatgatctatctacttttaatcattaaaacaattatatataaattaaaatgaaagattataatatcaagagtgttctactaattttaggtttataatatgttacagtaaaataccatttgaaataaattttgtgttctaatttatcttaaaatctctctgtttttacatttgaaagtccttacattcttacaaaattaatgcattttctgaaagaagctagcaattactaaaatgatatatggatcattagctaacagtttgaatcaagctgttttagttctataattatacaagaaatttaaagtgaaaatacctattaagcaattaataaaactaggtttcaaaatattggctaattttctcctaatgggaaatgtaaaatagcaaaactgcttcttaaactacacaaaaacctcctcacttctccttttctctctctctaacaccacttatttcctgaaaatcatctaaataaaatatttaattccagggtctgatgaagaataaaagagccaatgcaacatcttgtggaacaccaggactgagaactcttgttgttaccattgcaaagaggcgttctggcgtcagatgcacagtgatttgtatggtggcataatcattggctcctggccaggcattatgtttcagaggacactattgtcaagaaccattcaactagaaatctgcactgtatgcactcaaaagttgagatcatctgccttcctatgacaggaagaattctgtgctggcaattgactcatggactctcttcacatacactaaggcttggtccagtggctctgatggaattaactgtgcagccaaactagtggcattgacaagacagggccacagtctctggggacttcaggagaaattgctaattttaaaatgcagagtattatgttaatgctggattaaatcttcagatacattaaatgtggatttggccatctaagcattattatgttatttgcccagttaatttagaggtagatggatggtgacaataaccatctctacagatccacaattctaagagatggatccaattgtgaaatgatatggagagatagagtaagttcaatctagcatatatgaagtaatttggtaactgacttttcttttaacaagatcaaaagctaacctgctttacactttcatgtctaaggacagccaaccagagagatggcttcacacactagcccactgctaagtgcttttcattcactttcatatttcatcatcaaagcaccctcctgccttatttatagatggggaaacttcaggaagttgagatacctagatatttgcattcctgtcttcctttcttcattcaggtttttctttcattgccacttcctcaaagaagcttttactgattcccatttaaaatagcaactgacttcaactccaccaaaatcactgtattgcccctccctctttccagagcatttgcctatcaaatgttatcttatgtatttacttgtatagcttaattttaaactatctatctctaggtcttctgagcacctgagaaacagagacaaagttgtctcttctgtgtgttgctgttcctctggtgcttagaagacctagaggatcctcaataaatattaactttccaagggaactgaagagcactaatgtgatgctaaagcctgttgccttaaccactatgctataagtcaaatcagttgagaatggagaggaccacaaattattttcagtccagcaagtgttataaacattaattctataaaaagaaaacaattgaaactaatttcttattatattgcatggcaccaaactccccccacttcctttttgaggatcatgagttgtctgtcattgtttctttttattgatatcaattggttaaatataatctggaattggaataaaagaaaaactattataggctttttccagaccatgtatttcaatgcatattattttttcctttctgttcattattctttcagtaattgcacttgttctatttttagtgttatgtaaaattactgtagctcataatttctattttgaagggttcagtgtataaacttagcacatcaatactatctttttagtgttcgcgctcaatggtgtcagttaagagatcaccatcacttttggtgacgtcaatgaaggggtattgcaatgcttaagagaactgttaatccctttccactggtgtcactaacaattgtagtgcttgtttattcatagcaggtacgtgactaagtaatgttaacatcaaagcagaaagaggataatagagtgttctaaaaagaaaattcggtggttgggtgcagtggctcacacctgtaatcccagcacttttgagaggccaatgggggtggatagtttgagcctaggagttcaagaccagtctgggcaatatggtgaaacctcgtgtctacaaaaaatacaaaaactagtggtgcatgatggcatgcatctatagtcccagctactcgggaggctcaggtgggaggatcacctgagcctggggaggtcaaggctgcagtgagacgtgattgtaccactgtactccagcctgggtgacaaagtgagaccctgtctcaaaaaaaaaatgatttgagataacatcacttgtcattgtttgttaactgaataatctttattctagccagtgcctaaatacataataaatgatagtacaaatggatataaattataactaaacctaagtagtgatatttatcacaatatttctttactagaagaatttctttgttaatagaggcaaggctacttgtttagataccttaaaataacataagatttttggataaataaattaatgattctttgattctgactggcatattaaaaatattaagcgaagagatctttgcttcccaggttttattttttgtctaattaactactggtgcatttatattaaaacatattgtcaagggaaaacgtatatatatatatgtgtatatatggtgtgtgtgtgtgtgtgtgtgtgtgtgtgtgcacacatatgctatacttggttgagtagtatccccttcccttgcccacctctctcccaaatttatgtccatccagaacctcaaaatgtggcctcatttgaaatattgtctttccagatttaattaagatataagatgtaaattgatacaagttcatgctggattacggtgggccctaaatccaatcactgatgtcctgataagaagcagacagaacacacagacacacagcatacaggaagaatggcatgtgaaggcaaagacagagactggagtgatgtgtctacaaatcaaggggccccaaggatttggggcccacatcagaagctgggaaagagacaggaattctcagcttctccttctgaatccctaagaaggaatcaaccctgctgacaccttgattttaaacttcttgtctccagaactgtaatataatacatttctgttgtcttaagctacccagttgctggtgatttgttatggcagccctaggaaactgataggtatactaaaatctctaatgaattgatgttaaatatatataagtataggagagttcatttaaattcttctgaaaatgtcttcttaaacttttaatgatacagtatataacaaccagtatacgtagttggtatcgggtttgacatttaaacaagctgacaaaaaacagctgtttaataaacatctgaattatataaaagttttattgtttattattcatgtgaatgacttaaactgacatctacatttagtgaagtgtgaatgggcctagccaataaactatgggtaatttttttaaagtctcatctttgaactcacaaaaaattatcaaatatcagctattatgtattcttcatgtgaagaaaatgtcatatttatttgatttgtggattagcatatatattaatagagcttttgaaagaacaaatgtagcactttcccgatttcatagacactcatttaacacacaagttcatattttaaagtacataattttaaaaaaattctagtccaaatgaatttaagtgccatgacttctaaaaattctgtctctatttttgggttttataggaccttgagccagtactcttctggtgagcttaagaggctaagacttcacctttagttatatggggctttcatctgattatttgtctattttgattgctctaaatacaagttagtgtgtatttcatctgaatgtatttcattataagttttggttttatgtagatctggggatctgtcttgtttttaatcttgattggtctgtttgttttgggatagttggtactttcatttcttatgcttgctttctttttcattttgtgcccacctttagtcaggtgaacatcagtaaggaataaaattttatttttttaagccactgaaaaaatttaaaaaccacatcataactctgcctctgctgactgataaaaatgctaacttattaagacaaaatgttatgcaagaagactttattggaatagagaaacatcctttttatgtaagaaatatcaacagagacatgtgcctttcttgtgacaaatgtggtatgtgtgtggattagaggtctggaatgtggcagcatttcagtacttggaggggagaattagagtagggtagaaagatagacggggagcagaggatgattctcacccagtagaaagcagagtgaagaaagaaaggggaattgttttttgcattatattatttgaactgtggattaagtctttccataagccatccctacgcctctaagtaggttttattaacttaagctggtttgagatgggtttttggtcacacacaagaattgcctgatacaagagaggctttgattttgttgttgcttgctcatttttatacactaagatggagaaaaccctggacatagtgaagacgaaattgaggaaggtgttgggtagagtggagggtagaagacctgtaacataggtacagaattacattaaactggaaggacttatatccagatataggagtcagggtagaaagagagaatgttagcagtaagggtaacagagtagcagaagtttattcttaccaggtcctgttatgtgacagtggaggcatgttgaccttctgactaggggagttaaaggagaacactgaaggtttagaataatgtctctaaggatagaaagagaaagtttcatcaagactcatcaataatagggcagcagggcttagggccaagcaaattcagagaccatgatattatagtagtttgtagtggtcttaatccatctaatttttcagcattttctcaatggccaatacttagcagtggtagtgttttatggcatttggacaacagaagtgaaagcactggtaagagagacgttgaagtgaaacaccatggggctcagaaaagcagagttgatccatctggtacatgggcaaggatggtcctgaacaattctgcagtaagttggaagatagaaaaaatacctaacgaacttgtagatctgggtaaggagatttttggcagaatattgtaaggctaattggcttctcttaactatatgagatagggttttacaagggagagataagcgagcataatttagaagaactatagggggtcccaggcagactctctggctggaaaattattctgatagcaagaaattagccccaaagcaaagatgaaaagtagggtacttccaattaaacatgtcataagggcaagcctcaatcaagagtgtggctagaaggcacagctcacctggacaaaagtgcttctaagcatattaggagcatataccacaataacctgacttggacccaaagttgagagaggccagtctcaaaaaaatttgagggaattgcttttgcataatatgatactttatatacatatctgttacatatcatatatatcatattaaaaagaaaaaaaaccctgtttttccttccgttctttcatataacccttctgacaacaaatgtggagtttttcacacactaagcaattctttagttcttgctggacacttcctggatgtcctacaattcaactcgattctcacacaactgcccagagtcagtgcagacccgcagattaaaggcttagccccaaaagactaccccccactttagatgtcaatcacaagtctcaacttcatttacttctgaaggacgagctatacattggaggaaacccctctttctttcaataatttgctagaatggctcacaaaactctgggaaacatttacttatggttaccaatttattataaaggatataactcagaaacagccaaatggaatagattcatagggtgaaaaatgggggagaggcatggagcacaactctctcagcacctccatgtgttcaccaacccagaagctctcagaactccttcatttagggcttttatggagctttatcaagtaggaatgattcatgaaatactggcattggtgattaacttaacctccagcccctttcccctccctcaacattgggggtgaagctaaaagttccaactctgtaatcacagggtgagcttccctggcaactagtcccctgatccttagggggcttctgaaagtcacctcattatcataaactcaggtgtggttgaaagggatgttttgaataacaaaagatgcgcctttttcctttatctttctgagttgtttcaggagctagggacaaaagactaatactataacaacaacaacaaaaaattcaatttttgcttttatctcttgggaattacaaggattttaggagctctgtccagaagccagtgatgaagatcaaaatacatatttcttattatatcacaattcacacatgtacatgatatccgtaagataagtgaactacataaagtaagctcacaaagtttctgtaggagttttgtccatttacaaacagtttgtaagctaaaagtatctgtgacaagcctcagtcaatttagaagttcatttttccaatgttaaggacatgcctgtgacacagcctcagaaggtcctgatgacatgtgcccaaggtgatcaggctacagcttggctttatacatttagggagacataagacatcaatcgatacatgtaagatgaatattagctcagtccagagaagcaggactactgaaagtggaggcttgcaggtcacaggcagattcaaaggttttctgattgggaattggttgagttattatcttaagacctggaattaataaaagggaatttatcatgcagatgaagctttaggtagcaggcttcagagacattagattgtaaaggtttcttatcagacttaaaagagtctgttctaacagtctttaggtctcagtgttgatgttaatgctggtcagctgtgcctgaattccaaaagggaggagagtataatgaggcatgtctgagtcccttttcccatcatggcatgaactagtttttcaggttaactttggaatgtccttggctgagaggaggggtccattgagatggttgggtggcttggaattttatgtttggtttacaagtttaacattaaaagcctctgtacctccaatgttttatggacaaaaagaaggctgaaaaagctacttggctgtaatcatgggccatttcttgctgaaaagaagaataaaatggaggcagaaccaaaagcccagaggctagagccaagagctgctgagaatgatgaattagggaaccactctcagagagcagatctggatgtgagataggaacattttctttctcagggtctatgaaactggcaacatatgctctcctgaatttcagaattgctatggaccagtgactgtgatatgctttctatatttttcccttttgaatgggtgcatctatcttgattatcctctgtctcattattgtatgttggatttgtgtgggacgataacatgtgtttttagttcctaggttcccagaataagaggagcacactcaaagagcgacatttatgagatactggatttttcacttgatatcataattgggtgagacttgaaagaaagtgaacatattttgcaaatgggagggatgttaaccactgacaaccacacccacagggtccactgtattagcctatctgcaaagacggctgccaaaaattccttctgtccatatatacattcccttttttaatgtgactgtttcacctgccagcaactgaagggctttatttccatttccccttgtgacttgtttgactaacagcaagaagcaaaagtaatgctattccaattctagacctgggccttaagaggcatgacagcttctgcttttactctcttgaaactcaatgtcattttttaaaagctcaggctagactactcatcatgagggaccacatgaaaagagataggcccagctagtttccacccattccagccgctccagatgagatgccagacatgcaaatgaagccatcttggatatttcagccccagctgagcttccagctaaatgtaagtacattcagttgatacctcatagagcggaactactgagctgacttcatccaactcacagaatcataatgaataacaaatcattgttgctttaagtcaatacatttaaagtttttttgttatccagttgtagatgaattatacagcctggggggaaaaaggagatagcacactgttagttgcctcatcaatattcatccccaaattctttttcctttttagtaggtctcacctcccacctggaagctgaaaacacctttcccagtctctctggaagctacagcacaggcatgttgcccaattctaaacaataggacatgataggaggtctgctgggtgggatttttgaaaatatttttttttctggttaagaaaaaagaaatgcccaaggaaaacctacaaatgccccttccattcttgcttttggacattttttgggagagggtatgatgcttagcactcctgcagccatctcggggccaacaatagaatccttgttgctacctggtgatagtgaagtagaaagctacaaagctcttgatttcttttcttttttttttttttttaaattttattattatactttaagttttagggtacatgtgcacattgtgcaggttagttacatatgtatacatgtgctatgctggtgcgctgcacccactaactcgtcgtctagcattaggtatatctcctaatgctatccctcccccctccccccaccccacaacagtccccagagtgtgatgttccccttcctgtgtccatgtgatctcattgttcaattcccacctatgagtgagaatatgcagtgtttggttttttgttcttgtgatagtttactgagaatgatgatttccaatttcatccatgtccctacaagggacatgaactcatcattttttatggctgcatagtattccatgctgtatatgtgccacattttcttaatccagtctatcattgttggacatttgggttggttccaagtctttgctattgtgaatagtgccgcaataaacatacgtgtgcatgcgtctttatagcagcatgatttatagtcctttgggtatatacccagtgatgggatggctgggtcaaatggtatttctacttctagatccctgaggaatcgccacactgacttccacaatggttgaactagttcacagtccaacagtgtaaaagtgttcctatttctccacatcctctccagcacctgttgtttcctcactttttaatgattgccattctaactggtgtgagatggtatctcattgtggttttgatttgcatttctctgatggtcagtggtgatgagcattttttcatgtgttttttgactgcataaatgtcttcttttgagaagtgtctgttcatgtcctttgcccactttttgatggggttgttttttttttcttgtaaatttgtttgagttcattgtagattctggatattagccctttgtcagatgagtaggttgcaaaaattttctcccatgctcgtgggtaggaagaatcaatatcgtgaaaatggccatactgcccaaggtaatttacagattcaatgccatccccatcaagctaccaatgactttcttcacagaattggaaaaaactactttaaaattcatatggaaccaaaaaagagcccgcatcgccaagtcaatcctaagccaaaagaacaaagcttggaggcatcacactacctgacttcaaactatactacaaggcttcagtaaccaaaacagcatggtactggtaccaaaacagagatatagatcaatggaacacagcagagccctcagaaataacgccgcatatctacaactatctgatctttgacaaacctgagaaaaacaagcaatggggaaaggattccctatttaataaatggtgctgggaaaactggttagccatatgtagaaagctgaaactggatcccttccttacaccttatacaaaaatcaattcaagatggattaaagacttaaacgttagacctaaaaccataaaaaccctagaagaaaacctaggcaataccattcaggacataggcatgggcaaggacttcatgtctaaaacacgaaaagcaatggcaacaaaagacaaaattgacaaatgggatctaattaaactaaagagcttctgtacggcaaaagaaactaccatcagagtgaacaggcaacctacaaaagctcttgatttctaatgacatcatatgggatgaaccaacccaggaacagcctgactctggacctcttttaatgtcagaaataaaatcttatttgtaaaccactcttagttgttcaggttgttgacacaggcactgaagtgcctccaaatggtgatgaataatgaggcaaaagtcaaagacagcaagtctagtgtcaaattttttgatgcctatgggtaagaagttcaagaaagtgagctattttctttctttttaaaatttatttttatttttgtgggtatatagatgtatacattagtcagctattttcaatagtgagaagggatgttgccacttagtataatgcctttttcatagctatcatagaaaccatatatacatatagtatagaaaatgaggatagatttctgacttaaactgcctatttcatttgtgtgcctggttacacctaattcaagactctacaatacagcattgctagcaattactgtgagaatatttcaagctccctatttgctggaaatacatttcatttttttgttccaagtttatgaatattagaacctatctaaaaaggagcttttaaaaacttgaggaaaggaaaagggagggcctacttttcttgcctgtgttatttcttgttactgctgattgagatgctagagatcatattgggtgagatgtgtcttagaatacagctgagcaattcacttttaacagtttccatctgagtacaaaaaactggtatgtgcagaaaacttgatattctgacttggcgggattctaggatttgttctatttttttctgtaattgttgtagggacatatggccctgtaccttttgggcagcaggagccagaatagcaggaacattctgacaaaattcccactcagcatgagagggaagcagtccccttgatacactgatgatgtgcccacttagcattacaagtgtttgagaggtggacacaactaaaactcacctcactcaaaatatatattgacacggagaaagtaaatacaatttgctgttattaacctttcttctcaccattgagacatgttaaatatctgaaattaataaaggaattaaatttaaaaagtttacttatcatgcatttaacacatttattgagcatctgttatataaatgcactgtttcaggcacaagagatagagccataaataagcagattaaatcactattctcaactgaggtactaatctgatataagagaggagacagaaataagtaaacattataaatcaactacatacttttacatggtgtaaagtgcaattaagaaaatattattgaatagaggtcaattttggaatggttgggcagggaagaccttctgaggtgacaagaagttggcctgggcaccatggggagctctaccatggtgaaaagtgttccagacagagtagacagcaacagcagaggccctaaatgagaatgcacttggcttatctggagagtagaatgaaggccagtgtggtaggacacatactaataataggagaaaactgatagaaaagagggtttgagcaggtgggcaggaattggacaacatggtgtctcatatgtcataatagaagtttggattttattctacctgcagtgagaagttcttaataaaaaaaaaattctataaactggagtttgagaaagaactatgttgatgatagcataagccctcaatcacttgtcacataaactccaaacttcagcagagactcagggagatcaaagggactaccacaggattacccactggctaaaattcagatccatggcagttggtcctgactggaattagacttccttgtctgttgccctcattgcagtgggtctgaatgtctctgtcggctgtgaatttttctccctctatctgtggcactgagaaggtggcccagacttccagagtctgtctcattggcctattacttggggatttgctgcccttcttctggaagtttgggtatttgttttcagagcatacttaaaggcctcctgaaagcaatgttaacaatagcaggatatattttacagtcttctactcagacttggatttttaagaaccagggatggagactgtgtttccagatctagtcaaatcccttccaaacataaagcaacaaagtgccttttaaactaggacctgtactgtttaatgctctggaaacaaatacccaagcttcagccaaaggagggaaagctatgttcaggaagcttcctgaaagttttttgaaagcaattttcatgcattagtattttacatatatatatatatatatatacacacacacacacacacacatatatataaacatatatatatatacacatgaatcactaatgagacaattgatcttcaggaactaacgtgaaataattggggtatcttggtattattgttatagataaatgttgaagaagttcattctttcagatattaattgagcacttactgtgtactaagaactgtgatagatactggggatttaatggtgaacaagataaattctctgccatcagggggcttatattctaacaaacttaaaatttactgagtgttctctgtatttcagtattgttactaagtacactaacttagtggggaagctagacaataaacaaagaagtatgtaataagaattaatagtaagtgctgtaaagaatactaaagcaggttatggtagagagattaatggcagcgtgaagatgtccatgtttcaatccccagaacctgtgaatatgttaccttacatagcaaaagaggctttgaaaacataattaagggttatctgggcaggcccaatgtaatcataagagtccttatctaagacgggggacaaaggtcaaagacagaggaaaagagacgatttaaggatagaagcaaagaggagagatgttagactgctggctttgaagttggaaaaagtgaacatgagccaaaacaaacaaaacagaacaaaacaaaatccacaggtgacctttagaaaaggggtccccagtctctgggccatggaccagtacctgtctgtggcctgtttggaaccaggctgcccagcaggcggtgagtggtgactggtggacaagcaagttttaccacctgagccctgtctcctgtcaggtcagtggcagcatcagattctcatagcagcctgaatcctactgtgaactgcacatgcaagggatctagtttgtgctccttatgagaatctaatgcctccaaaatgctcaccccttcaaactgcccccatccgtggaaaaactgtcttccacaaaaccagtccctggtgccaaaaaggttggggactgctgctctagaagccagaaaagaggagatatattttcctctagagcctacagaaggaatatataggcctgctggcaccttgattttagtcctgtgaaactgattttggatttctgacctccagaaatgtaaaacaatgcattggttttgtttcaagtcactaaatttgtggtaattagatacagcagcagtaagaaatgaatacacaggtttacaggatggtgaattatggagggtgctcaggaatggcctctttgaggtggtggcctttaaacagaaaaatgagcaaagtgaaagaatgaaccatctggtggggagaaaagcattccagtcagagggaacagcaaaagcgaatgctctgagaagggattattcttctcaatgtgtttgaggactggcaagaaggctttgtgtgaatgagcaaggggaaaaagttagtaggtgatctcggagacatagccagggtccagattataaaggacctctcgccttgctaagcattttgactttattccaagaataatgggaagtcaatggaaggctgtgagcagggttatatgctctcgttattttttaaaggcacaatgtaactccaaaatggaaaattggctctgggctggaggtgccagcacaggggaaaccgaaagcagagagctgggttgggagagcggagactgaagttgtccagctgaggggtgcagaagtgcagactgcaatgacagcaggcagaaaggactatatgttctagacagaatggacaggatttgctggtagattggattgaaggcatgagacaaaggagacatggatgatatcaaggattttgatactacagatttgaaacattctgagagggacaggtttgtgatggaaaatcatgagtctggttttagatatgttttagaagcttattggacagccaagtagagatgtcaggtagggagctggacataatacctaaagttcaggagagtggttggagctggtgacatcatttgcagaaccctggatggtacataaagcacgggacagtgtgtggatagatcctaaagagagccctagggcactccagccctggaagaaggcagcttatcaaaggaaaaagaaagaaagaaggaaacacaatccttattacttccatcttcaggacaattcaaagccagtgtttttgacttcctggcttgagtgaagcttgaaaaatggcaacttgcccctttgcaaagctcctaaggagtagccattggcttggcctgtttgcactggctctgggtgagcttttaaaatgccagtgagctctaattgtgttgattgcctaacagctgtgaatacaagatgctgactccagaactgcaactcattctgcgaagggcaccgtccttttccctctaatgactgctgaacagagccacctgaagcctgcatggggtttagcagcagctgcacttctgctctaagaaatagctcactgcagtcagatcaaactgaagctcttccttgcttttcctcgaagcttgggtacttattgtcggagcattaaacagtaagagtcctagcttaactggtgcacagtgctttatgtttggtagggatttggttaggcctacaaaccgtctgagctaagaaccttgagaaactcctgctatagttagctctttctgtgactctgcagtgtgaccaggaatgaggacagaattaagaatttgctgcctctatgatagaactgtttaggcactagaacactggaactagatctacaaccctatgaatttaatttccttttcaactcccctactccttcttttcaatatgatgataatgatcttgtttaaaaaaaaaaaaagccttctgctttacttcccactctgctcctcttcccagggactcactttcttcttgactgcttccccattacaagtactcagctccctgttttatcaccctgcttagagcagccattatcagccttggctgaacattggaattacctgggaacttttaaaaatccggaagtctgggtctcgcctccagagattccagcttagttgtcttgagcgtggcctggacatttgggttttcaaaagttccctatgtaactttaatgtgcaaccacaattgagaatcactagcctccagactctctgtgttatcaaaattaatgagcagctgattttagaaatctcagttatcaggagaaaagggtgaacccccccagggctcttctccttttccaggtgacacttctttatggcagtgcgtgaaagtgaagccctgctgcttgtaatctccctcaagggagtgcaagatccaggcaaagacaagactgcagaggcgctaccttgggggaaagtaggaccctaaatacttacacctggaggcacttacctttaatactgaatttgtcagatgcaaatttgtctatgcaaaccagggccttatctctagcttcccctcaggggttttgggaagtgcgctactactctgaaacagggttgtaaagcgtcacctgtgctctccagggaaccctctggaaaggaggtggaaaaacagaggcttccacccttgcaactctaagtgtgttccttggccagtgggatccatcacctagtattttcttagatatgtggtatctgggggccagtcccacacctatgcaataagaatctccatttgaacaagatgcccaagcgattatatgcaagtttaagattgaggagggctggtttaactcgagggtaacgaaaagtacgaaatcgtactttacaggagaagctaggcggagggagccacttattcttcctcttgcagctgggtctttttgtggtgagtggcgaagcggcgaggctggcaggccagggtgctggactgggtcaggcgcggccccgcctccctcctgggtccctgccctgcgcgccgttgctgtggcagcgctggacgcggctagagctggggctgccgcgccctccacctccttctccaaaggcctccccggacccctggctcgggcccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgagtgcccggccccaagcgtcttcgcctccctccgcgcttcctccctctccccggcccaaggcctacacccacgagcttttgctccaccctccccttttctcgcctcccctccccgtgctcgcctcactgcccggacaggttaccgagtccccaagtcgccgcctcctccttcccaactgggaactcacgcctctcgccccatcccagaacccccagggattctttcgctacctagccttttcccgcctccgagaccttccccgggcaaacgtcacaagcagcttttgctcagagtctcagcagaaaatcttgagccccaaaggggaggtaatttacaaatgtgagaaggtcaactactcctcccctccaagttgaaaaagttttaatccattaactttgatggtacattgaaactataaacatctcacagattatgcctacacaagagttctgaatccaactctcattttgctgacttgaaaatgtaactccagagctttgggagtgtttctgggtttttttctgcccctcaccttccttgccattgtctagaattaagacttcttcaggctcggtctagaaacttttgatttttaatattgaccctagattattggatcacagttttgcgatgcttagttacgtcaagcggtttgcttaacgtttgccttttattgacttaaaattttagttacctaaaaaagttataatgctgtagtttacaacaaatacttcgagtctattttcacgtcttagtcaaatagccttatagacttaacagatattttataaagaccattttgcaagtcttataagtagactttcatatagtcttatttctaagtccaaactcgagaaatactccccattgttgaattagcttagatgtgagcggtgaaagacagatgaaatgggggaggaactacatcaaggttactctacttgcgaggagatgacttgggggagatggaatttggtattcaacctcttttagctaaatacaaatttatgaaattaaaaaaattgccttcccctgttggaaaacaagacacagtgtggtatttatgttacagaatagactcactgtcttaaagtcttgctcaaaagtctaacaaaatgaaaccaactagccagggattcagcactggttgcgattgtgaattctgcctgtgctgcatgtgccatgctcgctcgcttcacgaaaacagtctttgaccttaaagtgttttcaggtgttttaaaaaccaaggtgtagtattttcttgaaccttttaagttaaaagctagggatatagctatggaattatttgtaagtctttcaggcaattcgagttatgcaatatagaagtttataattacagtttggattagcccaaagagccagtttaacctacagtgcagctgaaatgctatagaattaaaatgagacattgtgcaatgagaggtcatacaaaccaatgttgcagtatttgtgtacaaaaaaagcaaacaatgacatgagaaaagaaatgctgttttatattgagtggtgattaaggtaaaataggtttaattagtgcacccctggcagtagagtttaaaatacatcttgacagatttgtaactttaaaggttgcaagtactgattctttgtttaattatgccctaaaaccatttggtggtcttttccttcatacaggtgtaccctttttctttgtaattaatacctggtattcaaaccactttgggcctctaaaattgggggcacagaagcctagagccttagtaagtacttctgtttatggaagaaaccaagagatgttttatttaggtaaaatatagccaggcgtggtgtgtccctgtaatcccagctacttgggaggctgaggcaggtgaattgcttgaacctgggagttggaggttgctgtgagcggagatcacaccactgcactccagcctgggcaacaagagtgaatctccatctcaaaaagcacaacaaacaaacaaaaacaaacactgggaaataagaaggagatattaagagatgatatatttaaatgttagaaatgctctgttgttgaataagcttagatgtgagtggtaaaagattaaatggaagagggagctacatcaaagttactgtacttgggaggacatgatatggtaggatgtggtggggggagagcatgtccattgctggttggcaagtgactggctgcctcagaaaaggatgagggtgggtaggggagatcactggagattattagaacatacgtatgttttcaagattgcttagtttttaaacctcatagtactttgttttcactgatgaaataaaatactatgtgatctttttctaattttccatcttgagtaataagcaaagacattaatgtattttatgaaggctctgactgccaaaattgggacaaattgatggtcttgttggcagggtaaatgagcataaccgtagtaattgtagttctttttattgggttcagggatgacctggaataatggatgtgttattacccttccctgtagaagtgaggctttcgaaaagaggctataagtcaatttgggaggcacaaagtatcagcgctttttggggattttttttttttttaagtagagaaatattttaaatgtgtgatataaagttatgcatgtgcttcttaagcacattaactcaaccagatccaacagctggtctaataactttttaattgtttaaaaaaatttaattgacacattgtaattgtatatatttatgagatactatttgatgttttgatatttacgttgtacaattatccaatcaaagtagttagttatccttcacctcacactttcattatttccttgtgggttagaacattcaaaagactctcttctagttattttgtaatatatagtattttactgttaaccatagtcaccatactatgcaacaaaacaccagaatttattcttcctacctagttgtaactttgtgtcttttgactaacctctctccatccttccttctcccctccccttcccagtctctggtaactattctaatctctgccttatctatatcaaccttttataatagaaaaagattctacatgtgagtgacatgtggtatttgtctttctgtgtctgggttacttctcttaacacgatgtcctccaggcttagcattcacaattgacaggactttattttttaatggctgactagtattccattatgtttctgtatcacattttctttattcatccattgttgtacgcttaggttgattccatatcttggccattgtgaatagtgctgcagtaaatatgggattgcagatctcttcaacatactcattttatttcctttggatgcatacctggtagtgggattgctggatcatatgatacttctatttttaattgttttaggaacttccatgctgttttccatattgactgtactagtttacaatcataccaccggtgtgtaagtgttcccttttctccatatctgtgtcagtacttattttcttttgtctttttggcaatagccattctaactggagtgaggtgtatctaattgtggttttgatttgcatttccctgatgattagtgatgtcaagtatcttttaaatgcacctgttgatcatttatatgtcttcttttgagacctatcaattaaagtcgtttgcccatttaaaaaatcaagttggccaggcacagtggctcacgcctgtaatcccagcactttgggaggccgaggcgggcagatcacgaggtcagaagatcgagaccatcctagccaacatgatgaaaccccgtctgtactaaaaatacaaaaattagccgggtgtggtggcacatgcctgtagtcacagctacttgggaggctgaggcaggagaattgcttgaacccaggaggtggagattgcagtgagccgagatagtgccactgcactccagcctggtaacagagtgagacttcatctcaaaaaaaaaaaaaagtcattattattttatctgttgaattaattttcttatatattttggattttatccctttgtcgcatgtatagattgcaaatatttttctcccattctgcagctgttttcactttgttaatagttttcttcaaggtgcaaagttttttagtttgatgtaatcttattttgtctatgcttttgaggtcttattttaaaaatccttgctcaggtcagtgtcgagaataatttcccttttttcttgtaatttcatagttttcaagttttacattttaaatctttaatctatttttatttttgtatatggtgagagggaggggtttaatctcattcttctgcatgtgaatatctgattttcctagtaccatttgttgaagagactgtctttttcccagtgcatgttcttgacatcttaaaaattcagttggctgttgtaggtgcaaaaatttatttctgggctttccattttatttcatgggtctgtctggttttatgctagtaccatgctgtgttgatatagttttatcgtatatttcgaagtcaggtagtatgatacttccagttttgttctttttgctcagggttgctttggctatttggggttttttttgtggttctgcatgaattttcagattgtaacatttctgtaaagaatggtgttggtattctgatagcaattgcattaaatccatagatcactttgggtagtatggccattttaacaatataattatttcaatccatgaacatgtactatcttcccatttattgatgtgggaagataatttctttcatcaaagttttatacttttcagtgtagagattctttcacttccttggttgtttatttctaggtatctttttttttaaaaaagtactataaatggaattgttttcttgatttttcacatagtacaatattagtgtatagaaatgctactgatttttatatgttgattttgtgtcttgcaactttactgaattctaacagttcttttgtggagcattttgggttttctatctataagatcatatcttctgcaaacagggacagtttgacatgcttctttctaatttggatgctcgttacttctttctcttgcccagtttatctggctagaactttcagtagtatgttgaatagaaattgtgtaagtggccatcctttccttgttattgatcttagaattgatctcgttattggtcttttcccattcagtatgatgttagctgtggatttgtcatatgtggcctttgtgttgaagtacaaactttccatacctaatttgttgggtttttaatcatgaaattatgccacattttgtcaaaggcttttaatgcatctattaaaatgatcatacagtttttgtctttgttaatgtgtatcacatttactgctttgtgtatgttaaaccattcttgcatgcctctgatcccagtgatgaatcgcacttgaatgtagcaagttatctttctaatgtgctgttggatttggtttgctaatatcttgagaatttttgcacctatgttcatcagggatattgtactatagtttcctgtgttgtattgttatctgattttggaattagggtgatgcttgactcatgaaatgagtttggaagtattccctttgcttcagttttctgaaatattttgagaggaattgatattggtttgttaaatgtttggttgagttcagcagtgaagccattcgtttctgggcctttctttgatgaaagactttattactgattcaatttcctcacttattattggtctggtcagattttatgtcttcctaacttaatcttgataggttgtatgtgtcggggacttcgttttttctatgttatcaaatttgatgaaacttgttgaaaaccaactctaaattttgttcatcttttgaaattatttttagtctctatttcatttatttctcctctgagttgaattacttccttacttctaccaactttgggattagtttgttctgttcttttttttctttctttctttttttttgagatggagtttcgctcttgttgcccaggctggagtgcaatggtgtgatctcggctcaccgcaacctctgcctcctgggttcaagcaattctactgcctcagccttcctgagtagctgggattataggcatgtgccaccacacctagctaattttgtatttttagtagagacggggtttctccatgttggtcaggctggtctcgaactcccgacctcaggtgttctgcctgccgtggcctcccaaagtgctgggattacaggcatgagccacaatgcctggccgattagtttgttcttaattttgtagtgccttgaggttcatcattaggctgtttgtcagaaatctgttgtcttttttgatatgggcatttaatactataaacttacctcttaaaactgcttgtgctatgtttcgtaggttttgttatggtatattttcattctcacttgtctcaagaaaaattttaatttcctttttaatttcttcactgacccattggttgtttaggagcattttgtctccatgatttgtgaagttgtcagtttttctcattgttgatttctagtttatttcttttctttctccttccttctttccttccttccttccttccttccttccttccttccttccttccttccttcctccctccctccctccctccctccctccctcccttctgtattgctttgtctcccaggcccaagtgcagaggcacgatcttggcttactgcaatctctgcctcctgggctcaagcaatcctctcacctcagcctcccaagtagctgggactacaggtgtgtgtcactgtgcctacaggtgtgtgtcactgtgcctggttaaatttgttttttgtttttgtttgttttgttttgtatgtttagtagagatggctttcgccgttttgccatgttgcccaggctgttctcaaattgctgggctcaagcaacctgcccaccttggcttcccaaagtgctgggattacagccatgagccactgcacctggcctgatttctagtattataacgctgtggtcagtaaagatacttgatattatcttaatcttttaaaatttgttaagacttgttttgtggcctaacatgtgatctctcctcaagaatgttccatgtgcatttgagaagaatgtgtatctgcagctgttggacggaatgttctgtaagtgtctgctaggtgcatttggtctatggttcagcttaagtccaatatttcttgatctctctgtgtgtgtttgtgtatgtatgtctagataatttattcattattgaaagtgggctgttaaagtctcttactattattgtattggagtttatctctttaggttgaatatttgctgtatgtatctgggtacttaggtattaggtacatgtatgtttataattgttatatcctgttgttgaattgatccctttatcatattatgaccttctttgtctctttttacagtttttgacttaaagtctattttgtctgatatgagtattgctactcctgctcacttttggattctgattgcatggaatatctttttccatttcttcactttcagtctgtctttaacggtgaggtaagcctcttttaggcagcatgtagctgagttttttttccagtcctgcagctactttatatcttttcattagataatttatttacattcaaggtttttattgataagaacttatttctcccattttgttacttgttttctggttgtcttgtagattctcagttcttctttctctcttgtttacctctgtggtttggtcattttctgtggtcctaagctttgttttccttctatctcttgtttatgtatctgttgtaattgctttctttgtgggtaccatggggctaacataaaaagtcttgtagttataataaactattttaagctgatagcaagttaactttggtcacataaaaatactctagacttttttcctccgccatccctaatttatatttttgttgcctttatttctttagtatgtgttccctagccattgtagctgttgttgtttttgaccagttgtactttaaaccttcatctagaggatcgacaggtttacatagtaacatgatatcactggggaattctgagttggatttatacatttacctctattggtgaggtttatattctcacatgtgttcatgatagttatcattttttcatttacagctgtagcactcctgtaaacattgcttgtaaggctggtgtaggagtgaattccctcagcttttgtttgtctgggaaggcctttattctcctccaggatagttttgctggatatagtatcttttgtccttggccgagactcgtttttttttgttcttttagcatcttgaataaattatccctttctctcctggcatacatcagtaatttaatgttactgatgagaaatctactgatagtctaattaggattcccttacatgtaacttgatgcttttctcttgcagattttagaattctctgtcttcaacttttgacagtttgactataatgtgccacagagagaatctttttgggtttaatctaattgggaatctttgtggttccttcatctggatgtctatatctcccccaatatttgggaagtttttagctattatttcattaaataggttttctgtgcctttcttcaacttttctccatctgccagttctataatgcaaaaatttctttgcttagttttttttaaactttgggttatttcacaaaacctattttcagattttgaaattctttcttctgcttgatctggtctattcttgaagctctcgattgtgtcttttattcactgcattcttcagatttctgtgttttaaatgatagatcttgttttaatttctcattttataactttcctgatttcattgggttgtttgtattctcttgtagcctgctgaatttttttaagatcattatttttaattttgtttcaggcattttataaacacccttttctttggggtctgttactagagactcactgtgttcctttggcagtgtcgtgtgtccttgctttttcatgtttcttgtgacatctgcacatctagtggaatagtcacattttccagttgtatgcagtagctttcacagggagagacttttcctgtagatgggtcctagagtgttggttgggtatggtacattggctttggtttggggtggattcagtaccatggtctctgtgtagtttcgtcagctgtaatcttcacagcaatgtctgatttcctcagtggcctaggctgcaggagtttttgatggtggtatagttttgctagggacaggcatgtcatgctagttgtcaggctggacacttgcaggctcggagggctgacaagctgtcttttgggctccccagggaagagaaagtatgattttccagcttttcttctatgtttatttaaaactttgttgtctggctcacagtgttctttatctaaagtctagccagtggtggtggtcatattgcaatcattattacagcttcagactttctagaccttttccattttagtgaccttcagccttcattcgcttccattcatgaccacagaatagatgtagtcatctctattgaaggcaaacccatcccatctcttcagcttcatctagaaatttgtttcatctgttacactttctttctttggtttttagccttcattctctaccagctctttcacttaagcagagatatgttcaagactctcccattctaacagttccctgccttgatcctacaagcttttctctttagctgctaccttgctttttatttttatttttttctcacttgctctgataatctcctagaaaaattggcttactctgaccatctccattagttcacctcttaattattcttcaaccatctgagacctggctttgttctttctctactgaaactcttcaggcagagattagcagaagtcttctaattgctcaatgaagtggaaattttcagtccttattttctgtatttctccttcatttgactttgacttaactctcttggtttttgtaataccaccagcacctagtttatcagtctctcatgggaacttcattctatctgcctgccaaatggtggagtcccaaggactgtggtctgatctgctgttcctcattacatgctttctggtcagtattgcacactgtggttctcatctaccatcatctacctccagaagtgccatatatttagtaagtttacaagaaaagcaactttccttgctccgtagactaactctgatcttttgttccctatcatggttatggaactcactaattattcagcatcagctgtcagaatgtttaactttgctatttaggtttgtgtaagttatgggacaataactaggataactagaattagcttgtagcttatgtgggttagataatacaattgcatatgtaagtagtgaatattttggcttaataagtgaaggagtatttaggaagctatctggaatgttatctaagtcaggattctgaaggtaactctagcctcactgtcccttactcactatttctaaacacccaccaatcctgcctactttatttacttggtatttctccaatctgccatccttctctgtccgaccaatcactaccctagctcaggccttcaaagtctctcacttgacctactccttcacctcctttgaacctgtgcacaaatgttagcttcttagtaaggctttctctggtcacctgtataaaattcccatctgctacatacttcctggttccctgtattgccttatattcctcagtggcatttatctccttgtatactatataatttctgatctctgtcctttctattaccaccccacttcaagatggcaaggatttgtctgttatattagtgactgtcctaataggaaaaaaaatggcacatttatattagagtaacttgagaagaatttttaaaagtcagtatttataaagctgtagatatagagatagtgaagtactcttgggactagtaatcattgggcaggtgataccatttttaagcccaaaagggcatagtgaaagagcaggtgcctgaacctggattcagagagactatgtagaggaggccactaggcaggagctgtggcctttgcctcagcttggctgattacctcactaatcctcactaatcctaaattacccaagttccttcttttctggcccatttcacagtccaaagccaactttaagccagagggcaaggggagcacttgatgcagtccatgcagtatggcctcccagtgaacagggcaggtggaggatagaaactaaatctagatggaggagagggaagatattcagaatatgttttttctttactgtcagcaccttgaagagtgcctggcatatagataatatttattgaatgaatgaatttgttactggtttactggcctcatgaactttagttttgcctattctattataacttggtgactacattcctatatacttgataccaactcctcattaactacaaaggcagtattcccctctccccctttttaaacatcaaaactcttttttaaaaaaaattcttaaatgaatcgccagtatataacacataaaagtatgggtgccttgattggagtggtgggtaaatgatcctgagtctgtctgtttgggttccctctttgcctagcaggaatgtgactgtcttgtttaaagcccactgaagtagaaaacaggatgagagacacactcttcaacatggcataagatttccatgcttggctcctgcctatctctgcatcctcatttctcagtagtttcctcatattttaccatcctgtaattgaaagaattacaaaactagttctctacacaagctttcttgctgttccagctgctgggaattagcttcctttgtgcttttttttatttgaatgattcatgtttacattcattaaaattaatgaagattcattacagttgttttctctttaggcataattggatctcctatactgagacattgaatgcaactttgattgtttttttcccccattatatgttaagctccttgaggttcttttcaactttgcgttattccaggatttctatcgtaagagttaaggttcatccacttctctgatgtgaggttcatggcaggaaggttccatgttgctcagctgcagagtagaaaatactgagcagggcttaaatagattaggatgctgccattataatataaactgtgtttacgaaagagcatcatcaattcagaaaatatctttttcattgactacagtggtgcctgatgatctttctattacaatcttaaattatggtcattttaattatagaatcatacatgggtttatttatgttaaaataaggtaattatcaagctagctgtgacctatgagaaaaatcctgaagaaatgatgaagggatcaggtgactgtttttgaagtcaagtgtgaaaggtcagaccactctgggtcatgggaccctgccaaggcagagcaggtcaagtgctgtgcccagtggggccaacccccagtatggtgccagggactgggtgtgagaagtcaaaaattaagaatacacctcagaaaggggacatggacagatgccacagacttatttgcgtatttcatgatttagcccttagcttgtgctgatactggatcagatattttcagagttcagtattttcaaaagcatcgctgatcacctgttggcattgttttacatctcaaccaaggaaaaacttttgggacatctgtttaacaaggggtaagcttttatttgaaatgttcgattaaagcagaagagtcaggcatttttttgtgcctccccaaagaaagatttgtttactgtcctgtgtgaataaatataatgtcattatttcccgtaaaggaaaagctgatggggagagtaagtaatgggtaagattaggcaatgttaagctcatatattagtatgtttaagagtgatcaatttagggatctctgtgacagagatgccaaatgctcacagtgctatctcatgttggaaacatgtgtctcctccacttttcctcagtcctctgaaatgacggccctttagggattgacagatactatacagatttctgtgctgatatgtgatttgtctaaaacaaaagtttcacaaaacaattcttaccattgccatttaagagtcactctgatatgctctgtttccattgcaaacaaatgctcattatgatttgtgaaattaacttcacaatttcctaatggataacaccttgaagtatgaaaagcactacaggatcttttatagcttccctcctccagctctctataatctgctcccatctgtggtgtaggaaagatttcagcagtggccgctgaaggccctaagatcttgtctcaacagatagcaaggtgcataacagactttggacaggttgtttaacatgtctgagttactgtttattcactggcaaaatgaagggcttatattatattgtctctaagtactatcagttctgaccacctatgaactttcattttaaagaaaatacctatttctatggcctttaggcattagggaattttgtcaaattaaataaatctcagtaaggtttgatggtcaatggggcccactgtctggtgtgtgtggaggggtgttgtattttacatcaggaacttcagagccctcatgaatttctaattagaggaaccacctgggaaatataagtcaaagccctttgctcgccttactcagctttagggcacagtgactagaggtgggcaatcgctttggtgtaggtattgtcattggaaaggaagaaaccattttctggaggaaaagaattggttgaggctagctttaagcagctatttcatgatggacaaaaggactagctcatccattcttcattcgtttctctgtatcctctatcaaatttctgagtaaagattttatacaatgcttgattagcattcaaatagtatgtttcaaagattttaaaaaaaataaaactaggcctttgaatcataattatggcttataactctatttttcatatacttactatctcaagttacaaatttcatgttatgtttttttcaaaagagtattcctgccacaactcagagctcagctgaattagagcagtgactagaaaatctgagaaggctgagcttcaaaataaggtctggaaagtgtttcttattgttacaagagagtcaaaatgattttcttgagctttaagtttatgtaagtatttacttgacacttagcagtttaaaagataatgtgcaaaaatatgaaaatgagaaaaaacaatttcaaaacaagagttggtgattacgtgagacttagtagagcaaagtatattctaagtattaatctgtctaagctgtttgggaacagatgtacgtgaaatggataccgggtgttctgttgtgtacaccccaagtgagacatctgttggtagactgtgtggtcagaaataatggaagcaggggttaaaccccaatatgacctattactcatgtgaattattgaaggactaattactcagtaaaacatgatgctttgattcatcagtctacacgttaagaaaaaagcctctttagaaaaaaatttagttctgtttctaagctgtcaaatttgaggaaatttttaagatgtatgcaaagactcaaatttccatagtaactgcaaatactatctgcttataaagttttaaaatgttttgacaggtctactaatttatcataaaaatagcctcaaaagttttagctttttgttagggtaggttgggtctcacagaaaacaaatgtagagtgaattttctaaagcagggctgtccagttagacttcctgaaatgatgggagtgcactatatctgaagtgttcaatacagttaccaccagctacatgtggctattgaacagaaacatggctagtgtgactgagaaactgaatttttaattatatttaatttttattaatttgaattcaataactgcatgtagcaagtggcaactgcattgtacaacacagctctgacacatggagagttgaaaatgtttgtttactttcttcccaagttttcattttagtctttgtttctacatagaaaggaagatatagcttttgaaaaatgaacctgaatgtagaactgatatggttatgcaatttgagctgcctatttaaagataaagcaactgagtttagagatttcaaagtggcagagtcctttaacatatttcgtgggctggccacggtagctcatacctgtaatcctagtactttgggaggctgagatgggaggattgcttgagcccaggagttcgaggccagcctgggcaacatagcaagaccccatctcagggaaaaaaatatgtgtatatatatgtatatatatatatatatatatatatatatatatatatatatatgcatacacatatatacatatatacacacatatattaacatattttgtgtgtacaaaaaatatttttattatgtgtagattagttggttactagtaaagttgaagtcttgtctatagaaatcattgtatttttcatggtcattgtgatacattgtttgaactgaaatttggcaaattcaatctgtttcttactacaagaatagtacatagatttgaaatggtaactctcttagtctgtgtactctgaccctgtgaacgtctggagactaatgttattcctaaatatgctatgtccacatggcagcatctgaaggcaaacactttttaaaactgatctacttttgtggacccttcctctctctctttcctgcatcccggatggggccctctggggctggaactggcacagaactattcccctaggagtgggttcattgaagccaagggacacacaaattgagaatcagatagactggaccaaggtcattaaaccagagagggcaatccagatggggttgtccaaagtaggaagttctgaagtgaattgcagaaatccaaacatggcaaagctaaaggaatagagaaccagggcaatggatatagagaacagagcaattgggtatgcaggaagatgctattgcctagactggatgtttttgtaccctctgtaatttgagaaaatggaccgtccttgttgaaatggtcagggatgtagtagataaattcattgcagttgtgtaatctcagcactagaatactgatcataaccatatcacttgttatcccacctagcctgccacttgattgggttattagattacatttcagacattgacaagtctacaagcatcattaaaatcctaaacacagacttctgaccgtattcctacccaagttttagaagcactatgccaatgacgggggtagtatatgctgagcaggtgagttttgattgtgtgtgtctacatgtgtacgtgggtgtggtgagcaacaggaaggaactctcagccatgactctaaatgctcttgtgttggccaaaattggtataagctaggaggagaaacacaaaggagagagaggcatgaagttgaaggacattaaaccatttgcaaacttttggcatgcaaaccagaatatgaggaaacttagtgtaatgggtgactgaattcagaggtagacaggcaatcaggaaggtataggcaccaaaaatagttaccattggtgagcgtttttgtttttgtcattggcatggtgttatgaacttatgttaagcctaagggtaagtctaaaataatgtaccagctggcatcagggaattcccatgtacattcctagattttcattagaaacagtgttctggaaactaccactgctgctacacagcagtgcccagtgcttgactgaaaatagtgaacacttagatttgtttactctgccaggttctgtgctaagtatcttatcttgtttaaccttagcaaagaaactatgtagtctagatagaatttttatccctagggcccagaggtgttaaataacttgcccaaggtcataccagtaatttcagttgctggggttcaaagctaggcagtctgactccagagcctgcactgtccccatttggttatgttgcttccccagttaagcaagcaagagtctatctgacatctgagttggtggtagtaaagcatcatggtctgaaccaaaataataaaaacctttgaaacaacattatctgacttctttcaggcttttaagacagttccatcatcaacagcttattccatttctctggccacttccagtttctgaacaaatgaagaaaatgggagtgataaattggagtttttaacaagtttttttaaatctaattttttttatggaaaccaccaaacatacccaaatgtaggaataattatgtaataagtcctcatgttcaaccctaagaggggtgaagctctatgtgacccattactgagtttaaacagttttcaatttatggccagtcttatttcatctatactctacccacatcccttcttcccctggaatgattgaagtaattcctaggcatcatataatttcatctgtaagcatctcagcatgtatctctaggagataaagattttctaaaaaatcatattactactcttcaaatttaaaataatctttatagttttacatatccagttagtgtccagattttcctgatattttctctattttttaaatatgtcaaccttgaaatgaggtccatattatagctgatggctatgccttttaaattttctcatccacagattcttcttccttttttttcctttcaatttatgttttgaacaaactagtttggcctatagtttctcatgggcaagaataaccttcagactgggatggccatcactctgatacccgtaaaggggatgaggcaggttggggaagggagagcctcagaccatgatcagatgtcacaagatttttgcttacctagggtgaggacttgggaaaaagattgcccattaggagtcctgccttgggcaaaagtggccaaacttcagctgtgctgtcacaggctgtgggctgccttggaaatgtaggacctcaactcctctgaagttgaggtggagcttgagggtacgaatccctggtggccattataatgactacactcattgggatggcatggcaagttcatcctcaaagatggatcctagcatccaccatgaccaatgaggtttttttattgttatgatcactataaactcaaggatttaaacctattaaatgtttttcaattcacagcaatgattatttttactgatcttcaaattgtcacattttggatttttagaccaatgggagccccttcatcttgacttctgagttcttttgacattcactcagctgtctgatagcttccctgctttctggaatggcaagatattccaggttcatcttgaacatttcatgcttgagatatggaatcaagctcatcatcagagggtcctggttccttttactggatagtggtattagagacctcaatttgagaactaagcaacatcattgctaaaacttcccctatgtgtaccttgttacttaggtttttcaaagaacagagctagaaaatatgttgggtttttttgttttgtttttaaagaaaaaatgtatcataggattatgctgatacttccaattcaagtgcaggcctaagcttttcacattgtctcttttctcctacccttaaagtcctgattcctaactataacaacatcattactcatttgctttatcctgcattatgtagacacaatagagtaacaacaccaatgctgccaatcaaaagtataattactgaaacccacttaagatagtcctgcaatttttttttttgttcatagagtgtacactactagggaggtgtagtcaaattactatgttttaaagacacttggaataattcatatctgtgaagttatacccccaacttatttgttttttgtattattgtttcattttgcttttgatgtttaggcatttcttttttaaaaatcaattttataattacgtgaaatacttatatggttccaaaatcaaatctactaaacaaactatattctaggaagtatagcttttatgtttcccttctatgcttttccttccttcctgtaggtaggaaagcttatttgttcctcaaagctctgggttgttcttttattttatataaataaacatgtgcatatattcttttcattacccccacagtacccaccgtcttaaacacatgtacaatatatgtgtttttctaccttgatttctttcttacttagcaatatgcccagaagttcactctgtagcgctttacatcagcatcaaaatccattatgtactatcgtttattgacctctctgttggagaaatttggattgtttctagtcatttttgttatcgcaaatagtggtttaataaaaaactttactttccgttttttgtttttcaatgtgcttttaggatagatgcctagaagtgagattgttgagtcaaagaataaatgtgttaataattttgctcaatattaccaaattctttcaaaagggttgtgcaattttgctttttaaaatcattattgtataagggcatgtatttcctgaaaatttctccagaagagtttattgccaaactttaaaaaaacagcctgatacataataaatgatatctcagcatagtttaaatttgcatttttcttgttaaatcattcatgtttttactgtagtcctcctaacatttagggagcaccaattatggggtctctagaaggttccaggattctgtaatcaatttgacatgatttctgtcttcagatattcacaatcttcaggaagatatattgacaaaagaataactacatgatctattttgtgtgcaacttagtacttacagagcattataaatgcacatggaaaaataggtaaaggagaaaatcattctctgttgggcgggctgagggggaagtcaggaaaagctacagagaggttcgagggtaaactttaatgtgggccttgaagtatgatttggagttagcaagacagacaaaggagcaaggaaaccattctagaaaaagaaaattttgaaaaatctccagaaaaggatgctttggcctatttggaaaataacattgtcttatttatgggggagatgacagtgctttgtttttagtcagtagtttatacaggactttgaatagcatgcaaggaagttggcgtctcaacctgaaaattgaggaaggtgtgacaaaggctgggcattaggtgagatcaagtatttctgtttttttttttggtaaattaggtagcaggatagattataaatgggctccacactgaggagcccagtgtgatggctgatccagcagatcagggggcagtggctgcaaagctgggagaatggcaaggtaagcctggatgcaagggatattgtcaaagacaaaatttgggggatgtgaggcttaaaagggaaataaataatggtgatggtgagatttctagcttgggcagtgggatagatagtagacgctgcgcaaattcgtttttaaatcagcagaatgagaagcatcttatttgaaatatattctaccaaatcttagcatcaaatgtgctagtgactagcaaaatatgtaaacagaagggaagtagcttgaaaagtacacaaactggagaaattgctcctgaaggactgtaagttgaacccttttaagcctaagatctgtatttcctatgagccctaggctctttccttgtgtatcctgtttcttattagagtagaggctacttaaaaataatcatagtttaaagcgctctattttcagaaaacattattcattagatgttagtaaataatgtaatctttatacattcataatatttctgcattattggagtgtaaaaagtcagtgaaatagtcatttgtaaagatgtcagtttttatctgtggaaaatagctgttcataccattttaagcttaaaagttcttcatttacttcttaaaatatccatgttggtattattttgtctaatacaagtaattaatatttaccccaaattaagcttttaagtttactaaatgttacaaacataattcaaagcactgtttagtgtccatctgtgcaggaaaaataagatcaatacaattgagcagctgttagcatgtattggtttccttatattttaagtatgttttcatgttttgaaggtgtaaagggatgacagtatgttttgttgtggttttcatcatacagataaaaacttattacagttgaaatcttggtgaacataatacattttaaaatttccattcctcacccatttatctagatatttagacacagtaaaataaataacatggatacatttttgtcatgtgatttatgttttttaaaaagtagaaataaatttctctaaaagttatttttattttttaaatttagcatttttcatatttgaggaaaaaacaatatgtcttggtaccctagcttctgaactaataacacacctgtcattttacaggttattttaatgtttttcattgggatcaaacctactctggaaatatctcatgggtgagctttatttttatgaaatgttcttggcacttgaagacctttgtaggtacatgccagactcatcttacatccagttcttctgcatggaaaatatgtgcattgaaattctaagtgccttttcaaatttgaccttcttagagaataatatgagtcccaacaattaggaaaactatggaatgccttttggcctttacttttcaaagattttcagtcagtaatgtttaattagcattcattgtgtacattgtccttttttgtgtgatatggctagttccaaaggaatattctagaagatctcagccttctgctattgaaggtgataatacactactaagttatgtgttgctttacattaaaataatgttgcagcagttacttattgcttaactagcgggtataggacatcaggttgaaataactgattttgaagtgaagagttcttgtttatatcttaaactaaccaagtatgttcattaactttgagaataacaatgatctttttcattattcttgagtagactggataaatcagaaaacccatgttagaggtccctgtaaaaacttcagtcttatttggtaagtccctttataagagtttcaataaaatcaggtaaatttaaactctgaaaattctacgtactgtctatcatgttcaatttactgttaaccagtactatgcactggaaaaaatttttttcaccttaatgagaccactggtcattactgctgctactgatgctcttttgtctgcacatactgttgcaacataatgtgttgtgcatttgatacggatattatcatattgccataaggagctgctattattttagacaccaactgattccatgatagtgtcagatttctttaacatatgcttatgtttttgtacaaatgaccccaagaaacatctgctagttttgtggtggtatctactgtttcttttttagaatttgacctgtcagtcactttttaacgtgaatctacaatatttgagttgtattcctttctcgtttttatgctattgatattaacaaaattgagtcagttttatggcataattcagagagaaaccgaagctgtctatggatgttattttaaaaatacctttttcatgatgattgtgcctttaaatttttgtcattgattgacactttaaaattgaaaagtgcccttttaatggatcctttaggttccaaaatcttaagttgaaaatttctgtctattggtcctgaaagtactctctgaatttgataagtatgtagtagttgtggtgtatccttggtcagtttatatcctgtgctaattgctaatcttacttagtttctttgatgcgtgtgtgaagacaggcaaagaaaaaggaagtggaatttctacaaaactgtgaaatctttactttatggagactagagaaatttctaagtaaaagaagacactcattctattgtagttaggatcccttcttttacttgcttttcatgatcttgactgaaaagcaacaattgagatttccattgcccgacgctttctcttctgcttttctttttgtttctcttgcatttttaaagacagctatttattcaaaaacaatatgaacttttatttattggacttaaacctggaacatcaacaaaacaaagaacaaacaaaactacctttccaaatttattttattagaggatgctatcaatacaattttgtattatgttcacacttgataccaaacctaaacccaagaaagtgtgtcctgtgttacagcctatccctctgtttaagataataactagaacaatttacttttattttctactcatctgctttctgtgtatcagctgttgtcctccctcagcctcgaagcatgtcatcatttccatctccgtgctcattcagtcatccttgctgctcttagtcccctttttgtcccttgggtgacttatgtcattaggacaaccttctgtccccacttggctgaaactgagctgaggcccttgccagttgcattaggtgtggcacctttcatggctcagtttgggcctctgtgatatctgtgtgccttctactccaaactccattctgccagaggtggcagggtgactggaagctttagtttcagtgacaaaacccaagcgtggctatgctgagtgtctaagtagctttcatttaggcctgaaataggagagtcaggcgcctctgtgtcccctgagaaagagagatttccctcagctctctgggcccagcactcaaccatttaagtcagctggttagtataatttccctaaattgtggtttagtttccctatgagtaggactggagtaggaccaagtaaggaaagtccctagtgacctttctgcctcctgaggagcaggccatttactttgagttgtagcttcccatctgtctgtccccactaccctatccaaggccctggaggagccacaggatgagggaggagattcatggaaaagcgccttcaggtactgggtatgtctggagtaacatttaaagtttaaaagactctttaacaattttcctctgatacttactactgcctatacttgtttggttttagtacagtaagttttgcctatcgtgggggtgaagaaaatagaaatattcccattaactttgtatggtgcttggtatgacaccctgaacaggtgcacccgtaattgtttacttgatgttctttttaataagtcaattatatcatcggaaattgaagaatagcaaagttaatttgtttaatcattctatgggaactcttgcatgctcgttcactagaggaacattgcgtttctcccttaaaggacaaggctttgttttgtttttaataagacacactctttataattaaaacaaaatcccagtgttaagggatttctgttttaaataattggatttctttcctttgttcctctaatccctctatatgagaaaaaaatctaatggtgtcttaggataaatatttttagattaaaaagttctcttaaccactgaaatttaataatacttctcaaagtttatggatgatatagaatgtaatgtaaggttgagaattttagatttggcaaaggcaaagatacaaaaactagtgaaaaacaacaaactggaaacacttttaaaatactgatgtatttatctttgcaataaattattcagaaatataaataaactcactatttacatagttttatttaaatttgtcctcaaaatactaaatttagtactatatattttcttctttcagataaatgctttcctgaaaatggtattttaatatctacagatggtttagtttaacaatggttggggtaaaaatgacatagggaaaagcaaaatgtgacagcccagcttggttacctttagagaaactcagaataaactctattcccatttccttctctttcccctttccatactcgagagcccttttctgagactcttaagtcatgtttgggccttggagaggataaatagcagggtgggtggtaaaaggggagagtgctttgcttgaggcaaagttttcctccatatgggaccttcctcaagccctcccttcaaaccctttaaatgagagcatgagctcctaggacagaggtcatgtggaaagcagcattagcatgaaggggggtgctgtggaggggtgtaaggtgcaaaaagcagcattagcatgggggaaggtggggtggaggggtgtaaagggaatgagatgtgaagtggttaaagggccatttttctagttggcctctgggctttgatgaaccttttccagtgtgcctgtttctccacttagccctgggctaatcttgactcttaactttccaggtgtgtatctatgctgatttctcctgggtttggaagctctgagaagctctggttctagttcaatcacaagacttttaaagaaccagaaaaataaaacaattttttaaaaagtaatgaagaaaagacttttaaagaaccagtgaaaacctgggagtaaaaatatagaagacttgagaaatttcatctttacctttcaagtgggcagcatgagaaattcttgtaaatggtgctttcaaatcttacacaaggttctcagttacctttatttgtactccctagactgtattgcatcccttgctatgttgactaattcccacctaaaataattcaatggcctcccaatataatctggcattctaattaataagctaagaaattatttggtttttcactcattggcgttaaatattcttcagtgcccacatttggaaatattggaacacagaaatgaaaaaagatacaatcagtttctctgcttgccatgttttccttgatatggcaatacgacaacaggtcaccctttgaagaaaattcagagatgctaaagtagaaattaaaactgaagataagtcaaggcaggatagtataggagtctgctacagctgccatagcaaaatactacagcctgggaggcttgaacagaaatttatcttctcacagttcttgaggctagaagtccaaaatcaaggtgccattggggttggtttctgaagagggttctcttcctggctttcaggtggccaccttcatacagcatcctcacgtggccttttctttttgcctgcatggatagagatctctggtgtcttccttgtaagaacaccagtcctattggattaggaccctatgctatgacctcatttaacctaattaccctatttaaggccctgtctctaaatacagtcacactgggggttagggcttaaacatattttaggggaacacaagtcagtccataacacgtgatttgctatagttttcctttacctaaatcttttccaaccttgagagtggattttggccaggtgtggtggctcacacctgtaatcccagcactttgggaggccagggaaggtagattgcttaagcccagaagttcaagatcagcctgggaaacatggcaaaaccccgactctgggggggcagggggagtgggggaattagctgggcttggtggcgttcacctctagtcccacctactcaagagggtgaggctgaggctggaggattgctacagcccaggaggcagaggtcacagtgagcagagatcacaccacttcacttcagccctgggttacagagtgagaacttgtctcaaagaaaaaaaaaagtgggttttattcttccccttaaattcctattaatagtgaggtgaggcttcttgtgttttttttttttttttccaagacaatggttaatgtgtgattacttaaaaatgatatataacactaagaaataaagaattgttaagtgagaaggaacatattaaaatggcttggaaagatgggtaattttttacattttaagtaggttttctcaactctaactctgtggaacttggtcaatctaatcagtctaaatatagcacaaataataatagttatatggacaggagaaatagtagccctcaaagatagtgaaatacatctgaatatcactaacaatgtcatgaatttgcttgttctaaagttttctgaaagtatgaattcataactgagtttttttttttttgcctatgactactaatgtttgaggagagagtagtgtcagaaccacccccccatttattacatgtttatttcatattttggtactgaaatcagtgtttattttgtgtcttcctgataaatcttgccaataagtaattaccttccatactgaaaagttcttaggattaccaggttgctgggggcaaccttaaaaggccatgcagaacattgacttaggtggctattaccctgctttattcaggtctgagcatttactttcctactacaatcagaatactgacctacatttaaaagtgcaacactgccctgttatctaaatccactgtgttcctgagaggaaataccagaaaagagggcaccaatattatttttctgctgttcttgatcataagtgattacctttttttttggttaggcattctgcttctgaaagataactgaggttgaagttaatagaactaagattcttatataaaatcataggaaagataattttcaggattattgaatcatattgaaaaatgatataattgtgttaaaagataaggactaaaatgagttaattcaatttggaaatagttaaattagaatttgcttctgtttttgatgaatactgctttttgaaaaatcttctgagtatttaagcttttactactctagtcattctctctaaagtagacatagaagcgtgttcttatcttgatttggtaaggctctgaaaatgcaaagcaacagatgttgtacccagcataattatatgtatcctggaaacacatctttattgagtgggatttgttcttggggaaacaaaaatttggcaaacaaaggacattaacttgctgatctcagcagtaattacttgggttagattataataatcttgtgtaggtggtaactgcatgcatatattacaaaatctaattctaaaatacgtacattaaaaggaaaatgaacttgcgcaaactttagatcatgtatccccttgaagagcagaaaagatctcaatttcattatttgaaagttgtttgaacagctttttggaagaggtttccaggattccaaatcctaatatgtgtattgatactgaggctttggactaatctttgggggttactgccttttttatgcccactgaaaatagagcatttcaaacaaatgaactgatctctgatctttaagcatgccagtaactctttggaacaaatccatagttatttttaccaatgactgtattaaaacagtactttctgtattatctcttccattccaaggccattttaaaacaccctctttctcttctcccaataggtaaagtacgacagagctccttaggactgggttatggagaattatctggaggtcaatttgagaaccactgtgcaaaccatttcttaaataagtagctacaaggttgtccttacaaaaatttctgaagttgatggtgttgcgttttggagtctgaagcttaaataagagtttgtcagtggtcatggtctaaatagctgattactaccaaggtcatctaatttttttttaacacaaaaaaatgttctgagcacaaatgaaaccttcaggacaagacatttatgttttgagaatgttcttaaatgattcctgtcgtgtatcttattttacatatcttaatgatcagcatgtattttttgttgttgatgatgattttataaatgtgctatcacctagtttctaattcctaacagctccttcatcagtagaatattgctgtagcacagttttgccatctgttaagaaaagatggtgactaataagagtggcacatttcagggctggtgtgctatcgcaacatctagtgttttagtactgaggacagtgatgtatgcagtgttccttacagccatggggtgtgggaatgttttcctcttcggcaaagtctgtgtatttctatagctgaactctcaggatccagaggaaaaccacaagatgatgaaaccagatgattgtcatcaaatttctattccccactacatgattattagttttcgtcaaaagaaatactcatcctatcctgggttggaattggtaaagaattttgcattgtgactaggacacctaaaagtttttaggatgagtacaaatggaatttgatagatttccccaaaatgtttgggaaaagatttattcctccctaggaacagcaagagtagcagcatcacatgaggcaactcctggtaattttttcttcttgctcttatttcaatgatatcttttcattcttttctgtatctctcaatttctatgtttctcctcttaatgtatcctgtaaatttcttagtagaacctttttactaatgagggtttcctagtttgctttaggaggcactcaggatgcccccttttgtaaggcagtaaattgaaaataagaacttggtgaaggtccacgtgacggttagtttccattctccattgtaccaaactgctacagggaaagaaccatatttaatcaacctcaaatcctcaatatttaggtcagaaaacacttggcatagaagagacactcaaattttgcagctaaatagattattgatagaaaatatgtttcttgcctctacaagcaatatgaaaccaatacaatctctaaatatcttcagactactaggggcaaatactgtattataagaataattcttcagaaaggaaaatccagctactctcatatcacctctctatgttgaaagctagggaagataaactggcttccagccagtgagagtccatgtggacctagtgctggctggagatccctaatccaaaggcaagagccagatactggttgtctgctgaaaatcagaagatgacctctctggtagtaaggccagtgactcatccctgcatcttttatcctcttctgatttgtataaggatctctcctttttccccagtacccactctcaagaattgctttcctttttaacatgatcataccaaaatgtatctaacagtaccttgatttcctttctgaggaatttagggagcatatttactttgtcagactcattagaggtttggcttcttggtcgggttcttaaatggacaacttgtttgggtgatttggcagagaataggagaagccagtcccctctgatagagcaaacctggggagctgtggttgacccacctgctaactgtcctgtacaattaggcatgtggcatcagtgggtgactgaccagagccaccatctcaatggcggctgttctttccttcctgtgccttctcagatctcttttttgttcttgttactccactatattggtttttcttgagtttttttcaagcaaatatcattattcacttctactgcagttcctctgttgttcgctttttctcttagtcttcattgttttccattttgaacattcagagatccatcaaaaaaagtaaaataacaggaagggagaggtaaacaccagtcaaatgaagtattataatagtgtattactatactctttaaagtaattgaagggtggttttttggggtcagaatatctgttagaatttggaatttgccactcttgagactggggcaagctatttaaactctaagcttatctgtccttcctcacaatctgtaaaatgggatcataataatggcacccagtttatggtgtagtgagcattcactgacacaattaatctaaacttatttgcactacatagaacagaatttttgtctattaaacaatatagcgttttaggcatgaaagaaactttagattaaattaaatatcatttttcttaccacagggtaagtttctgttttgtttgcccctgtttctctaactcctagaatagtttccagcacatagagattaaacaaatattcgttgaatgaatgaatgcatctattctaatcctcttgttttaggaatgacccgtcaggctcaaaagtgaaagcatttccctcaagattggtgacagagttggggactaaatctaaggctttctcttcctacaccagtgtcctttctgagaacacgatgccattttctcaatatttgtttatttatatggtaaattggtaggaagctgtgtggtactataagaggataaactttgataatgaggtatacttgctatcaaattctaacattctcatttaaaacatggcataccatttgtcttctacattttcatatgtaaagtgaggtgatttctaccttatagaactattgtgaggattaactgaactaatctttgtagagcacctggtcccatttattttttttttttgctcaccccaccccccaactttctagctagataacttatacattcactctgtttttcattccttcttgaatctcctgtggccagacttgacccctgtcactctacagcttactcgtcaaggtcagtcctcatctgacttgacctactaagagtctgacaagtagtcacactatgctccttgatacagctttcttcacctaccttcttggatgtcattcttttggttctcctcctaccccattgggctgctttttcccagtctccattcttgggtattctcattttcccatgtctgtcctctgacttcttattgtctctgtttctgttttctctggttggaccttctctagtttctggcttcaaatactatctaaatgctcatgtctttcaaatttgtaactctagtctagacctctcctctgaattccagttttataaatcttctacttaaatattagaggtctaataaacttctcaaacttatgttctacaacaaactccacattttctcctgcagcctctaaatatgtacctcctatagattttcccatttcagtaagtgggaacttcattattctgattgtccaaaccaaaaacacttggagacttgctacattccaccctttgtctttcattctacatccaacctatcaacaaatcctgttgcctcttccttggaaatatatccacgcttgagcagcatcattgtcaccacttggtgttatacactctcatttctcacctggagtattgtatttctcatctggagtagtgtctgtccaacgatgtcccccatcagtctgttctccatgtagcaatttcgtttttgtttgttttaagattgggtcttactttcgccttggctggaatgcactggtgatcatagctcgctgtagcctttaattcctgggctcaagtgatcctcctgccttagcttctccagtagctaggactacaggcacacaaccacacttgactaatttttttttttttttaacttttactagagatggggtctccctttgctgcccagtctagtcttgaactcctggcctgaagtaatccttctgtgccagcctcccaaagtgttgggattataggcatgagccaccatgtctggcccagatgttaattttaaagtgtacattagagcacatcgttcttctgcatgttcagcataaaatccaatgtccttaatgtagtctatattaccctacatgggctacttgtgcctgatccctctactcttatgtcttatccctctcctgctttctcactagcaccagccacatcttaccgttccttgaacacaccaagtatgcatttgccacaggaccttgatgcttactgttccctttgcccagaaacccttggaaccagctatgtgttaaaattcagatatttactgattttagagagctaaaatggggtatatataatatattacataacactcacagctggtttgtggtagcatttcataattaaataatatttctgaatgaaacattaagaatgcccatgctaagagggatgagtaaagactcaactctcattgtcagttcagctgcagaatgaggtcagctcaagatttgctgccaaatgacttaagaaaaaaatgtttttggagctttggggatttcagaattgcagatgagagattctagacccgtacctacacagcatgctcccttattttgttccaatctttgttcaacgattatttattgggtagtcaaggaagatctctgtctaaaaggcttctctgtgtggaacaagactggcatgtggaaggtttccaattaacgatattgaaagagtgaagctcaaatcatttttcactcaaatacatactatttagaagacagtggccagtttaagaataatcattattggaaacaaagtactatttgattagggatagttaacacaaacacttattagtattagggatatgtgaaatacttaatggatgagtcatgtgctgacataaaacccattatccattttagttcctggtagcctaactggttgaactctgttttattgatctattattgatttggcctgtaacttcaagttacattttaatgtaatttcatccttttctgatcaccttgtgtcttcaagcatttttaagcagttgatagatagttgaaagatattatcactatttcaatctaaaagatattatcactattttaatctacttaaaatttttactacattcattttaagtatgacttatggaacgaatcgaaaatacaagatagtgaaaaacttgtgaggatcacctgaaattttagcattcactttccttacatagaggaacttagtctctctaaagaattatgagtaataaagtatcataatgatatttgtcttagttttggttaagtgtactccacaggagaaagttaggcatgagcaggaattattgtagtcccacattctcaaacagttctccagtaagaaagattttatgtgtttccagaaatcattttcctcctcttcagagctttgggaccataattgtatttaaattgctaatctgttttaaggaatcataataaattgtttaacatttatattcaatcaactttgtaatttgtataaatttttcagggtgacatttgaacaatttttaagaaaatgggaaatacagaagtattcttagttttaatatattttaaaaagatgacatgtgatctactgactgaaatccttcaatcatttttgtttttctccccaagattagatagaatggatgtgattttatttttaatttgcattatggagagtacttttggggggttttatgaaaaagacttcatttattttgttagtggtacttcagttgcataagaaaatgttcttttaaatatagtggtcatttgtgtgcagccttcaagttagcaaacatgcctttgagtagtcactatttttgaaggtctttatatctgattgcaatggcttatattcaatagtcctcctactaaatgaaataaaaatggatgcctcttctgccacagaggcacaggtggacatgttggtagcaagccccatgcggtgtgacacatggcacagcccaacatgggggcaaagagcatgcggcttgagctaggagtcactttatggctactttagtgtagatttgtgtttttctgtggaacagccattattgaagacatttatatagtatgatgtttgtttttcattaaatgctgattgtgatttcttaaaaatagttaagacttgattagcagaacctatttagaagccagagttcccctgcttcacctcttgctatctatataaatgatatttttgactctgtcctttataatgttggcaccctgtgcatattagatgtaatcagggctgaaaggaaacttgaatccatctggaagcaataaacttttctaaaagactgcacagtgttatttaatcctgtgacttcttactgtgagtgaaattaaggtttgatgcagttgtgtcacatcgtattgatatcaaatttatctttctaaaaaaaaactgacagtattacagcacagaggagaagatggcttgctgtaatcctgtaagctattttacattgattacatgctacataatgtacctaagtatataaaatacttgatctagaatgtttatgttttctccaaaattttctcatcaggtaatactttctcaacttcacctttagttttggcttcttatcatagtactaactatgcggtagtaattgtgttatgatgaaaggcatggagaagaaattataattttaaaactattataaagtggagacacacttgtataattaccatctatgtagactgccaaggtataaacatttagcttattttagtatcagactctttgaatcaatttaaggctttttcaataaaattggcttcctctaatttctactccaaaatggttaaaattttgttttacttcaaatacgttgtagggtatcatatttcatgtgactaggagcctaaactatatcagctgactggcataatttgtgaattatatgtgtgtttattaaaatttaaagtttttattaagacttacaattttattaagacttaatttttttccttacattttgagtaagtccaactgaaaataacttagagacttaggaaatttgactacattttataagtaatttccttgtaatttttctttcttgtggaaacaattcttactgatttacttaactcttttttcaatggcaaaaatgaaaaccaaatatatttgtcaactatattcttttaattgtggaaatgaaaggttcatatcccccatttgcctagcatattaaaaataaacatgacctttgtcttgaatgttgttaacttggattttaaaaatcaaaccaattataagctatattaaaattgcttatcaccttccctttgtcttcagtaagtctgggcctaaaaatactcatcatatgaataaataaagttttacaaatactttttagaacatcttgaattatatgtgtgtttgaagcttacttttggatgttcggtcaacaaggcttctgacagtttctttttatcttccctctattccctgccactgtgcaccccaaagtgatccctgaccacagtggtcccattgctggcatcaggaaggtagactgaggagttcaggtatcctagaggctgttaggtgaatctcttctacctctttcctggtcctaggaccactggacacttcaagtaaaaataacaattactttaatctctcaggtaaagtttcttctcccttccagcaacacagatctgcctgtgccgagttcaaatactctgaactttcaacagttgttctgaatacttttttgtcatcttatgatcaaatattgagagcattgaggggataactgaatgggcatggtataaaagtcagacttttagtgtttctaagtagcagaaccctttggacaatttagagggctgtgcgatatcctcaccgtgactgctgggaagtaatgggatctgacctgcagaggtactaccttggctgacaataatgacaaaagtgagagcaaagtacatatgactatccttgaggtcctcaggaaaaaaagagtattagtgagttgaactgtatgtaagggtctttaccaataaggaagcccatgcccagacataatccttacaccctggcaatagaaaccatcattgtggtttacatctcatcctgttcctacagtccagcaagttcaggccacaaaaggtttaagcactttttcctttgttctcatagcaacagttgcccatggaggttcagttacactaatattaacattttaatatacacaaagaagtgcctcgaatgtagtaggtattcaaacttgttaaatgaaagaagtaaactttcagacttaccttgaactactacagttttattctttctctaacctctcccactactaccatcttaaaaccaccatttaattagtattttataacaagttattaaaggctttcaaagacctttgaaccttcaccctctggtaagttaataacttctgatatgcgattaaatgtcaactgagtagtagtgggccctaagagctcagagggactgagaaatgaaggttattgtttagaagagtggctcaatgtgcttcgacagttggttaatatttgaaaagactagagtcaagaaagccttccatgtgctaggaaatgaaggagcaaaggtccagaggtggaaatgtatacagtgtgattaagggattttctgattgatagtaaatacagtcaataaaaaacttttattggaagcctagcctgtgtttgaagcattaagctaggtgctgggatacagagattagagatgaagataatgatgaagatattgttgaagtgaattgctgagaagctggagaaagggccaattaccataatctgaggctcaggaggaattggtgcaaagatcatctggtatgatatatatgaactgtatatacaaactgatctgtgtagctgaactgataatgccaaaaaaaaaaagactaggtttttgattaagatgaatccattaaggtcatgttttctgttggtgccattcttggagacctcccccaaccctatacatttataaatgtttttcctgagggactgagatggaagtggacatataaaaggaaaggtctgggcaaatacataagtaggtagtaaaatcaaggaacaaatgatctcaacaaaattgcccttcttgaaatgaatgaaaatgatgaaagccaatcacattgcatgatgaacttggggtatagaatatgaaatatttaaaattgctttatttcatgatgtttcagatgtagtaggaacttgttgcatagatggtgtaaaaacaatctagtaataaaatcttaggtatttaatacaaggtgaagaaagatgcaatgcataaatcatgccattttaggcttaattttcataaggctatgcctgtctttataagactatataccaggagttctcaagctttttggtcttggaacccttttatactcttaaatcgttgaaaaccacaaagaccatttatttaagttataaccattgatatttgttgtattagaaattaaatagacattaaaaatatttactatttaaaaataaccaaaaagatgggcatggtggcccacacctgtaatctcaacactatgcgaggccgaggcgggtggatcacttgaggtcaggagttcgagaccagccaacatggtgaaaccctgtctctactaaaatacaaaaattagccaggtgtggtggtgggcgcctgtaatcccagctactcaggaggctgaggcacgagaatcacttgaacccagggagatggaggttgccgtgagccgagattgcgccactggactctagcctgggcaacagagtgagactctgtctcaaaaaaataaaaaaaataaaaataaaaataacagtaagttcattgcatattaacataaataacatatttgtattaaaaataactattttccaaaacaatcaaaaaagcagtaccactcttctattttaaattttttcaaatctcccttttctaaaaaaaaaaaaaaaatattgtgtaagtttaaggggtacaagtgcaattttgttgcacggatatattgcttagtggtgaagtctgagaatttagtgtatcttcacccaaataacatacgttgcacccattaaataatttttcaacacccacccccttctcactctcttgagtctcctttgtctatcattccacactctgttcctatgtacacattatttagtacccacttaaagtgagaacatgtggtatttgactttctgagttttttcaactctggcttaatagaagacagctgaaatctcagaatgcttcttcatccagtctgttgtgaatatgttgctttgattcaagtatctaaggaaaatacagttttacacagatgtgcagctgaaaaggaaacatcttttaatatgttcagataattgtggatattgtcctttgatactatagcaaaacttatcaagtgctaatttcttaaaggctggttataatttgaaatctgaaaacatatctatttaattgtagtttgctatttgaaaatttattggtctgtcttgtactttgaatggatattttgcccacgtatgattttataacatcctgtattggccttttggaaaatttggtttactattatacagtttctaaatgttgataatttttattataatatattttaaaaagtctaatgtcactgccagtctcatcagaaaattctttgagattagaaagctgttaagatcatcatcacacttacaagttttacaaaattttaattttactcaaaactttatattttatcattgacaaagctctcagttgctttgcttagtgactgactcactttgttcattttccagaaagtgtttaccaaatgctgctgcctcaataccagagtctgtattgtcagttgatctttcaagtaaaaagtggtgttctatgaaaaacagctagttcagctgcgactgaaatgatataagtgtttctcctggagcaaaccaccacttcgatttgtagcagaaatgctgtatgtatactttccattgttattactcataacatttttaaaaatatactcaagggtggagatttttttaaaaataagtgttattgcttcatcaagaacagttaaatgaaactggattttttaaactgagtttgagttaatgaagaatgcagcaattattagtaaaatttggtgctccaccttgattcatactgacactccaggagttttacccactatttcttttgtacctttagtgcaaatgttaatatggtaggaatggtaaatgacatctttagtattattataaaaatcgtttttaccctgtatactctttgagactacacattgagaattgctgatgaaggtgttttaatttatcataagcactgaaaagatttacttaattcaccaatttctcctgaatatttgtttatataaaacaagactatgtgtatacacctacctttttattaatggtagagatctaggaaaattaatttctaagaactagccaggatatttggaatgtgaataaatcatatatccagaaaaaagctttagaagattgtctatgattgaaagtcaaacagctctcatttctattatactgttctttttcaaagaatttaccaattttatgtggtatttatgattaaacatacaccatgtaatttaacatttttaatgtcacttttacatcataggtattaaagattagcatttttattgtctgtattttaaagctcaaagaataacatttaggctgggtgcggtggctcacacctgtaatcccaacactttgggaggccgaggcaggcggatcacgaggtcaggagattgagaccgtcctggctaacacagtgaaacaccgtctctactaaaaatacaaaaattagccgggcatggtggcgagcgcctgtggtcctagctacttgggaggctgaagcaagagaatggtgtgaacctgggaggcggagcttgcagtgagccaagatcgcaccactgcacttcagcctgggtgacagagtgagactctgtcttaaaaaaaaaaaaaaaaaaaaaaaaatttagatttttgactgtttcattgattcatcttagacttcacatgaaaatatctgtatatcctcaaatgcttacattcttaagaagtatctcagccatttacacatgatagaaacaactaaatggaaaaaaattgcagttggaaattcactattttttatttgatccgataacaatgtgacatttgcgattggactgtaattttctgtctttctctctgaaaataagttcaaaaatttccctctaattcttttactagataagaagcctacttcgttgtaactcttgatatatgtatgtatttaggaacttaagcttttctgctaataaatgttatgtcataattcttgaggatagtattatattgtgatgggttttcagtaaactacaggagcagccctatttgtttaaaccctagtttaacctgattattaacaattaaattgtgttttcttctaacaattaaagtgtgtttaaatttattggtcccttgcttcacagatttatctcagtatgtggtgtattcaaacagaattttgtatttttaattaggggattagataaccaattctgaagagccaaaaaaattgttagacatcacattgcttaaccatctaatataccataagtgtgtgtatacactatgttgtgggagccatctatcaggcaggcctgtttttcaggcagtattttaaaaagtggacatgtgcagaaactgtgagcacaattagcgccaagcagataaatccagctctaatcctgtttacggtctacatcagacagatgtgccaagattgatttagacaagcccgaggcttacagtaatatttttaaaagtgccattcgctgttctatttttgttaaacctttgctaaatattcttaagtcttgttggttttgctcttcttattaaccaccgtaagtaacctactttaagcaggtcccgctttgctctcatggtgacaaggtaacctgccaggagaggttatctttattccctgtaattaagttgacttttccccccaaaaaaatacaacaataggaagtgggtgctgaattaaataaatagcatgatacccagtagatgtatacttaagttccttgcaagaacagatggtccccagtatctctgtaagtaatgtgagaggacagttaatgttctgaaacaactagctataaccagtatgatactaatgaaccagtagatttcaaataataaaccacatgccgccaagcaaaattatatgtcattcataaggatttaattatcataacttgcaaaaaagtgtcaatagatgatttctatatttttatctactgatatcaaatatcaatttatgaatagagtttcacttcatattttttaccaataaaggtatgttttaacattaaggtagaattaaagttatatttaaaatacatgccccaaagtatgtggtgatttttttttaactcctcttttactatactgtctgtatgtattgggctgtatatggaaatgtagcttttacatacaattaggaaaacaattgcttttatttctagcagaaacttgtactataacagaagtggctagcatgggaatcagagtagttatcttgtagatgacaactgaagcagacataaaagatgtaatattttttcagcactcaaaaatttataagtaaaattttataaacaaaaagcagtatttttgtgattcatatggaaaataaaatgagtctgagtcattcttaaggtgataccgtaaaggtgtatagataagaagtccatttttaaatatacccaagacaacagttttttctctcagtatggtttgttttcccttttttctctttaattatgtttcccataagtatttgtatattctaagaatgtccaaaaaataaatgttttgcagtgggggttgaaaagaaagaaagacctttttagatttcagctgatcttatcagatgatctctagaaccttgaaccttcaaccttcactgaagttagctggagggcttttcacctggaaacctgagaaacctcagaagccttctgctttagctctctctcaagtctaggaagccagtggcctgcgaccccacagagccagctggtccactcctcatataagaacttcggtaacaatacaaagacatagcaaagcaccatctaatctgataactcattaaacaatatttagatggctcaagactttaaataaaaacattttaagcttgtttatagaatactaacaagttttattcccaaagactatattcagagtgagaaaacaattttccttaaaactaatattatatacatgttcatatatgttaggaactagttatatgcaaaatcaagtgactcttgtgattagaactggtcacatttattcatgtagcataaatggttaatattgccaaaatgagtaatagatcagattttctatgtgagatattgacacctgagagatttacagtgtttcactgttgtgaaaaatggagtgctgaagaacatttgtctattgttatacatttgtaaaagaattcacaaattactaatttcaaataagaactaaatatttcttctaagcctatagtttttctttttaatttcttctaagcctacagtttttctttttaatttcttcttgtaacattggcaaaaagaccattcgtgtgaaaacctcagattttgatctgtacacaaatgcaggagtagagattggaagcttgagctggaaaagcaggaaatactgctcagagccttacaaggattttcagaattttcactgttgggtcctcctggttgctgcagtctaacctcgcatctccttgaaggcagccccagtttctgatgaaatactcttcagttaatttatacatatgctgtcttgctgttttcctaaggactgcaggcagaactgtggttcacctactgttttaaatttggctagatttaaaaacagatgatctcacttatatgtggaatccaaaaaagtcaaacttatagaagcagagagtacaattgcggttgtcaagagctgggggaggggaagcaaggggatgatggttaaaggtataaaatttcagttagacagaatgaataagttctggatctattgtatagcattgtgactatggctaataatgtatacttgaaaattgctaatacctgaaaatcactaagagactacgtcttaaatgttcttacaacacaccaaaaaaaggtgtgaggtaatgaatatgttacttagcttgattttaatcatttcacattgtaaacgtgtatggtactgatcttgtacctcatttcattttccatatgaatcagaaaaatactgctttttctttataatatcttatacagcatagatacaatttttagtggtcaattatattgtaatatatacataaatatatatgattttcattggtcaattatactgtaataaaacagcaaaaaataaagttgtaattaaaaaataatttggaagaaaaaattagcaagtggttggagattgaggaagatgggaccaataagtcctccaaggagagtcatacattagttttttttaaaagtccattattaatcttataatatttaatatgtttaatttcttgacacttattaatccaattaagtatgagaacactgtggataaatctaaaaaccttaaagttgagtaaaataaaccagatacaaagaagcacatactttatggttacatttatatgaagttctagaaaaggcaaaacttagctatagtaaaaaaatcatggtcctgagggaataactagagagtggtatgagggagctttctataatagtgggaaaattctgtatctttattgggatagtggttatgtgagtgcatatacttaaaaaaactcatggaattatgcccttacaaatctgtaatttttgttggtaatttataccttaataaaaaacaaaacagatgacagggttagtgattgtttccttgaagaaggtctttacatgggtctgttgttaacgagttgtagtaaaaatcatccaaaatgcttggattcaaatcttagatctgttcctaccagatgtgtgaccacagacaagttacttacattccgtcttcagtttcttctcttttaggaaaaagcatctagtttttgttgtagagattaaattagataatacaaatgaagtacagagaacagcgtttggtgtgtaacacatgttcattattagctacccttattttttagagaatggaaatttttaaatttaaactaatcaaactattttaggataagcaagtgaaacaatctttttttcaatcgatcacagaaatattttcactgaagacaaattagacatttatataagcaaactacagtgtcattaccattcaaattttcatatgcatattcatgcttacatgcatatgaaagcattacacatatgtattctataaatatatacaaaacagtaatggaaatgtgctgtactattttgaacatctttctagtcagcccggcattttatttacttttgagacagggtctcactctgttgcccaggcttgagtgcagtagtgtgatctcagctcactggaggctggaggtcctgggctaaaggaatcctcctacctcagcctcctgagtagctgggaccacaggaaagcaccaccatgcccagcttatttggtttattttgtttgtttgtttattttttatttttttgtagagatgaggtctcactatgttgcccaggctggtctcaaactcctgggctcaagttatcctcctgcctcagcctcccaaaacactgcaatcacaggcattagccactacactgacctctacattttaatagctgagtagccttctgttatatgaatatacttttttttaacaaaaccaatactccattattgtacatttaggttgtttccaagtttcactcaaataatgcttgggtaagtaagtatttttatttattattattatttttttgagatggagtttcactctgttgcccaggctgaagtgcaatggtgtgatcttggctcactgcaacctccgcctcctgggttcaagcgattctcctgcctccacctcctgagtagctggggttacaggtgcacaccatcatgcctggctcatttttgtatttttagtagagatgggatttcagcatgttggtcaggctggtctcaaactcctgaccctgtgatccgcccacctcagcctcccaaagtgctgggattacaggccgtgagccaccacgtctggcctggataagtattattttagctaaattgtgcatatttattcccttagagtaaattcctggaagtaaattgctggatcaaaaccaggtatattttaaagaattttccttttctacattaaaaataattataattctgattacaagaaaggaaaattatggagcttcataagaaaaaattagtctcatatttcatacctcatattgcatatttaataggtaaccagtgttaaatttgttgtgtgttttccactgggatttctttttatctcctttaataaaagcaggatcagatccctcagattactttgtaacttgcttttattctactttttcatacctcttagcatgaatgtctttccagaccagaatacagagatttcacttactcatttatgagctgcagaagatgactatgatttattcaaccattctcctattgaagagcatgaatattgcttcagatacttttgttattataaatattagtgcaattaacattttaaagtcttttgatacatattcccaacttgttctccagcaattaccatttttgcattcccaccagcactggggctacttccctttagttgcaccatcatttagcattatttttgatcttgtgccaatctaaaaggcaaaaagtggtatcttgttgttttaatttgcatttctttgattactaattagattgaactttttcatttgttcattggtcaatttgcatttcttcttttgtgaaatgcctgcttgggtcttttatgtactttaccattaaagtgtttttcttgattaaatagattatgtaactgtcatatgttgcaaatatttctgtccatttggcctttgcttatgactttttatgagtctttaggacttttgaggtctttattaggtattcaataattttaatgttaaatatattgatgtctgtcttcctttgtgtcttacggcttttctatttaaggttacgtaaatttctaatatacaaatattggtgtatattatgaaatagggccctatttttctttacaaaagattagtcagttctaaatcatcctttgctatttctagcggcgcttagatgccaccattatcacatcagtgaatttttaaatgtgtaattgtttcctgatctattcatttctctattcctagatacttctattgtaatagctttaccaaatatatctgatagggtgtgtactccccctcattacttcatttatttatttatttatttagagacagagtttcagtcacccaggctggagtgcagtggcatgaacttggctcactgcaacctccgcctcctgggttcaagggattctcctgcctcaacctcttgagtagctgggattacaggtgtgtgccactacacctggcaaatttttttttttttttttttttttagtagagacagggtttcaccatggtggccaggctggtctcgaacttctgatctcaggtgatctgcccttctcggcctcccaaagtgctgggattacaggtgtgagccactgtgcctggccccctcattgcttttaaaacattttcttactgtaatatatttattccaagagaattttcaaatattttatgagattccttgtccattccttacatcaaaaaataccacggagattttgattgaagttctattataagtagttacttggggtggggggaggggggagggatagcattgggagatatacctaatgctagatgacgagttagtgggtgcagcacaccagcgtggcacatgtatacatatgtaactcagctgcacaatgtgcacatgtaccctgaaacttaaagtataataataaaagaaaataaagagaatactggcatggaaaatatgtaatcttggaacttgttgtatctccacttattcaatcctttgtctctcagtagattttgaatggctctttatcccacacgagtctagaatcattttgctaagtttattcctagatataatatgctaattgatatgggaattttttttatctccattataccttcttcttgggtgtagacatatttgtagccagcttcctcactgcatattttttattaggcctaatggcattaagtttattattttggattttacaaaaaaaattatgataacatctttaaatagttagtttcaactcctcctttccccttaaatccatcaattactgtcttttatttcactttccttatgtactgactagaatgcctagaataattgaatgctatgagtaataataggtattcttgccctgtttttggaaatccttctggatttcagtaagtgtgatgttggcttttggtttagtatctttaaatttgcaatttacaagatattttacattggaatagtcattgagttgttaagtaaagcacaaacatgttaaattcagactgaagtacaggacttcaatgaaaagttaaaagagtttatttcatcactttcattttttctttccctcagtggctgtttgtcccctccccccaccccgctccatcccccagcttccttcctttgtgctcttattgttctaggtttgactacataaaaagagactctcaatttatatgtgatacaagaccataactaatattataaaattagtctagaagaagttatttgcaacctatataataagggactaatttcaagattatttgaaggactttaaagattggtaagaaaaaaatagacaaccgtttagaataaggcaaagcatgtgtagaggcaactcttaaaaaaaaaaaagtgagctgggtgtgatgatgcacacctgtggtcccagttactagggaggctgaggcaggaggatcacttgagcccaggagttcagggctgtagtgcaccacagtcacacctgtgaataaccactccattctagactgggcaaacataagaagactctgtgtcttaaagaaaaagaaatgaaaagatattcagtttcattaattgtttgactagctgatttttggaaaatacccacaaatataaccaagcctacaagttattttaaggtgggtaagagatacatcttatctatatgcattcacctatgtgaagcggacacccagtaacacccccgtgtggaagacaagcttccttaaacttcacaggacagtatttcccatgtagtccatcatagggtgaggatttttcaggacctttggtaagcctgcttgctttcattcttgagggtagaggaagggtgcaagacttccctggtctctcccaagcattttggggaccctggccataagcctacttgctcaacaggtgcaaatgactggtaatatgctgaccagatgcaagtgtaccaccaatgatttgctgtgactgagtttggtttcctttgcatatactatccagctttttgtttctaatatattcttccttaagggaaccaggacttcttggggaatccagatgagcttgaaacactgtttttataagagaagggctgttttcaaaaacatctatagttcgtaacaaaggagttagattgaagggactctcactgttcagtctgtgacaagcatgagtgttaaaatggagacaagaattttagttaattgtaatgttgaatttgtaaaaggctataacttcataatatgatcaaggggaacaagcaatctaaaatgtgttaaagtagcattttcaaagtgcggtccagggactctcagggttggtgaggtcacaactgtttttataatattgctaagaatgtatatcactctccttctctccaaggatacggtggagttttccagaagctatgggatatgtggcgatagccttgccctaatggagtgtgtgctttgtgctttgcatttttgtcctttaaaaatgcttggttttaattttgaatacaataattatagatagatataacctacataaaccaaagttatttgcggccctcagtctttaagggtgcacagtggggcctgagactaaagagtttgggaattgatgttctagagaaaagtcagtcttactgatgagggttaatcaattagtatttactgaccgggacaggacaaaccattcattttataaagacacacagagcatttcactaaaatacttttactctgattaagtggtgattttagtaatagtaatgattgtttgattttctgatacctgaaggaaaaagagcctgttgaattgatactttgagggtgttgagttttaggtcactgggtgactgtagaaatggaccaggagaagaactgaaacttgagccttctaagaaatagaagaccaaaaaatgtttagtgttaccctatcccatgaccacaataattgagaaaaaggcctttccgttccctcttccctaccctcccccttctcccctaccctctcctcccccctcccctccccctcctctcccctaccctctcctcccccctcccctccccctcgtctcccctaccctctcctctcccctaccctcccctccccctcctctcccctcccctctcctcccccctcccctccccctcctctcccctcccctccccctcctctcccctcccctccccctcctctccctccccctcttctccctccccctcctctccctaacccctcccaacctttcccctccttctctgtccccctccccctccctccctgtcttcctcccaccccccactccctgtcttcctccttgtcttccatcctcccttccttcctttccttcctgtctttcttttcctttctttcctttttcttctttccttcctgtcttccctcctctccgtctgtctccttctccttgtccccttctctctgtcttgcctttcctttccttctgtctttttctttctttctctttctttttcactcttcctttttttaatttcccttttacttgccttctctctttcattccttccatgctttcttttttttagtggtatgtatactttgtgagcaatcagactatagcttgcagaatagttgggagaggccaaaaatgcccctgagaatgcaagcaaggaacttcttagtgagcatatgaacatcctcactccaatcggaggataacattgttcatacttcaaggactaaaaagctgagagagggtctctgctttctgttacttttagcactcgagtcatttctgcatgtatttctactgattactttttctcctattttggttcatatgttttctgcttctttgcttgtctagtgattttggattagatgagtgacattgtgaattttactgtgcaggatggctgaattttttttctattcctgtaaatatttttttggcattgttctaggatgtagttaagttacctggaaaaagtgacatccttttgagaggcttgcttttaagttttgttaggtggaatcacagcagtctttagccagctcactaaggaccaatactcttctaaatacttaccataatgtcatatgaatttccatgtttttccacttcagctggtaggaacacctgtgtcatctctaagcattgtactgttaattcttctagtagttcttatctggctttgtacatctgctgatcaatactttcagctaaagtctcaaggggacctctgcaaatctacagtgttcactgttcagctttctcttctgtagtaaattgcacagtgaactctagtccccttagccttcctgaacccccagttctccttaactcagggagatcaccaggccccaccaggattcctgtatctgccctgtgacctggagattctctgcaggcaataggttggggcggtcgtagggtccactttgttttcctcctcttcggcttcactgtcctgtgttacctgatgtccaatgtctgaaaactactgtttcacgtatcttgtgtgcttttgtagttttaggtgaaaggtaaaactagtttcttattattccacattggccaaagcagaagttttggaagtctttttttaaggtctaaaacacttctactttgagagtcaattgaaatggtcttttccacaataattattttctgacctatggtttaaagataagtcatgaaaattttatgccactatttttttttaagtctgattatggttaaattcagggggctatttcctcctagattgacagagtttataatgtttcctactcacaataattgtacttctgcttcctctttgcatgtgttactttaatgggaatgtatatttccttttcgttaaggctgccttcaacaatttgtcataaagtcacttctgttagtgaattctattttttctgttactttactctatccttagtaccaaagagctccttatgtgacaccaatttattactaaaatgtcgctttgtttatgttcttggaattcttcatacattgactatcctcagatgtcgaatgttgtaggcctgtgtggcagggactctcttccatttattctatttttaatctaattcttgacaaaataaacccaatttttcttttcttcccctttccatctcacgtagggactggcataaagggcaatccataaaattacaaatgatgaatttttttggttttaactattattcatacatttaagatatggtcacaatttttatttcttactagtaattcattttattttttaacttttaggttctggggtacacgtgcaggtttgttatataggtacatttgtgtcatgggggtttgttgtacagattatttcatcacccaggtattaagcccagtacccattagttatttttcttgatcctctccctttgctcactttctaccctctggtaagccccagtgtctgttgttcctttctatgaaacacaatggttttaattggaaaatttatttttttttcaggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggtaagtactcctcatgggaaattttaatcagcccagtttccttgatatacatgattaatctagacatgttttgagtaaaaacaactttagtgatgttgagatagtttccttctgttcctagtttttgtcgtgagaaagtgttgaaatttgctaaatactttttctacattaattgagataatcatatttttccctacatcctgttaatgtggtatcttatattaattgattttcatatgtttaacatccttgcattccaggaataactccccaatggccatggtgtataatcttttaaagatgctattgaatttggtttgttaatattttgttgagtatgtttgcatcaatattcataaaacatattgttctgtagtttttctgtactgtttgtctgactttggcatcagggtaatactggcctcatagaatgagttaggaagtaactcttgaatgactattttcatgaagaagcttcaataatctgaaataaaatacttaaataatttagttcacctgagagttgtttttagaagcgtatttatttttctattaatgtcttttttgaactatataagaatgtattctccttccactcacacattgatggcaagtgtgtatttgtactctgtggcctgaaaataagatttttttgaataatcttaagaggccatgctttatactctggtaattgagaattacctatttcacagtagctttttctaaaggttaatttccagagaaaagagaacatgtttattaggatatatctcttaatgaattcagtgtatctgaaatttctaaatgacattttcatattttgcatactaaataaaattcataagtacaaatataatgcaattcataagtacaaatataatgcaatttggatttctagaagttatctagttaaaatatgatcttaggatttattttttttgtcttagatttatgaatcttgcttgtttttctgttaattcatttcttcttgtttgctgcatcagtcagatcagagtagaggcagcttgtatagttgatggcacagtttagggttagatggcacaggatagaaatgggtgctagacaaagagcagtcacagaggcatgttagaaatttccagttccagcatcattgatgaagaaaaccatgaggacccaagttgatcaaaggcagccagccaataaagctatgctcatgcgagatgagctgaagtgacattacattaaaattggaagaccctcttactaagtggctccatgcttccctgctagcccctttgggacttccaagaagacttggttatttcaagaagacaagaacccacagaggctgtagtttagtttatctctctggaaacatagagaatatgtataattaaataaaagcactttaatagtgaatcctttacagtgttatttgaaatttatgtcaagtgatttaaaaagtaaaaatgaaaattaataatttcagtggaagtaaattgattaacatgaccaggaatacataaaacttgcatggtcttgtctataaaataaggatatgtcatttaattaggagagtcaaagctcattcttgcgcttaaggtctgaggaactcttctcccatggggcttatgaagggctacactgaggcaacttcctcaatatatctcagccataaaaccaagagaaagtaagaagcagaggacatcacaacaaagctcaattcagtaaaagcaattttataggagtagagggacttgtcaaaaacaaaaacaacaacaaaaaacaatgtccaaatatttattcagcttaatgagtgatgtttttgtttgatctagggttaaaatctagacaaattacagagatgaataaactacatatcctttagtctaccatcctctgaaaatgttactttttgaaactttgattttgataagagctggaggcactcagggagtcattctctggcatggtctttgagtacagagtgattttgctgattaaaagcaaatagattgacttttaaaatcaactcatacaaacaaactgttaaaatcctctaatgagagtgaagaaacctaaccaagactgactgatacattactgctccatctctgcaccaaagtggactcagggaggcctgtaggagatgccaactccttatcctactccccacaaagacagttcttggctatcttcatcagacacaaatgaatggttgaggctccaaagctctctaccaattcttgtgttacactggcacttttaaaaaattttgtttattttttatttttaaatggagtctcactctgtcaccctggctggagtacagtggcgtgatcttggctcactgcaccctttgcctcccgggtttgagcaattctccctgcctcagcctcccgagtagctgggattacaggcacccgccactacgcctggctaatttttgtattacttagtagagatggggtttcgccatgttggccaggctggtcttgaactcctgagctcaggcaatctgcccaccttggcctcccaaagtgctgggattacaggtgttagccaccgcacctggctggcacttctcttaaaactaatatctcaagaagttttttctttaagaatcttctttcaattgcaggtccatgtagttctggtattcattaaagtgcctatcccaggggttttggtatgttgtgtttcaattttcatgtttcaatttttttgatttatgcattaattttgttttttcagaattcaggtgcaggttgtttagtttccatgtatttgtgtcgttttgagaattcctcttgttcttcatttctaattttatttcattgtgacctcagaagacacttgcattgattttgattttttttatcttattgagatgtgacttacgactatgtggtcaattttagagaatgttccatgtacagatgtgaaaaatgtatattttgtgttgttgggtggaatattctgcagatgtctgtcaggtccatttggtcaagagtctgatttaagtccagtgtatacctttgttagttttctgccatggtgatctgtctggtgctgtgagtggggtgttgaagtcccccactattattgtatagctttttttccccataggtctagtagtatttgttttatgaacctgggtgctccaacattgagtgcatatttatttaggatagttaaatcttctggttgaattgaaccctttatataatgccctcctttgtctctttttgatgttgttggtttaatgtctgtttcttctcatacaagtatagcaacatctgttcttttttaattttctatttgcatgctagatctttctccatcccttcactttgagcccatggttgtcattacatgtgagatgggtctcttgaattcagcagaaggttaggtcatttaaaaaatctaatttgccactttatgtcctttaagtggagcatttaggccatttatgttctaagttaatattgatatttgaggttttgttcctatacatttgatatttgtgtattgttaagtagttgctttctagtttgaattgtgtaattgctctataagatctctgagccttgtacttttgtgtgcttatatggtagcaagtattgttcttttgtttccatgtttagaactccttggagtatttcttgtatggcaggtgtggtggtaacaaattcccttagtgttttcttgcctgggaaagactttatttctccttcatttatgaagcttaatttggcagattatgaaattcttggctggcattttcttttttctttaaggaggctaaaagtaggcccctgatctcttcttgcttgtaaggtttctgctgagaagtcctctattagtctgattggatttcctttataggtaatttggcccttttctctagatgcctttcatattttttctttggtgttgaccttgcatagtctgatggactatattccttggggatggtcatcttgtatcttgcaggtgttttctgaatttcttgtatctggatgttaacctctctggcaagattagggaaattttcctgaattattgcctcaaatatgttttccaatttgcttacttcttcctcttctccatcaagaatgccagtaagtcataggtttggttgctttacataatcccatatttatcaaaggctttgttcatttttcagattctttatgtttgtctaactgggttaatttgaaaaggtggtcttcaagctctgaaatcttgtcttctgcttggtgtagtctgttgttaaaacttccaagtgttgttttgttttgttttgttttgttttgagatggagtctcactctgttgcctaggctggagtgcagtggcatgatcttgactcactgcaacctctgcctcctgggttcaagcgattctcctgcctcaccttctggagtagctgggattacgggcgagtgccaccacccccgactaatttttgtattttttagtagagacaaggttttgccatgttggctgagctggtctcgaactcctgaactcaggtgatttacccatcttggcctcccaaagtgctgtgattacaggtgtgagccaccatgcctggcctgcttccaagtgtattttgatgttccctttagtgaatttttcaattccaaaagttctatttggttttatcttaatatggctatctcatgtttcatatcctgcattgtgtttctggtttatttgaaatggattttaaatttctcttggctctcactgagtttccttgcaatacatattttgtttttttagtctgtcatttcaaagttttcaacttggttaggatccattgctatagagctagtgcaattctttggaggtatgaagacactctttttgtagtgttggagttcttgggcagattccttcttatctgagggagctgttgattcttatttttgaatttcctattggttgggcgggacttaaactttttttttttttccccttgagggtatgactatggtgtatgttgtgtgtgatcattcaactttgtttctgggtgctttcagggggccaaggctctttatggattccttgggcgtggtagctttcttaaatgctgcttattgtagcaatgtattggatttgtgagctgacactctatctcatgtggggctgagggtgcagaagtctcaggaagcttattttgtggagtagtgctaagcctttctggtagtgggctttttatttgatagtacagttcaggctgcaatccagtagatggcacttaaaaaataagaaccagcttgccctcagttaggctgatgtccagtagaagcacctgtcctgacaggggagtgacaggaagagattctgttggtgtgtgccgaggcctttggggtcgctggttggggggagatagggggaggtgcactagctcctcatgcaggaatgtgatctgcttttctatcataccccatcagagggctcatgaccttcagttcataaagattttttccttgggttcccagccatagtctgtctgtaggttatgcatatgcccctctgaaggcaaccaccaaaatggtcttggggcagagcctcttcccccagtctagggcagacaactccatgacttgtatgtcctccattgctgggacactgctgctctgtgtagggatggggagttgggccccaccctttatgtaagcctaagtggcattctcactttcagcaggggtggagccatcttgaaaaccatgaaaaactctttcttcgagtacctgtgctggcccccagtgggaagaaccactgctgcgtcttcaacagcgtgtggggtgggagggtattgccacagatgaccccctctccatatccgttccttgacatggtgttgccccctttagcgattggcactgtgcccacctttcctttgtcccaaaggggttttggcaagttgtgtccctctcccttataggtggcctacactaggggggttagatctctagaggttccatagctccctgggaacttgctggccccctgggcttttcaaagtcagaacaggttatgaggtatgtttgctggggatctggtgctacagagactcaagggtagagaatccctgggcagagcagaggcccaccactggtgcacaagcaatatggtgaccaccatctcagtttgtgtctgaggggagtatgggaacccctgcaggagctggccacccagttctctatccctgggaaattcctaaattaccaccaataacattgccctgggtcacaagggtggggccttgaattctttgggggttgatctctgccagactctagctacttttcctttctgcaccccagcttcttcccatgggcactccaaaaggtcctggctctctttccccagttttccattagaaacttgtccatttgacagtaactttgatcttctttctaagaagagctggcatccaaggtctgtggtcagctatgttggaaaaaagaaggagaaaaaaactagtttgtattaaattctgaaagactagtggcactggttaagtctttaaaggattgttaacaaaagaaaatctttttaaaccaaactcctaattttatcagaattgtaactgaaaatataaatgtatgaaaacataggtattatgtaaaatttgctcaataaaagaataggaaaaactactatttatcttggactgatagcatgttagtttgagatttgaaccctttctactctagtaagtagtggtgggaaaaattcactgtaggagtctgcagacataacaaactatcattagactgccaagacctccacataataaagcaagcagagaatgtcaaataagtatgtgaaaaatgatcaaaaaagagaaattgaaaatataaatagggtgctattaaaaaaggatagcatttatgttatgacatatgtacacatgaatatcactttttagaatttcatccttcttaggacttattcctgagtccgaggattgagaggttctgataaaataagtctcagtgggttccaggcatgggctttctttaaaagtctctccagggattctaatgtgttgccaggaccaagtaccatggacagccaagatctcatcagcacagtttgattgaatgaacttatgtagaaccctgaatgccacacttaaccaaagaaacctttccagggattaattataggtgacagaacatgctatattcttattaaatattattaaaagttaagcaatacccattcctgattcatgtaaaattctcacttattttccaagagttttactgtatgactggtttatgggatgcttggaaaaggttgacagacatggcaaaggttcctgcagtgtttctctttgtccatcaacagccctagctcataacctctaccctttcagctaaaagcaattagctcttcagaagtgattcattctatttatacttgggataagtaacatcaggcagtcttccctagggcttctcacgggccctggtggcatttttattctaagagagggttatatttttacatgtaattggtcataattatactaaaaacaagtaattggtgtcttatacaagaaaattatatttctgctttagtcattgacagagtatcctgagaataagagttaagaagtatattcattgtcatcttatttctgatatatttcaaattcttttgctaggaagaagcccttttgactgtgctttgtgtaacaaaacttcttcggagaaacaatttagataaactttgtcagatcttatgtgattatattcaaaatgctaattgaagattctctaaacattttcagtaaaatgttgaattgttttcatgctgttaaataagttaacatgtcttcctttactaaagtcattattataaaaatgtaaatcctaatgataatagctgatgtttattaagcatttagtaggttccattttttgatagcaacttttatgaattatctcattaaatcttcataataatagcatcaagaactacaaatatgttttcatgtaagaagggaaataaaattatgagttttgctgtgaggtttgaagaatgaaaacaatgcatgacttagaaaatagtataattaagtgaattttattatcattatcatctcttagtttataaatgaaaaaactaaggcttacataatgtaaaaatcagttaacaaggttaaacaaccggtagatggtagaggaggagctgggaataaatctgtacatgtctgaatctggagcaggaacccttaactgatgtgtcattctagcaggtcatcagttactctacaatacctattaagtatactttatttactgtgtttagatttatagtagatttagactctactgtaaaaacaaggacttcatacacctgctagaaagtatccatatcatcttgtttgaaagttgtcccgctctagtgttcttttctaatcatgatgattcagaactccaaactcttgaagcagggcaacccgtagggtcagcattcataatttctcaatacttaaaaaagtttcctcatgactgttgctattattgagatttctcaaatgtcttggcctgaattgggtgtgcactatgaaaaaaaaaatggcagacatttctttttgttaaaggaattttaaaaacacatataaacacactgatttgtgacagattaccaggctttatgtttagcagggtttcctaagcaaaacacaaattctgtaaatctacagaattagataaaacattgactcaatccttagatgagagtataatggattatcacttaataacttctgtcactgaaaataaatgatgtaaaaagtaataaagttctactctcacagtatgaataaataggaaatacataatactttaaattaggcaacaaatcattaagcccccagcattcattagactatcattaatgataataaaattgtgtggtatttatacagatattatatgtaactccaggaattttgttataattgtgtatgaatatatttgttgtttgaggcaggtagatggatatttgcagcagctatgtgctgaagcattctggtaatagttttcaaatcaaccatttttttctccttgtcgatcatctttaaagcaaaagcaccgttttttactatattttttgaaaaaaatacattaggtgtaaaattatatattttgaagaagttcactttctgtttttactagtttcacacctttgttattttttcagtggaaggagcagagataggcaaaggcgaagcctgtgtgtgtggtcaggttcctgggcccttcatagcatctgatgccaagctgtgttctcttttgtgtcattgccttcccacttgctaattacgtgacagagctagggacttccctctgtctagaatgccccccatctcttgtttgcctagtgaaatctggtttgaagttcaaggtctgatacaaaccaggtgatcctctgcaaaactaactgtacctgagcaaaccaggcacttactcttttatatgttcctggcactgctgatactctgatagaaaacatcatcacttaatgctaactgtgggctcacaaaggggatacttctactgtaagaagactgtaactcttcttagcacagagattagtaagtacttgaaacagagtttcacatataataagtgttcaataaattttattttttatttctaacacttggcacactgcatagctcagtaaatgttggtgaagtgaactgagtattctccttatctattatgtggtaggcattattctagttgcttctgttataaaccaactcatttaatccttatcacagcacttttattgtggtcaatattttttaatcctcacagatggctaaggaatcagcactctgagagattggttgacttgctttgggtaaggtgcttataaagtggtagaacaagattcctatccaggccttctgattcaaaaatacattctttttttttttttttttagtagtgttttctggaaaggcagggtataactgactatgctgtgtatttgggactaagtatattattgtcaagtatattaaaaatgtcgcaacactggaaaggagtccatcaatgggctatgcaggttgagggatttgtagatgagaaactgataaatttggttagcaaggaaagccatcaagctgtgaaccctttatattggcaaaagagagggtcctttgaaatctaagggaacagaactttcctgttctccaagtttggagcagaataggtaagctctaggcagtctaatgcccaacttttaccagtggtgttttagttttttttttttttccaaaaggaaatgatggaattctttatatacttctgaattgtctatcttttcaaaaataaaaattttcattttgcagtacatacagaatcaaaagactttcaagtcctaactccacaaatgtttattttgaagctctttaaactgtttaccacggatattagtaaatctgtcagaaatgaggtgacttacttatccttgtcccaccagatatgtgggaaggatgatcacgctagatagcatggatgggtcctctatttatctctttttacttgaatggaaaacacatcattcagattaatcaattagtcattgtgactgatagaatttttatatggataatctgggtttggtccctagctttaccacttacttggggtctttatgtcttctatggtctcctatctgtaaagggaagttgataatgccaatctagctaggttactgagatgcttaaatgtgtaatgtatgcaaagcagcaggtactcaataaagggtaactcttactattattgtatagctctccaggtatgtattgagcttctatagaatccatagccccaaactctttagccctttgagaccaagattaagcattgtctttccagaggagagggtgagagagattgccattatactaatagaattcatcattatcaccgtcatcatcatcatcatgatttcttggtgtgtcatggaatgtactgtgtttcacattaccaacagatgttaattttcacaacatccctgagacaagaaactatgattacattttacagataaggtcatgcagctataaagttgtgaaattgggattcaaactcaggcagtctgtccccacagtccatgttcttaacccaccatgctctcctgacacttgaaaagttaggaggcgtactccatagcctgtaatgttgctgcagagagaatctaattttaaatccagtgaagcatattagttgctgtctttgatatgccattcagattgtgctatccttatgatgcctaccttggttgtatatgtaactgggcgtcaaatatataaatactcaaaaagtgataggtgccaataaaatattttatagttaatacttatgtaatctgtgttctctgtgtttgagggctggttctaaaatactgctctatatttgacttctggttaaaacaataaactttgctcatattagttatatagttgataccattctcatgttgctaacatgtctgtaagtaacagttgaaattgatctggcaattttagagctgtcagacccaggagatgagagaaacatttaaaatgtttataacattaaatcagctgagtcaagagagagaaagagaaagatgattcagatttcttgtactggtggatgtaagtgcttggaactgaaataaaggagaaggtgtagggagggagaaagataaagaagtcttccctttatacaagttgaaattgagttttctttgagatatagaggtgaagacattttaagaaacttcttaaaactctctaatgtggcttttcaacctgtttccatcaatttggcacatctcacttttcggcacaacagaatattctaggtttatctcacaccttccttgccccagcccaggaatcagccatttctctaagaaactcttgtttattttggtggggaacagtattgggaaaccaacatctgggagctaaatatactcctagtggttaggaggtcataccttgtagactcttgtagctgacggagttaggacatatttattagaaatcataagtttatattgatcttgctaggatctatccaatcctacaagattcttccctgtgtctctcctttgtatttgtgtatcctttcttccatattaagaactgtggctcccaacaacaaggcatgtgcccatttgcccaatcgtatgatgtataaaaactactttgagaaaagtggcagccaaaccactaagaaaaataaacttgctgaaatgagttcaagatttattggcagctctttttttggcccctagactgaaagtatatatttcaagtattgtgttcaaaaattatttgggttagctttttccacctttcataatagtaatattatttacttgaaatacagttggctttgtttctatattcagtttttttctctctatcttcattaatttcattatatatatttaatatgtaggacattaacatgtttccaaaagaagaaaacactccttcctgtatcatttccacctcatctctcttaccccttataggtaaccaattgcactggtttctagtttatcttacttatattcctatttgaaaagttacctcatatatgtatgttttttaaatttttatacttttttacacagaaagtaacgttcagtatgtactttgccactttccttttaaacttaacagcgtatactggaaatcactccatatcgtgtcacagagagcttccttatattttttaatagctgtataagacttcattgtgttgtctgtaccatattttattcacttccccatgtgtggacattttgactgtttctagtatctgcaattactaataatgctgcagtaaactttgtgcatatcgtaccttggtaaatttctagacatagatttctgggttaaaggttaagcacatgtgtagttttgttagatattgataaattcctttccatggggtttatatcatttttaaaatatttaccagcaacgtataacagcgtccattacttcaaagcctcaccaacagattgtatgttttaagtacttttatgttttagaatttttccaatgcgataggtaaacaatggtatatcaatatagttttaatacattaaagttcagcatcttttcaagttcggctagtctcagggctattcttaatatcttgtgaattatcttcatattattttcccatattccataatacttttggttttttttcctcctcaattctgacaagttctttatatttcaggaatattagccattttatttgatatgttacaaatatttttctcccaatatataacttttctcttataacgatttttttttcatgaaaagtttttaattaaaaccttttatgggcccaggtgcagtggctcacacctgtaattccagcactttggaaggctgaggtgggcagctcatttaaggccaggagttccagaccagcctgaccaacacagtgaaaccctgtctctactaaaaatagaagaacattagctgggcttggtggcacatgcttgtgatcccagctactcaggaggctgaggcatgagaatcacttgaacccagcaggtggaggttgcagtgagtcaagatcgtgccactgcactccagagtgggcaacagagtgagactctgtctcaaaattaaataaatatataaacaaaaccattatgggccaggtgcagtggctcattcctgtaatctcagcactatgggaggtcaaggtggttgaatcatttgcgccaaggaactggacagaccagcctgggcaacatgggaaaaacctctctctaccaaaaaagaaaaaaaaaaaaattagctgggtgtggtagcatgcaccagtagtcccagttactcgggctggtcacatgagcctggggaggtcaaggctgcagtgagcagtgattgtgccattgcactccagcctaggcaacagagtgagaccatttctctaaatacatacatacatacataccttttgtggagttaaatttacacactttttctttattggctctggcttttgcattgtagtaagactttctttacactcaacttatagataaattcacccatgttttcttctagtacttgcatagttgaattttagatctctagtccatttggagtttattttttgtatggtagaaggtattgatcctattttttcccaaatagttgttacccagttgtcccaaaacaagttattgaaaagtccatctttgtcccagatagactggaacaaaatgaattaaagacttaaatatgaagatttttacttgtgtatcctttcttcctagaaagaaaacataggcgtaaagcttcatgacgttgaatacttcatgccattggtctggcaataatattactattatgaaaggtggaaaaagctaacccaagtaacttttgaacacagtacttgaaatatatactttcagtctaggggccaaaaaaagagctgccaataaatcttgaactcatttcagcaagtttacttttcttagtggtttggctgccacttttctgaaagtagtttttatacatcatacaattgggcaaatgggcagatgccttgttgttgggagccacagttcttaatatggtagaaaggatacaccaatagaaatatttatatttaagtctggcaatcatttttaagatgtgaacttgaacaggcaacaaaagcaaaaataggtacgttggattacatcaaacccaaaagctcttcacagcaaagggaacagtcagttgagtgaagagacaacctatggaatgggagaaaatatttctaagccacacatctgacagagggttaatatccaaggtatataaagaactgcaacaactcaatagcaagaaaacaaataacatgaataaaaaatgagcaaaggatctgaatagacatttctcgaaagaagacataccaatggacaacatgaaaaaatactcagcatcactaacaatcagggaaatgcaaattaaaaccacagtgagatatcgcctcacacttgttagaatggctgttatcagaaagataaaagataagtattggtggggtgtggagaaaaaggaactctagcccactgttagtgacagtgtaaattagtatagctgtgatggaaaagagaatggaggttcctcaaacagtttaaagtagaactaccatatgatccagcaattccacgactgggaatatatccaaaggaaatcagtatattgaagagaactgtattttagtgattattgcagcattgttcccaatagccaagataagggatcaatctgagtatctatcaatggacaagtgataaagaaaatatggtgtgtatacacaatgggataccattcagcctttgaagagaaggaaatcctgtcatttgccacaacgtggttgaacctggaggacattagctgagtgtaataagccagccaccaaaagaaaaataccacatgatctttcctatatgtggaattttaaaagttgaactcaaggaagtagaatagaatggtagtgaccaggggtatgcgataggctgagggatcaaggagatgttggtcacgggatacaggatttcagttagataggaggaagaagttcaagaggtctattgtataccatggtgagtatagttaattataaagtatacttgaaaattgttaagagtagattttctgttcataccacaaaatgataagtatgtgagataatgcatatgtaaattggctcaatttagccatttcacaatgtatatatatttcaaaacaacatgatgtacatgataaatatacagtttatttttaattaaaaattttaaactctctaattggtcttcaacatatagtacacaagtcttttcacgactctttataatggaacatatgttcttggaatgctaaaaattattttttttggaggccctgcaaataactaaaaatttatcttaaaagccacacctaattacttacatatgatccagaaaggatactttgaaaaagctttttaattgataaaatcattaaggtaaaacatattcataaaagtgttctctaataattttataattttctagttcatgaaggattaaatatacaactatcatttgaattggattttttatgaggttaattgtatttaaatgctaattattttaactaattttgtggttgacttctatgtagagtagggaaaaagaatttcctaaagccagttacgtatatctctttttagtctggatttttaattaggaaaagtgatatagttaaataggtctactctatagcatcttctaaaatgagtaaaaattcattatatcaggataaaaaatgataaagatatatggatgacacatttggctgaatttttcttcttcgctgttctcttgctctctatttaaatagtcttagctcttttatcatttaaattctgaagtattgaggtgattattccggcagcaggtgattctgctaattactgttcagtcagttttagctattagaaacagagatatgtttacattgctgggctgcatgtaaatttagaagttacatggctttgtttttactttgacttacggcattaaaattattttcatctgtgtatgtaaagatctgcatctataagcttttgtggataataaggtgaaattgatgcattttaatataaattgccaatataaaatatctctaactcagacctctactggaaagttgtcaaatcttatgtaggaaaggcttttaccatcactgttacacattaactgggcatagtttaatattaatagctcctgagacttgtggttaactgaggtttctatttcctgtgtttgggttttatctttgcaacaacttggttgcttttctgtgtaaaatagtggtgaatatacacaagagtatgacaaggttctgggctcttaactttgatgaacaccatgccatttccatcatgctgcactcaaaacagcacagatgtgagtctgggagtggcgtccctgccgctctcatgagcctttgtttggagaacaccctgattaacccccacccttcacggttcattgactcactgatagatcaagtttaaactagtatatattagcacatttgttaccaacagaggaacagttggccattctgttttacattgctggttcattgcaaactggcgtgctaaaaaggtctgtactctagagtatgaattgggaagttaccaaaggactgagaaccaagtcagttgcatattaatgttgaattatacctatattttaatcttggattgtctacttgggggatgcttacactgttgtcaagttatgaataagtgataattaccactttgaaattcatctttttttttcaaggagtttaggggatttaggtgtctcaatatagctttcatattaaacagtttgtcataattggatgagagcagagcaaggtcatgactacctgatgccttgtgttggagcattttaaaaatgttttccagagagttatttgtacctaatgactttacataagtccttacattatactttatttctaggtcacctaaaaatgttaattgtttagtcaagagggttaggatgtgtgtctgttttctcatgaaaaaaattaagctgttccctttttatcaattttcttgcaatctaaaggcttttttttcttaccttcctaacctagtgactaaggtcatcttattgttacagttcctttcatgggagataggtttactgcatcatttggcagtttcatagggtgaattttgtcttggcttcatctttccttactggttgtcatcccctgggccacctgcttttttgcattttcctttctcttgtgagatgatgaagctctgtgccccgatggggatgagagacagcactctgagttcaagtctaggataaggcaatgggcttgcttttcaaaacaaactagtgtcatacgggctgctgctttcaggtccactgtctgattttatcactgatgacttgtttctggaaggcaaactgatttaagttctgagcaaaagggtcggtgtttattttcaatgctactattaatttagagttttaatttagaaaagattttttaccagttctcaaatatgatttttctattgactttaagtttgtagatataaggagtagacatgagatagagactgaattgcttttttgtttttaaaacttggcagtaataaggggttgcttgttttttcatgctaaatattttttctaagggatctagatacctatcagaaaacttaactttgataactctggttctttattaagtatttttgtcttattttaggaattaatagaaatagttgtaattttagacttcctttataaaataccaatttaaagagaagctttttgcttaaatgattgttttgcagtgttgtgcttttgttttctttaatgcagttgaaatcgcagctttataacttattttttaatttggggtttttaaaagaatattagttatttatttatatttattgggcacctactgtgtgccagacactattctaggaactagtaaacatagcagagagcagaatcatgaagttcttgacctcaaggagcttaaatcctagtggtagagggggaattcaaaaaaatcaaataaatgtatttctattatgtcaagtgatggtatgtactaccaggcaatcagatgaaaatatttcctcttctatacacagtgggcaaggaaggcttcattgactgtggagttttagaagaaagctgaaagtaatggggaaagagagccatatcgatatatgaaggaaaacatggtccaagcagaggaaacgaaaagtgcaaagaattgagcaagaaagtcatgttcaagtggagtcagcaggggaaagagtaggtcacaaatgcggctgagggtgggtcatgaagggccttacaagctttgtatgagtttttacttttattctgaaaaaaacaaaaacaaaaacaaaaaaaaccggggagctatttggggattttaatagaaaagtaacataatttccttttaaaatggatatgtggccactaagtggagagagtggtgtatatatgagtggatggaataattgatacaggcaagcaggagacaggttaaatgaaaaatggattaatccaggcaaaagatggtgacttaaattaagctgggagtgggagagatggtgagacatgcttagactttggattcatttttccagatagaactggctgacagagacatgtcatttaccaacatagacatggcagattttttttttcttttctgagacaaggtcttgctctgttgtccaggctggagtgcaatggtgtgaccatagctcatggaagcctcagactcttgatatcaagtgatcctcccacctcaacctccctagtagttgagattacaggcatatgccactgtatccagccaactttttttttttctgtagagacaatatctctctgtgttgcctagggtagcctttaactcctggcctcaagcattcctcctacctcagcctctcaaagtgctgggattataggagtgagccaccatgcctggccaatatggcggttattaagaggataagtcaaagattacatgaatattctgttatgaaaagtgtcaaacatatagaaaatataaacagtattccagtgggcacccatatttttatcaccttgattctacagatcttaacatttttctgtatctgcttcaaacattttattctgccaatgtgttctaaagtaaattgttgatattgtgatagttctctccaaaatgctgcagtgtgtagctctaaaaatagatatttttcagataaccaaatatcattaacctgccaaatcaatgaatgataattgcttattaacatttaatacttggtccatagtcaaattctccatattttccataatgtcttttatagttaacttttaccaactagtgtctgatcaagaatcattcatttaactaattacatttaaactgtaacattacaacatgttttttcgtatgttttattctctctgacattgacttatggaagagactagattatttgtcctgtagacattttatcatacataagagttactaggagagctctgattactagtccccactctcagaaattttgattcagttgctctttccagtgagctgctggtgatgctggactttcattctgaagaccatactttgagcactactgctgtaccactatccgatggcttctttgtgatatcgtttaacttgttgttctgttgcctgtatttcctctaaactgaattttcaatctaaaggcttactgagattcatgtttgatactttgggcaagaatacttcataagttctagtgcttaatgttaggtagcacttaattctgactatttcactattcatgaggctaagctaaggaggtgacagcctgatccttctattgtaatgtttcatgtgaaactactagataatttgttgagttggggggtgggtagggaagagatatctagttttcaataaatatttcacctaatggttttaacacacattgatcatccttgcctgaactaattatttaattagggatggcaacatggagactttctaattcaatctttttttttttttctaaatgaatggccttgtttttatttttaaatggatgttacttcgcaactggggttatttgattacccagaaatatagcgcatattaaaaaggtaggataaatgcttagttaactaattaagcaatttttaattaccagttttcacagtaaggcactaaagtttctgacttgagcaaagataaagtggaaagataaagtggtcgtttagtgagatgggcaagactgtggataggtagactaggtttggtgggaaagtcagaatatcagttttgaatatgttaagtttgagatgtctattagaaacatatgttgacgaggccaggtgcaatggctcatgcctgtaatctcagtactttaggaggctgaggtgggcggatcacctgaagtcaggagttcaagacgagcctggccaacatgtgaaaccctgtgtttactaaaaatacaaaaattagctgggcttggtggcatgcacctgtaatcccagtaatcccagctacttgggaggctgaggcgggagaatcacttgaacccagggggcggaggttggagtgagccaagatcccgccagccactgcacttcagcctgggtgacagagcgagactccatctcaaaaaaaaaaaacatatatatatatatatatatgttgacaatatttcagttgaataaaataaaatattctagctattttaggtagaaaggcattttataccgatactactactaaagggtaagaagatatgactgtagtacattaaatatgctgatggcctacaactgttgctgtgttgctttttcctcttcaccacacatatgcagcctcatgaaacattttccatgaccagcacactgaaggaaataaaaggaacctagtttagagatggttctgcatgatacaacaaaaatgagctgctaaagcattacaatcccactcaagagtattcccccatcaaatagtggggctggtattttaatcagttgatactaattgtcaaggtgtgatggccaagggattgatgtttatcagtgtatggacagtggttcagagtttggtgaattagtcgagttgaaagagaaagattggtgacaaagatgtatgaggtggaaagtatactttcacagaataagaacagaaaatgagatttatgtttttttgtaaacgttcaacaaagaaaattcattcagaggaggaaataggtaggcaagatgccctattctacagatgttagtcagcatcactgcaaagcaacctcagggcttatgcagtggacacttaaaatagcactggtgcagggatgggagaaataaatggatttaataagcactgctgcttaccaaggttgattgaattgccactattgccaagtgttctacctgcaaacagatcaaccttgagccctggatatggcaccatgtcccagagcaaccagccagccacctggtggcaggttgattgcattggatttgctccattatggaaggtcagtggtttgtcactgctgcgatgaatgcttactgtacgtttggatttgcattccctgcccaccatgtttctgtcagcaataacatggccttattaaagccttattcaataatatgacatcctatataatattgcttttgatcaggagactcattcacatcaaaataagtgaggcaattggctgtcaactacaggattcactggtcttaccatgttcctgttgtagcatattgtattctacctggaagatgaaaccttgtgacattaaagtagtttttagttccataaacataatacaggggtctatgaatcaagaagtggaggtagaagtgttgtcttttacttcacatctaatcacatgttcaaaatattttttcatcttgcctctgcaactttgaactttgctgacacactgaggttttagtgtgaggaaacaatactttcacatgggaacatgatagtcgttcaattgaactggacatttagaataacctggccacattactgaactgtataactgaaacaacaaatgaaaaaaatgaagatgctacgctggcaaagatgattaattttgattattgggagaaatagtattgctactgttaggaggaagactatatgtctagaaactaggaggaaacctgggttgcctccttgtagcagggtaaaatgagtgagtaccttgtctaagaaagggaacatgaccaaactgaacccagaagacataggaaatctaaacagatcaattaacaccaaagaaacgggcattttttggtacttctaaaaaagtaccagactgatattttcacagagatgttcgttatacccttaaggaacaggaacagaaaacttctatactatttaaactattttagaggatagaaaaggaaagaaaactccagattttatttatagaacttgcatgaaattgataccaaattctgacaatgcaagttcaaaaaggaaaactagagatcagtgttacttatgtcaaacagctcttaatagaatagatggatatggttatcaacatgataaatatgtttatcacattttaaagcctacatggagaaacatttgaggttttcttattctagaactgacaggaatgtcctttattatgagcactattagtcaaatttttctggtggaactaatgtaagtagactgctgaagaaaatgaatggtatgaacattggaaaggggaaattaaatgattattatttacagataaaataattgttaagctggaaaatccaagtgaataaagggaaggcctacaattaagcagttaaggaaagggctaggtatagaaatcaatagttttgatatatgcaggctatagccagttaggagatcagttaggggaaaaacacgttgacagcagcaacgaaaagctgataaacctagaattgttcaccacttatcttaaaatgtttaacatggtactgagggacacaggagattatttatgtggaaaaacataccatgtttctatacagaaaaattgaacatcacaaaagtattatttgatcttaagataatttatatttaatgcaatctcagtgaaataccaggagaatgtttttaagctagacaaacttatttcaaagatcatatgtaaaaataagcaaaaatagatgtgaaaaattctttaaagtaatgagagaccagtcttattgactattaagtcattataaaactataatgtttaaaagatggtactgacatatgaatagatcagtggatctcagatgggcagtgcagaaagagatccaaacacatacaaaaatttagtacctctaaaggtggcatttaaaatctgtggggaaagatggattttccaatgaataatgttgggataggtagatagccatctggaaaaaatgaaagtcaaatcccaactttttaccttttatcaaaatgaacttcagatacaattgaaaatataaaattgagaccataaaagtattagaagaaaaatgcagtttttaagtctcaaaaggggactcttaaatatcatacaaagcccagaggccataaaagagatgattgataaattcaaatataggtccgtgtaagcgaaaactttcagtatggagaaaacataagttattaaggcaaatgacacactaggaaaagcatttgtaactcataacaagcctagttttcttactgtgtaaagtactgccataattgacaaagaaaatatgaagaattggcaagtgacatacatagaaagttcatggaaaaaataactcttaaacatttacaaaattttacaacctctcatgaaaagagaaatggaaattgaaattagagtcacatacagtatttcacttttcatttgtcaaagatcaaaaagtttgaacatactgtgggtttatgtttataaggatgtaagaaaacaggcaatctaaattccttgtagagtgtaaattggtagtaataagagaaaaatttactgaatactttgtgccaggtgcttttctaagcactttacatttaattatctcaattaacttatccagaaagtaccattatttctgtattacacgtgaggaatttgaagaaaagttagacaagtaattcaaagtcacacagttaataaatgacagagtgaagatttgagaccatttcctttttctcaagtgtccacttttggtcgcaactctgctgtttctgtagtgagtgatttaacactatatgataaaaccttaagagtacgtactctttgatccagtgattctacttccagaagtttgtccattttgcatcaaatagatggagaatagcattcattgcattgttatttgcagtaaaggaagattggaaacaacctgaacatttatcctcaaggactcatccatacaaaagaattgaagtaaattcatccagatgaatatgaggcagctttagatagagtgagatggcatcctatgtagtgatatggagtcatctttaaaatacagtaaaaggaaaaagcaagatacagaatagcatgtagggaagctgctgtctatgtgaaaagctgtagaatatacgtgcatttttgtatatgcatagaatattcctagacaaggacaaacatggtggttcatacctgtaatcctagcactttgggagactgaggcaggtgattcacttgactccaagttcaggatgagcctggccaacatggcaaaaccccatctctagaaaaaatataaaaattagctgggtctggtggtgtatgcctgtggtcccagctacttgggaggctgaggcaagaggattgcttgagcctgggaggcaaaggttgtagtgagccaagatcatgccactgcactccagcttgggtgacagagcaagacaccattcatctctctatctcttttctctctctctctttctctgtctacacacatacacatacccccccacacacatatatatacacacatatatgtgtgtgtgtatatatatgtgtgtatatatatacgtgtgtgtatatatatgcgtgtatatagatacatttctagaaggattctcaaagtgatatcagtgattgttgtgcaagaaggaaactagatatcagtgaatgcgctaaataaggtgattttgaattctgtagcatgtgtatgatttacctatagagaaagcagtctagcatgagcgtgggtttctcaaatatagaatgtttgcagtgaggtcacttggtgaaaagtatagccatgtcagacagatgtaggttcagattccaggacttccaggactgctgaaagggaaaggggctttggatctccttcagctccaggcagcattgctcctttcccagctttgacattagctggagggaagacaagttcttagagctctatgtgcttgggacaagaccccttccccctactgccttactcgccaaccataactgctgcaaacaattcttacctcttccaccccatgtcactgcctaaaacccttcatcacctggcctcccatgcctctaagtctctgtacatcccctagcctgatactgtccccaaccctcctcaactccagacaccattttactctaccctctggaattgtccattattagcaaaatctcctttattttcaacctcctttctaagtatttcccccacattcttgttgtaatagagacacagctttcccaggactgtatagctttccttgcagtcctctaaagtggtaactggtttctctgccatacatttcataccactggtcctggagatattgtcaatatcttaatgtcttccttccatctcacttaaattttgagaccataattcctttttcctctcttaaaagttctcagtgttgaagctcaatccattagatacctctagctggcactactagttgcagtcctgtgcagactactgagtcattttctttactccctgaagacttaaactctatcttactctcactctctctgacattactcctattaaaatgttatgtttctttagctattctttcagtttttggtctcctctccttcaacgaggatgatttctagaatgttggttctcaaaatgtggcccctttgcagacatcgtcagcacctgggaacctgttataaatatgaatctgcagaccacaccccagactactaagcccaaaattctgggggctggagcccagaatctatgttttaagaagcacgtcaggtaattctgatgaatatgccagttccttagatcttgttattgtcattactgacaactttctctgagaccacaatttgaatctaccaatttttcactagtactcacccatcttaagtccttactttccccttaccagccagacatttgaatattccttgactcttctctttcacatactatatccaaagagtcaacaaatgctgtcagctataccttcaaaatacatgtagaatctaacttttaacctccactgcagtcacttcagtccaagcacaaccatttcccacctggagtattgcaactgttcttgtttggtggcccttggccctactttatctactttccgcaaagcagccagagtgtttctttcaacacctaaggttatatggcttcattgattgaaattcaccgtgcttcacctctttctctacaaaagccaaagtccttgtaaatgcctgtaaggctcgagggtgatctgaccttccctggcctgtcgtgtttcggtaaaagtaagctgagtctttcatagttaaaggacagcaatattgtcctgcatgatattttaaaaacccaatcaagaatcacacattgcatttaattttcatgcctttagtctccattaaaagtgtgccctttgtattaataattggagtgatgagggacagagtttaagaatatataaatattttgtccccaactgactgtcactggatggctttggcacccattggtgattcttacctgaatcagtaattattgtgatgactgaaaatagtgatttttctcactgtataattcttctatatttattaattaccttaatattatcctatagaacagaatgttcccttctcatcttttgtttgtttagtgtcagtattactcatgaagttgggtgtttagaaaattcaatgttgtataatactgttattattcaatattgtattttctcagtttgagtcttccatctgcgtcctttcatgtaaatagtataaagatcagtaatagaggaacatagagtaaagtgtgagcagagaagccttactctgagacaaacttcagagaggtgaactctgttgctgattaagaaaggcttcactgaggaagtgttgtttgaagtgagctttgaaaagtcataaaattttgacaaaagtggggatggggtggagcttaaaggaaaaactgtctgaacaaaggaaggcccggcagactaggaatttggcaataatacagtggttttggaccttgatgaggaagttgaaatggaacataaaaaccctctgcatttagctccatttatttgctcaggcagctctcactgcctaaaattttcacccctgctgttttgctcaggggtgggatgaggggtaatgagggaggaaattttagggggtgaaaacagcacaagccaaaaaccctgctcagatactcccttctcttgaagccttttccagatccctaataagaattaaccaccctctctcacacactctgttgtactttgtccttctctgttaaccagcctctgtgttttgtgctgtctgtatttgtggatacatcttcctcctttaaagcacgaatcatatcttaatcccttggcccttcttcccagtacttagcacaagtgctcaatacatgtttctttaacgcgtgtaacagaggaaggcgaggagagtgagtgggattgggagcaggaggattctgaatgtcattttaaggggtttgggctcgctcttcaggcagcaatgagccatagccgcctttgaactgtgcagcactgaccagagctgtgatgccaaaggatgcagtggaaggggaggacagccagcatgcctgggcatggtccccaagtcagaggacatcagtgggagaagggagaaggcatggaagcaagtggctaccatcttatgaatctgagcactcattcaaaggtggcaaggaaaaaggaaggcattgagcacggttttgaggtttccagcctgggtgattggaggctgatgcaggcttcttaccaaaaagggccctaggcagtttcaccaggaatgtttaaggagtttatcatgaccctatctcttcctcgtctaaaactctccctaaaatcaaaacagtatgtcctgttgaaatactttattgtatcaaatataatgagaagtaaaatattctctctacttgatgtatgaaacactgacttcttgtagtggacaattttcacttgtctttttagtaatggtttttattaaaaatagatgttaataactgcttgtttaatctttaaacgtggccctctgagagcagcttaccgtaaaagaaacggttgtcagctttctttttgctcctcagtccctcctgccccttcctaacaacagaaaatttgctttgcacctgctccaactgggttcgaagagataagcatcttgcaagcccagaaaattgtagtatcaaatctcagccccaactgtgaggcagcactatcattgaatccctgctgagaggcgttgctttcccaattcccaaaagagttctttctcccctggccccttttcaggcttgaactctgaccgaaaccctctttttaactcccagcatgcactgcacttggtactgacactgacccatccctgcttcctctgttctgcactggactcatcagtaggtcaggcgttggtagccctggggtcactggggtgcccaattccaataatgagcacatttagctaaggagaggaaatgtacccttctatttgttacagtccattgctttttttccagaaacaaatgctaaaagaacatttgatatattgtggtttggtaaatacacatagcactgcctaatattcacaaagttgcctcttttttttgcatcttccttcataaattaaatatattgttctaactcatgatttattttaagagggatatacctatttcacagctaggaaaatgttttcaaataaagttatattcagaatactcttgcaagaatttcaaataaaaatagcaaatactatttaaatgcatataacattctaacagacttgtgtgtcattttaaagggaaagaaaaaaaatgatgacaaggactttacaactttgtctttaaaatttcttcttaggctttccaaacagaccgaagtcattaaaaatactccttaacccccaaagtcacaaaaaagaagctacccaggtttattatgagaaggttgaacctctgttgaagcttgcaggaataaaaactgatgtaacaagtaagtaattttcagaatataatttcaccatctacaaaaacatacaaaagcaaaataatctgaatttgtccttaatgcaaacttgggaaactacttgtaatatctatagcatttttacgtcttcataacctactgcagccagctcgagggttataatttaattatttttgttatttttattagaatattaatattttctctttagaattttttcagatattttttcagacttaaacaattgttagatataattacaaaggaagctgtatacttgtttacatcttcatggagatgtttgctacttacacgttaattttgcagttaggcaagaaattgattttttgctcacttatatagttgatgtctttccatggaattcttccttgggttgttttcgttctgactctgacccctggtggttaggtcaaaactaagcactgaactgctggttttattaatagatgaatttagagatgctagaagcttaaatttgttgtctaaactaagaaatgtacttaggtttgtgccaaggaaaatagaaacttgttaatgctaaacttaatagatgattagtaatatcctttttgatttttttaatttggtagtcacatttctttgtttctttgagacttattttcgtatggtggggaactgagtagaagagtcgatgctatggagaatcgcaaccttcctagctttatttctatgtggcttcgctaacagtggaaatttgcaataaattttaattgatgaaaagtattataaaataagcctactcaggggacaagcccagagtgcaattggaacttcctagtcccagttatagattcctagggaagggattcacagtgatgtggctttactcagctgtaaacaaaggagataagtttcaagatgttaataatatcattgaaacctacacctagtgatctgatggattgaggtagaagaaagttcaaaaaaaaaaaaaaagcaagttttgtaggaaggtcagcccccatgaaatgtgcctataactatagaggttcgagagaaactaccatgaaaaactcaagaggaatttttgaattaaaataaagttatagtgaagaagttaacctttatgtttgtgaccttcggcttatttagaggtgatttacaagtaaaagagaaaattcagatttatgttttctttctactgaagatttccaaagattggctgaaggaaaagtttgagatttgtattagggtgagacaattaaaagttgaataaacatattggcatactcaatgactattttgttcattgcttttacatgtgaatactacaaagcagcttaacatggatattgctatatagcattcacttcaggaatctcattgtatgcttgctctgtgttcaacatagtgcaggatgcgagatgaataagctatcatacttggatgactttctacattattagagattcaaaaaaatgcttaaaaccattataactggggtatacataaaagaactttgatgtctcagaggtgatattttgatcggaagattcaagaaaagcatttgaactaggcagtttttaagaggcagacaaaaaatgagggaaggaagtcaggctaacaggcatgtactgtaaaagttgggagggggggcggagagagagagtgtgtgtatgtgagagagtccatgtgtgttacacccatacatctggagagtttgtgccataactttgctctactttcctcagtttttacattatctgaaatcttactctatcatcataaaatagctgccagtgaatttcatcctttcttattaatatccagtgggatggggagaggtgtgcatatgtgtgcaagagagacccaacatgctttaatcctgaagatgaattaaaatttccttttttaagtttgggcacagatactgtattagcgcagtcaatctggaataatcatttatttaaccatcaagactcttcccaggggctgaggacagatccccttttcctgatgactgaaatgcctcagctgaatctggattctgttagggagaagaaagggcaaaatgacttctaggaaggctctcaacaatgtatactacaggaggtataattccaggttatggatggatccttaagctgcactcagcagtttactcatcgtgtattgatccacagttggtgtaaatttttttttatcatactgttgcaatctggtttggcaaagatgactccaccagcagaattaaaattaaaaaggaagagagaaaaagagattggagacaagaaaactgatatacaaggcctgaactaaggcagaggaaatcatctaaatgtgctttccttcttaattgtattggagacaaaactattatgttctaggatttttttctctaaatttgtaaatattactaagtaccatatttaaacataaaacaatagaatattccgtaaagcaaatttagaatttacttacatttgtgcagaatggctaattattagctgcctaacactcctcctacaggcaaatttataaaattacatcatttgcttataaaaccattttagtatgcatattggctcaatatttatgaaaaatatttcttgaataaacctgtgaatatttgaaaagttttagtcttcctgcctatcttacagtgttatttttgtagttgaaataatatatttgaaactttgtatattatactacagaaaggtggtcataatactgttagtttcagtttcaaaaattatgtcatagtaagatcgaattcgtactttatttgaaagtatatggaagagtaaagcagaaagaggacatatcttctgcatgtccagtgggacattgttttaatgtatccttgtgtgaatgggtgagtccaaatggaattggaattacaaaataaaccctatatgatgagttaattaggaaatagtgctatataaatatgaagtataatatgaagaattacagctagatatatacactataaggtactgtaattttttcataaatttattttaaaaatggatcttaccacattaataaaaacacacttctttcattttgggttgtgctgaaatcctaactacttctgaatatagatcagcatcttttgaaatatttgtgctaaagttgcatccccactctgctaccaccaccaaggtagtatcttatctaatagcatcagaaaaacttccgggagaacctggaaagaattattttttcctaattacctattcgtacacaaatcaaagaagagtatgaacgataagcccatgctggcatatgatatcatttctcttgcttctgaaacaaagcaagttttagagattgtaccattaaaggtgtgacagatattttgaggatcagagatccataggataattcatagtacaatagagtgaaaaagttaaggcagcagagaaatcagactgaaaagaactttcgaggccatatggttcaatttttctccttgtgggtggagcacaggtgtgtggcactcaactttggcttggccacctacactagaggcagagtacgttgttactggacaatactgtttgacattcttatgaatgttcagagttactgtacctttgggcagattagaaaaggcacctcctctgtgctgacttacaaaaaggtgccctttcttccagactaattcatcctttgcttataaaaccatttcagtatgcatattggctcaatatttatgaaaaaaatatttcatactttcaaaatattcatatttcaaaaatattcagcccaaggtcactagattcagcctaaagtcatttgttagattgcaaatccgtcattcccgttagccaagtacctttgtgctaggcataaactgtacaaaatgagaacttgtcagctgacattcgcctctttgtaatttttatgtactagagttaatgttatctcttgtagtaatatgaaataaatgtgccccatctattgtataggagtcattgagatatttgaagagagatatcctgtctgcccctcatctcttgttcacgataggtacttccatcgccttcagttactttttgcattaacagagctgctagaccttatcatggtcattatcattatcatactcaaagacatttatctgaaggaaaccttgatctctgccagctcagggctcttgggagtgcctagtcaccagataattttacctcctgggcagagttgtcaagaaagtggtgtttgttatcattttccccttctttctcctaaaatcacgcttctaacatggctgttaacaagcctcttcatagtgtttctctggttgtttatggctctacttgaagccttccatttcttggaaatgcctcttgcctttctaaatctcacccagcagaaagctaggccatctaatgaaactgtgtcacaaaagattccagtagcctgaggcatcactccttccaattttacctgcattttaatacaaaatctgaaaagtaaatgttcatgcatcatatctagctagagagaaagataattctgtgtaaaagattctttttgttacctcttaaataattgtgggtgtatatggccagtcctgttcccagcattcagatgtgagttaggaagttggaactttatacctggggacgatgaagactcactaatggggtatatacaaaaaagtgatatgattaaatatgtatctgaaaatggttattctggctagagtgggggagaggtttgagggagacaagataaaaggctattgtagtacaggtggagtatcccttatctgaaaggcttgggaccagaactgttacagatttaggatgtttttagcttttggaatatttgcattatacttaaccacttcagcatctctctaatttgaaaatcatggacacaggaaggggaatatcacactctggggacagttgtggggtggtgggaggggggagggatagcatcgggagatatacctaatgctagatgacgagttagtgggtgcagcgcaccagcatggcacatgtatacatatgtaactaacctgcacaatgtgcacatgtaccctaaaacttaaaagtataataaaaaaaaattaaaaaaaaaaaaaaagaaaatactccaatgagcatttactttgaacgccatgtcattgctccaaaatttttagatgttgaagcgttttggattttagatattctggttacagatacttaacttgtctacacatgaaagatatttagtgatcagatcaatcagctaatttagggaattagctgggagaaatggaggaatgctatggcataatttaaagacagaaacaactggccttggccatggagtggttctggagagtggaggaaagggacactctagaaagaagtcattttcctgtcttggggtagatgatggaacacaaaaagaacaatatatttgagagagaatatatttgaaggtatacataatggattctgttttgagcttactaactttaaagtacctacaggacaggaaagaaaatgacatttcagtatcatatcccacactagaattttatcaccaaaccaagaaatgtttccttatgtccaaatcaaatctcacctgattttatttcaggtgattttctcatcaacattgaatatcaaccttaagactttcttgtcttcctgaggaagttgcatttgcaccaaagaggggagggggaaattcccagcagtgagaattgtgttcaaagacctgtaaactgtgaaggcttcacatctcctatttagaaagagcacaggttggcaatctcataggaaaaggcaaatagatgaaagaagaggctgggttacattttttgaaattacatttatctagcaatcctttctttgtttgtttgtagggggatgatttgaatctggctgtcactgattccagggcccacaatagcctgtctaaatacatatttggtcctttctactatatttaaatagtaatccagatcactctttatccttttgcctaacattgttttgtataaccacctattacttcatattataattcattatttcattagcatatattgtctatctccagaatgcaaattcctgaggccaaagactaattcattttgttcattttgctaatatattttatagatgtagatagtcaggttcttttcattttgtttctttgttctagatctttgattttattggacttttgcaatgttacttaaaaaattgctattttcaggcaggttgcattagtgtataatcaaattccacccacaatatcaaaaaaagactattacaaattaaaaaaataaaaatagcattcaataataacacagttctaaagctcattattggatctgaaaaactttaccaatgtaagctttggtataaaagtaaggcttggtgaactgattcttagcataaatattttttcatgatattcttatttttaatgtgtatatgtaagatgttttattttgcattttaaggttgtaagtacttgctgtagttataaatgaatgatcagcacacatcttctttgataacctttcaactttattaatattaatgtttcatatgtagttttattatggctttcttctgattggaatttaatatagagaggttttattcatgtgagtgttaatggcattttgaataagctatgggagaattacaatgtaacactgctggatacagaatgattcttttagacaccaagactaataatttttaacaatatcgaaaaacattgtaggaaaagcttgaaccatgctggcaccagggacagacaagcatgaaagattaatgtaatcttgcatataatgacacacattcttacacaaaaaatccatctgcaatgtcatgtcagtcagcagaaatctttgatgggtggatacagctgggctgtctcttctggcagagctgccctggaaaatgctaaatgtggttgtgatgcttggtgccatctgcagtgtgcccgtttatcctgtcttcactggcatttacgatactgcatagggcatcagtgactgtggagacagcgatacagagtgacagattcatttcctcggagggtctgagctctggtgggcctgtgtgccaccctccttcttgggtctgggtctcttataattggtgttggctttactttgtattttcacatccaactcttcctctttttagtctaacagttccagtacacattcttctggtttgtaaatcttacactaaccttttgactaatttattcatgtaaggttgccaaaccgatttaagattgactgttcaatgccagctaatatgccttatttccaaaatactgctcctcctaagcctctgatttaaaggacatgtgtcttatttagggaatactaaacaggcaccaggacaaattgggtaaccactatgcgtgggatattcccaaatgactttatgtagttgaaacaaatatatgaccttctcttacataaagctataaaacatcaggccagtaacacttagtcctcttgcccatgattaaaatataaatattcaagaataaatgctgttttatgacttgaccatatgtttatcatattattttgccagaacaagttaaaaagtgtgatcattgtttaaaactgtcactttgtgtatgtgtgtgtgtttttttaatagtaatggaatatgaagggcacgctctgtcactgcttaaggaatgtgaactccagggatttgatgggtaggttatattattaatcaatatatgttatatcatttatgtattaaatgccttcactagttttagctacatatttggaacctaacatttaaaaatatttgtagtgtatgtactttggctctatcttgttcatatctatgtaataataattaatgataatatgacatggtcatctatctctcaggatctggcataggaaagcaaaaagaggaatctaattattaaaatactgggaaatgacagtgtactactctatacttactaatgtgcatacatttgcatctataattatttgcttttaccatatatctagagaagcactaatggaagatgttatactggtcacatggcataactatatgatgatcttcttttgcaaattaattgataggtttaatagctacccattggttaacttgtctgtgatagattgagggaagatattttataaatacaagtaaataaatacattatttccagaaacaataagaaataattttaattatctcataatgtagtgactacaatttaggtatgttattcacagtgggcatcggaaaccattgttcgcaatacattggagtgtacagagattgttcactggcatgcaaacgttagaaccaaggcaagtgatataaatttcattgccattttttaaaattaggtgaaccaatttgctaaagtgttggactgatgtgtaagactaaaacatattatattcctttagggaagttctttttacgtgagtagatatttgagaatttaaaaagttgacaagtgtgtgaattatttgtgttacatggtgatgggcagggggcaaagacccataaggtcaggaaagggagttaggtctgtactttcaccaaagtgaaaggcattaaccttcccaaagactgatttgaatgtgctggggagggaagtgatgcaatcaaaatggagtattggcagggctgtttttcagaaatgcttatttatttatttattttttggatgaggagaaaacaatagctgttgagaaagaaaatgtggtaagtaaaacatgatttttccaaaaggaatctaattgagggaagtaaatctagatagcaatattatataaacattgggaatcaaaaatatggggtaggagattacttcagaactttatacttagaggtagacaaaaacattaataggcttcatttagaaaattgtcttacaagtatacaatttaagaaaagtccttgtgggaatcatgcataccaactacctatttgaatatgctgcatagtccctcactagacctcatgagtacatgaaggtagctgcattgcaaatgagtacctgcttcaaaacttgattaaagaatgagaataaagatatcacagatattaaacttgttcttacacagcagcattacagaatgttctgctgaatgcagtatctatcaatatgttttactggtatttgtactgggtaaagggatgaaaagaactttgcagaatgaagaaagacgattgctgaagtgtagtacaataatatttttctctttacctgaacatatttaatccttatttatttttcatggcaggtgttgttatttttcagtgtagagctaaaagatgtatagatttttcagttattatattttataaaccaaatagtttggcctaaccattatatgaattgagttatgtaagtgtttctaaactctatggcatgctgatttatttcagacttacaataatttcaaatttctactgaaagtcatcttccgtgttctaagactctttaaatcaggggtccccaactccgagactgcagatgaatatcagtcagtggccttttaggaactgggaggcacagtaggaggtgagtggcaggagagggatcatttccgcctgagctccacctcctgtcaggtcagcagcagcattagattctcacaggagtgcgaaccctattgtgaactgggcacgcgagggatataactggtcatgcgagggatctaggttgcgtgctcttgatgagaatctaatgcttgatgatctgaggtggaacagtttcatcctgaaaccatccgtctcccaccccaccctgcagtccatggaaaaattatcttcccacaaaaaagtccttggtaccaaaaaggttggggaccactttaaatagcttatttatttttgtggggtcagttttcccagtagaagctgatatggtagttggagtaattatcttaataaactggcaattttaagtcactgtacttagaattacatagagagatatatgaggagaataatagaaacatagtttcttcaggtacttcaaaggaacaattctcttgcaagtaaaattgtttgaaaatggaatattctacattggtgagttttctattcctgaacctgttctaaagagtggctaaaggaaaattttgggggaaatttatagaaaaggtgcagagatgagagaaggttaaccccaaaatgctatggcattttgatgagagacagactcaaatttctttaagaactttggcctgaagcacctccgtctgacactagtggaactattaatagggagtgattaggaaatcacctaacagtttggtttctagatacaggctgaagaagttaagagccaagaaagattctatgtatagtatttagtaaagcaaaacaatttggtaagtaatgtttaagaaatgctatttcctaagattttggagttgtatttattttttttaatgaattacatatgtttctatgagacatcttgtgacatttctaaacccaacagaaacagtgtatcagcacttatgacagctagttctccactgcagtgtgtcctaggaaacactctaagatccactgttaaaccttatgagagcttcagattctatattgctccctattttactgggcatgagtaggaagttttaggaaggaaaataaaagaatatcagctgcatagacttgaagcagtaacacttgcatttataagtgtgagtatagttttaaaaatctatagattttatgcaattgtaaatatatgaattcctcgctattaatatttgtttcagaatttttaaaaaaattgttgagttacttttcttttgttcatttcaccattaattagacccataatgttgtagacattatttggattatattgacattttatcagattgaacatatctgtattacttagtaaggtaaaaagcaaaaacaaaaacaaacttttccagaaagaaaaaaaactgtgaatcaaaactacaacaatatattgaacatttcatagatgatgggttcatagataagtataaaaacattcattaaaaaaatctttatcactctttgaaaaaggatatattatcacccagtgtttcttttctagacagaataattctgtttggagccatggcaaggagtttacttattttaaaaacaagatttgtcacatgcaaaggattagttactctaaggtttatgttttagagtgacacaagtgtgattaactcactataaatgattgaatactttgctttttgcctttcttgtatatttagactcttgtgatatttttgtaagaagctgttgatgaaaaaaaccaaactgtaaaatatttaaagaggtttattttgagccaaatatgagtgctcatggcctatgataaccccaggggggtcctgagaacatgtgcccacagtagttgggttacaacttggttttatacattttggggatacagaagttatagccaaagacataaatcgataaatgtagggtattcattggtttggcccagagaggcgggatatcatggagctggtgggaaggggagctcacagatgaattcaatgattttctgattgtcagttggttgataagctttgctgaaagattagaagtcagcagaaagaaatgcttgagttaagataaatggggtggtgtaggctgggtgcagtggcttagcagtggctcacacctgtaatcccagctctttagaaggctgaagaggggagatcacctgaggtcaggagtttgagatcagcctggccaacatggcaaaaccccatctctagtaaaaatgcaaaaattagccgggtgtgatggtgtgtgcctgtagtctcagctacttgggaggctgaagcaggagaatcacttgaacccaggagggagaggttgcagtgagctgagatcacaccattgttctccagcctgggcaacagagcgagactctgtctcaaaaataaaataaaataaaataaaaaattataaaaataaagataaatgaagttgtggaagcacaggttcttgttatgtagatgaagcctccagatatcaggcttcagagagaatagatggtcaatatctcttatcagaccttaaaaggtatcaaactcttagttaaatctctcctggatcaggaaaagacctggaaagggaaggagattctctatagaatgcaaatttctcctgcaaatgatagctttgcagggccatttcaaaatatgtcaacaaaatacattttgggataaaatactttgatttcctctagggcctgctatttgttatttaatgctataccagagtcaggttggagttggggatcttattgctaccaagtctgttttgtcagtcttatgatctattttttttttttttttgagataaattctcaccctgtcacccaggctggagtgcagtggtgcaatctcagctcagtgcaacctctgtctcccaggttcaagcaattctcctgccccagcctcctgagtagctgggattacaggcatgcaccaccatgctcagctaattttttgtttctttaatagagatggggtttcaccatgttggccaggatgatcttgaactcctgacctcgtgatccacccttggcctcccaaagtgctggaattgcatgcatgagcctggccaatgatttacatcttaatgccagtgctggccatttgcgcctaaactccaaaagacaagagggtataaggaggcatatccaacctcccttcctgttatgacctgaatagtttttcagattttctttgtgaccttcatggccaaaaggggaggatccattcagttagttggcgacttagaattttatttttgttttacaaaacttatttcctaggttgagtcactttacctgaacatgatcttaatgattgaatagttgttaacataaataaatacatattttttctaactcacttaatttcacactggttctactggtaaactgtttttcaaaataataagattctcataaggctatttttattaggtttcatatatagaaaaggtatctaatatattgaataatattgtagcttctaagaccaaaatgtcttatttcaaatccctgttctattacttactagtggtacaatcttgaaaaagttactttatctttctatgttttagtttcctaatctgcaaattgaaggtaatattacctattgcatacagttatttctccacttaaatgagttaatacatggagagtgcttaggaaaatgtctgatatatatatatagtaattattcactaaatatttctttattgttataattgtcatttgtattagtttcaaaagatttaacacagaatgtattatgacaaaatttcagatgtttcagaacatgctcatagggaggccacctctaataactctagcaatatgttaacatatgcatgacgctataattgtatgcaacattctaggagttaagtgttcgcatcctatgtatgtaagggtcaagttatttggtgctaaattagatttttttgggtatgactccacatagtctttttggtcacacccatatgtcagcatttagacagccatggattgagggttacgtttaagttcacagattagaaatctcatagagatttttgaaatcaggtaagtttcaagtcaaaccttggtttttttcattcataaagatgggactgtggcctattttgcagacttctgaggatttaatagaaattagtaaacacattacctgatatatagtttgtccttagtaaacatcattccttttctctgaataggtggtcatattgcgaacctctggaatcagtttagacataagaataaaacacacctaatcaaacatgacctgggtcatatcttgagtcttctaaccagagtagccttggattgcccaggctatgtggagctagtgggatgaggaagatggggactagagggaatagatggccgagagaaagatggtgggaactgactggaaagacactttcagcctttggtcaccaccctccagagcttcctaaacttagagaaccagtaactactgctgactgtggcccatagacagttttgtttgaaatagtgtttttaaatatattgaatgctagttgcttagtatttacaaattaggagactcagccttaaatcagaatctctggcttctgtagaaaaaccagatctgggtccattaggcctcacacgtgatgtgagtgggccacagcaaagaagtggctgcgcctttagattgagcctactcttccattcctgctgggcccttgtagcccttgagttgtgacacctgctttcactgaggcaaaatccactttccattgggttaactggtgacattttgatacgtaagaatattttgcttcttttgaacataaatgattatgaaatgaatttctggtacttctgtgttattttaatggattctgcccccatagtctacttgatataaagtcttaaaaaatatactagtagtactatctaggatcaaaggctaatagtattacatctagaagcaccgtatagcaataatgtcaaggagatgaaattcaggtcaggtttgtaattactacattcatatagtaatgataattagcagtttcttaaagcttcatattttatatgatttttattgctatctgtcttttcagagctttattgagaattagcaggattttatgactttggttggtgttagttaaatgaattgcagatgacagtattattaacaagaaatgagaatgatatgcttttggatgttaacagagcaaaacgctggtcagatgtgaattaacatgttcaaaagttttcatatctcttaacacacttaaagctattttgtctatggggaattatctagttattatatttgtgaagtaaacttacctgtgttgtgtttgtgttgtcttacccattgacacatattaacatgtttaaaggtacatgtgagcagttatgcacatagactacaaattagtaaactattttgaagtctagatttcatgacttattaccaatcattctgaagttttgccttctttgcttgatttgtatttttctagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggcaagggagtggctacagattcattaaactgacccttctccctcttttcctttcttacttgctaatctagacagcacaacacagaattaatgaacagactttgaaagatccagacttctggcatccccactagcaaatgtgagacttttgacaagtcatttaatctctttgagccttatttttctaatctatagaatagggatcacagatatattattcactttattacaaggttattgtagtactaacgtttggtttagtaaagggtttaatatatagttaaaccatcagtatatggaatggttattattctcccttcgcataaaaaatctgttgattacacagtaccaggtaagaagtttcaaaacagggccactccagtctagctgcttacaattccatatgaggtgaatatggtaacttgcataattgatgtataaccagataaccttgagaatgccaaaattacttgtgactggaagggaggataaggtttggaagggtgagattcttaagggcaaggctttttaatctttctactcactgccatttttcagcatctagaatagactatgccacagtgatgctcagtgaagcctattaagtgaatgcatgtaaagaagactttatatagtaaatgacacttggattaggtcttaaaatgggttggagctggcctgaaaaggtgagaatgagttattttcttggctgcaaaagtaataaagcaaaggcaaaacccaggagtgtttgaggaatagtgaaaaggccattcagtggaagataatggtatcaaaataggcccaaccatggaggctcctacatgccacagtaaggtctctgaattgtatttgataagcagtagggaataatgggatgtttcagagcaagggggcaacctgattggagcttgttccaggaggattcattttgcctcaccgtgtggaatgattagaggttgggagcaggagaaagtagaggtcagagacacggagaaccgttagagcaacactgtgatccagaaaagagggaaacatcattcaaaagctgattgtattacacaatcactcatccctatttaacgaacggtgctgggaaaactggctagccatatgcagaaagctgaaacaggatcccttccttacaccttacacaaaaattaattcaagatggattaaagacttaaacattagacttaaaaccataaaaaccctagaagaaaacctaggcaataccattcaggacataggcatgggcaaggacttcgtgtctaaaacaccaaaagcaatggcaacaaaagccaaaattgacaaatgggatctaattaaactcaagagcttctgcacagcaaaagaaactaccatcagagtgaacaggcaacctacagaaagggagaaaatttttgcaatctactcatctaacaaagggctaatatcctgaatctacaaagaactcaaaagaatttacaagaaaaaaacaaccccatcaacaagtgggcgaaggatatgaacagacacttctcaaaagaagacatttatgcagccaaaagacacatgaaaaaatgctcatcatcactggccatcagagaaatgcaaatcaaaaccacaatgagatatcatctcaccccaggtagaatggtgatcattaaaaagtcaggaaacaacaggtgctggagaggatgtggagaaataggaacacttttacactattggtgggactgtaaactagttcaaccattgtggaagacagtgtggcaattcctcagggatctagaactagaaataccatttgatccagccatcccattactgggtatatacccaaaggaatataaatcatactgctataaaggcacatacacacatatgtttattgtggcactactcacaatagcaaagacttggaaccaacctaaatgtccaacaatgatagactggattaagaaaatgtggcatatatacaccatggaatactatgcagccataaaaaatgatgagttcatatcctttgtagggacatggatgaagctggaaaccatcattctcagcaaaccatcacaaggacaaaaaacgaaacaccgcatgttctcactcataggtgggaaatgaacaatgagaacacttggacacaggaaggggaacatcacacactggggcctgttgtggggtgggggaaggtggggagggataacattaggagaaatacctaatgtaaatgacgagttaatgggtgcagcacaccaacatggcacatgtatacatatgtaacaaacctgcacattgtgcacatgtaccctagaatttaaagtattatatatatatataatatacagccttatgaacatatatatatataaaggaaaattaggcaaaatagcattacttgaggtactcaatagcctggcagagcagacattaagggtaagagagactggacttgaatttcagtttggtacttgactttgggtgggtaattagcctttattagtcttgattacacatttaaaaggtttaataaggccgggtgcagtggcttatacctgtaatcccagcactttgggaggccgaggtagtggatcacctgaggtcaggagttgaagaccagcctggccaacatggtgaaaccctatctctactaaaaatacaaaaatgagctgggcatggtggtgtgcgcctgtgatcccagctactggggaagctggggcagaagaataacttgaacctgggaggcagaggttgcagtgagctgagattgtgccactgtactccagcctgggcgacagagcgaggctgtctcaaaaaaaaaaaaaaaaaaaagtttaataatgtccatccccatagggccattacaagaatcaacttttaaaaagtcacacattatcactaaaaaagcaaaatatttttccctatgattatagaaaataatgcacattgttgaaaaaaattcatattttgataaccctattcatttagtatggattttagaatacttagtattgttgataagttgacagagcataagatattcaaatgcccttttagagtgtaaagtctttcagaaagtcagaatttaaaaggagagagatattcagatataatctgataattctagagtatataggaaaacctaaaatggtttctaagtagaagacaccaagatgattttgactcaaagagaaaaatgatgcattttgggccatcttttcatggcattttatttcttgacctttttgctttactttagtagttctgactataatggtggaaactttccaacatttccttccatgcaaagtggatgtgcttaggacacttcattagtacttaaattcctgaggtcattcattgactgccatacatcagaaatagaaagatgggtgtccctacaggtatgcctttgacataaatttggtggttggctataaaaactggtggttattcttatgttttagtatgtaattcagattttataaagaaatagcatttagttttatcactattataattttgaagagtatttctgatttggggagcattttatgtattctttggatatttgtagtaatgccattttaacctgtcttgtttagaagacacagtatgctgccaaaattctggtcattgcataggagttctagcattctaattccatctaataggaggggaaagtcatgtgtggggtatatttaatatgatgactgtatgcctagtcagggcttttgatagagaatgggaactagaactaggcaggaagttttcaagctgaacatgaggagacagtgtgcctttgaagccatttgcctcctggagagagacacccagagggagagtgtttagtaaattaatccactgagccaacagactaagctgctgaattatggtcagactcaaatggatcagatgtggagaagcctgtatttgaactgctggccattaggaatggtgtttgttgctatgggaactggtgctaaggaactatactgagagactctgattaaaagggggagggggaatggagaaaaaagcctgagaggacataaaaataaaaaagcaatccagttgttgtaaaacaaggctcaagccacatactgatggctgtgaaccatatattcctatagagtttgcataaataaattcatgctttccaattaatttgaggagaataaaatattgccgagggactgttaatttctatgatatttcaggcaaagaaccaaagtgtaggtgccgttttcatgagaattttagatatgcttgactaggaagtcattacatcacatttatctgtttggatgtgggagacattaacagccttatgaatattcatggtatctggttaattaagttaattgttctgcagaagtgcttgcacttccaaggacattttttttttttttttttttttgcctccatagtttctccctggtatttcatcagtaattctttacatgaactgctacttctgtccttacttttttgtatttggaacattttagcagctctcaggaggaagtggtaggcaaagtttctggtagtgttaagaaaaataactttcaggctaattaaaatgtttaccttgaggtagaacatttatagcttttgtgagaacattaaaattacgccattgttatttatgtgagcagcatgttcttttggcatgtagacatcttttcaaatagagtacagtttcctgaaacaaaatgtaatccatctttcagattatcccaacaaaatatagaacaagctatcgttttgcaattttacatatactttctcataaactttccttttttcttcagagtgtcaaaaaccacatttaaagactaagatacagattaatgagtagtcaatgactaaaataattttctgacttctagtcatgtctgttatcactgccaacttctacagaattagagaaaagttgcaaagcctgagaagacataaacaatttttaaagccatctctagcattctaaaaaaattttgtacttgggcatacccaccgtacttcaaactcacagggaataaatggtctttattttcttaagtcatgatatgtgtcattctctattgcacatgacattacattatgttttttaatagcctttctagaggaatgcttttacggtctactcataattaaccatggtaatggaggaaatgtgtttcatggagtactgtaatccatcgataatcctaaatatctgactctaattatgtggcctcctccaaaatctttaccacaaatctgattgggaagcacaatggattgacttgtttcttccttttctcctgatccattccagatttattagcaattagatggtcaaagggcaggctgtagagggccacaagatcattggaaagaccttgataaagatccactgagtaacaggtttctacactacttgttctcaaaacttagggtccatagactcaccttgtgaacttgctaaaacagagatacctgggtcctccctcctccaaacacattctgagtccatgagttggaggtagaacccaggaatgtacgtttttaacaagctcccaggtaatgatgctgcttggaccatgcattccagaggagtttctcaccaagtcactgtgcatacaaaccacctggggatctaataaattgcagactctgaatcagtgtgtctggaatggggcctgagaggcaacattttaaaaataatatattttttacttccattaatactgctattactgttttaatacctattatccttatttttaaatggacaaaaattgtatgtatttattgtgtacaatgtgatgttttgaaacatgtatacattgtgaaatggctaaataaagataaacatgcataaaattgacataatgatcacatactgattttacattgagaacacttaaaatctcccttagaaatttccaagtatataatgcattgttactaactattgttttagcctgttctcatgctgcaataaggaaatacccaagactgggtaatttataaaggaaagaggtttaattgacttgcagttcagcatggctggggaggcctcaggaaacttacaaccatggtggaaggcaaaggagaagcaaggcacattcttcacaaggtggcaggaaggagaaatgctgagtgaagtggggaagagtcccttataaaaccatcagatctcatgagaactcactcactatcacaagaacagcatgggggaaaccacccccgtgattcaattactcctacctggtctctcccttgacatgtggggattatggggattaaaattcaagatgagatttcggtagggacacaaagcctaaccgtatcaactgtagtcactaggttgtataacagatctcttgaatttattccttttacctgaaattttatatcctggaccagtatctccccagtccttcccacccattagccccagtaaccactattttactcttcgcttttatgagtttaagtttttcagattctacataaaagtaagtatttgcctttctgtgcctgtcttatttcacctagcataatgtcctccaggtttatccacgtgttgtaaatgacaggacctctttaatgccaaatagtattccattgtgtatataaacaggctgattgtccctaatctgaagacttaaaatccaaaatgctacaaaattagaaatgtttgagtgccagcatgatgccacaactggaaaattccacacctcatgtgacaggtagcagtcaaagtgcagtcaaacctttgtttcatatagaaaaatattttaaatattatataaaattatcttcaggctatgtgtataagatgtataaaacttttatgtttagacttgggtcccaccccccagatatctcattacaccaacagtgtaaaagtattcccatttctccacagccttaccagcatctattgtttattgactttttaataatcgccattctgactggtgtgagtgtggttttgatttgcatttctctgatgatcagtgatatttagctttttttttatatgtttgttggccacataaatgtcttcttttgagaagtgtctgttcgtatcctttgcccactttttgatggaatttttttttcttataaatatgtttaagttccttgtagattctggatgttagacctttgtcagatgggtacattgcaaaaattttctcccattctgtaggttgcctgttcactctgatgatggtttattttgctgtgcagggattgttttcttgatttctttttcagatagttgtaagtgtacagaaatgctactgatttttgtgtgttgattttgtgtcctgcaacttaactgagtttgtttattagctctgacaattcattcatggagcctttagggtttcctaaataaataagatcatgcctacaaacaaaggcaatttagcttccgtatttatgatttgcaagccttttatttctttctcttgcctaattgctctggctagaacttccagtactattttaatgacagtggtgagaatgggtattattgtcttcttgaggaacaagacattgtttctcaactcatgagagtaattttaataagcactcaagtattgtcattcctgtttgacagtaggccgtattttgagtaacaagggtcacagcataacttgccttttggtgaatcagttggaaccagtttgccatttagttaaaataaacttttctttgcactggtattactagaagtaattgtgcttatttataattaataataattaaatatgcttattcttagttacctaaaaaattatgatattaatgacctcttggttgataatggctaagctgcctcagcttctccaatttagcaacccaagtacatatcagttcaaagtaacacaaattgaagcaattatgtatgatcacataggaatgcttctgattaacaaaatccagaggactggtctttgccttcataaccggaacacaccacatgcatggtttcacagctcttggctattattggacttacttattatattctttaattcaagaaaaattgtagcttcattcattctgttcttaataattttaaattctctttagcctcctgggaatgggaagggctagctggtatagtcccctgtatctcagatttcagttacacataaacattaaaggggcctgacttagggcgctctttgcctctgtggactggtggggaaaatccaggtgtgtcttaaattctaataatcatgaaaatcagaaatcataatgtttcaaatacaaatcttcatacatgggaaatacaattgaattaaacattttcttcaatgtaggagacatttgtcagataacagaggggattctcatttggctaagagcttacctctaagattcattaaatgtgtttagagcatattttttgtagtttgtagttattttatttttctgagttattatttggattattttctcttttatttatgtatgcatttgtcactgctccccagaggcacctcattttggcattgaagctaaaaacccattcattaaggttgggatggagtgggctttgatatagctagcatttgggaggtagaaaatagacattcgtgatcaaaaaagctgtaagcggttactataaactatttttaaatttctaagtattttaaatattgaacaaatgtgtagacatttgatgtgcatctatactgtgaataagaacttaaacttctaatattcacattaactttcctgattttataaattctcgtttatttttcatctgaacattgaagaatgacatctacataaagtaaaagcaaatgttagtttgaacacattctaccctaatagtgcatgttttaaaattgctttggcaggatctaccaatgtattggcacattctcttcatggagttcctcatgtgataactgcaacattgcacattataatgggtaagaattcttccaaagcagttcatattttataaggaaatgttgatttatataaggaaggccatcttatttccatcagactttaagaaaaggcaggttctttgtctcttagagtagagaaatgtttgactaaaaaaccaaaaggcaatgctttactatgtggattgcctgtcttttcaaaatacttgctttgtaaagagcagtaaatgaagttttattgtaatctgtacagaaaaaaaatattgtagtgtgctcaaaattataattttataaccagatgaagaacattaatgaatactccttaagtatatccaacactgatgtaggactgtaccaagactctaggactaggattatgttattaatgaaaaaacataaccagaaaaaaatttcagccagtagatgtctatagatattttattatccctattggtaaaaagcatataagctcaggtatatgtaacactaaactactgttaaatctgtgtttaccttgcctatctactttaacttcgtttctttgaccatgttttataggaaatagcaataagctgaaaaatttagtactctgtgtttcttcactagtacctgaacaagttaaaaatggtaattattgtagttataggtaaagggaactgaagagaaagtgaggatgttcatggtctacagtacctttagatattctcctataagccaataaatatgctctcttatgtttgctgttttgatacaagtcctactgtactcactgattaatatttaatgtaatattcaagggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaagtaagtctttttcttaaaccaaaaattgtatcccaggttcaatgactgttaataacaaatttcattacattttagggcagaagactgtgaaatatcatttttaccatttaacagctctgatgatgtgcaagaaaggtaggtaaaaactcaatgtaatacagataacctgtatctttaaagcataaaacattctgacaaacaattgatcagacttaggatctttggttatttttctaacatagtagtaaagaatatagaatcacagactcttacaggtcctagtaagcaaacaactactcactcagcctttttctctttttccttccttctttcctcccttccttccccctgtctctccctccctccttccgttctctttttcccttcccttcccctttctttcctttcctttgtttttttccctttctttccttttccctttcccttttcttttgagtgcctactatatgccaggcactttgaatacaacaatgcaccaaaaaatgaacaaaacacacagttttgtccctcgtgataattttggtctagtgtgtaatacaaatattaaagccatattaaagaagggttatagtctttaaagaaatagtacattattattccttataatactagtttacctttaaatgaatcaacacattatgttggcagcaacaaaattgtacgtttttacttactatctaattgaagaaagtatttaacatatataatgatgagttctctaattttctcatatttaatagatttgtgtgtgtctgtgtgtctgtgcgcgcgttatctgttttatgtctttgttttgttttctttcttttaggagggcacagggatctcccaaatctggtgagtcgaaaagtatctccttgagaactgtgccaggttctgttgacattttgttctggtgagggaaaataaccaatcactttcattacctttagactgtaatgatcaatggcaaatgatccagggtcagttcttgaatgtcagcattatggcaattccttgcctgtgttcagtggcacctagaggcttggcacctaataccaggttagtaagcatttttattgaattgttgatacatttcttatagaccattttttttccagggtatccaattaactgttggttagctagaaacttaacaggtagtttatctttgtatattagagattctaagggatttgtcatcacagtaggttgagaacaactgttgaactggaataattatcagataatcattgactatttaacgtcactgaggctaaaataatatttcctaagttttattgatagaattttatgcctactttacttgatttattcatttagttgtggagaacattatattaaatactgatatttcttgtgaatgtctttgctttccaactttaatgcaaacataaatatccttagcatgaaaatcacacatatgtatatttgatactgtattagtctgttttcatgctgctgataaagacatacccgagactgggtaatttacaaaagaaagaggtttaatggacttacagttccacgttgctggggaggctccacaatcatggtggaagatgaaagtcacatctcacatggcggcagacaagagagcttgtgcagggaaactcctatttttaaaaccattagatctcatgagacttattcattaccatgagagcagcacaggaaagacccacccccatgattcagttatctcccaccaggtctctcccacaacacatgggaattatgagagctacaagatgagatttgagtgggaacacaaagccaaaccatatcagatacttttagtcaaaagaaacatttcagttctatttaatgtgaatagtagtgcatatcaatctcctgcccacattttcaattgaataaaatatgagacatcttatatatatctttttatccatgggatatagacattccttctcttgcacattcttcttaatcagctgtccattatggggctgaaaatatttctttcctgaatccaatcctgtagagtgtaggagaaaggatcgtgagtgttgtgaaatataggcaataaacggggaaatattcaaagttagagaagaaaaaagagaaactgcaaacttcgatattgaaaacccagatggcaaggtcctcattaattacatctagtgctaaaacttcaaaggagtattttgaaccttgtgtgatttagaaattgagcctggtggttttccccgacaccttcagaaatcctagatagctgtgtgctttcataatgtagtttccctgactaaacttgaagacgtggctagctgaccaaggagctatgtttggcaggacttgagacaatgtttatctaaccctgtttgtttaaggaccttcttgggagggtagacctgctcttctgggaacaatcgattcatagctccttcaaagccactccataaatgttctgcttgactagaattccactgttgactctgcaggcttaatcagtattaatgaatttttcagagaaggatgactaattagagatttcttctgtggtttataatcacaacatgccatctttgcaaagaccttttgatcaagactcatttgaccggagatttttcagagatgtagcttctgatgattcaggatgattgaacaggagatttcactttcttctttttcccccaccatgataaataataatttatgttagaatatctcagtgcaaattgccagtaggaactaatattcttatattctaagtattctaagattaaatgtgttcatatatgtgagacatttaaagcagtgccagccatgtaagttgtgtttctatttcaagtaaatattgcaaagcaggcataggatagtgcttttaatgtttataaattatgcaattaaagatgcacagtaacactaccatgaacgttttggtgctgtttatttttaattgggaagaagaagcatgatggaaagcatactgagcacctggagtattggtgctgatgaccattttttctctgtgtgcctttgaacaaatcacttaaacttggagttgtcttttccctctacatgaaatgagcgaatgatgagataatctctaaggtcccttacagctctgacttgagctttcataagatactaagagctctttttttattttgttgttattcttaaattaacttcatgtttgcactgaaatcaagctagaagtcatttgtatgtatttctgcaaactgcattctatagcttgatgcatttgtgagtggctgttttggcactaaatcacacctctgaattttcactctcttatattggatggaacagttatgcaagattaaaatgttcagtcatttaactgaacatgtgtggcagcatttgttcactccatttcatccatccaaaggccactttgatttatttcatttcctatgtcacttagaccttctgtctataaataaatatttaaatcacactttagattttagaaaatgttgagctatttgttacacaacttgtgcatattaactcttctataatacatcttttaacaacatagtttcacatttagaatttctaattacattgtattttaaattatgtcttgatatgtgagtaggacgcttgatggtttgctttgtaaaatgctctaatgtaagagcttattgagaaggaagccagtgatttaataaaactcatttgaaagcctgcatcatttaaaaaatagcaagatacggtttatgaattttaggtaaacgtaacatggtgatttatctatcttgtccaatactttcagtaaacagtatacttgttataaggaacagtatgtcataatttttggtataatctcttagtaaatttcttgatgtctaatagaaatatttaatttcagattaaataatggaagtatggctcttataattgcccgaaacacttctcggccagaatttataaaacacctgaaaagatatgccagtgtaaaaaatcaggtatagtaaattctttttgttacttatttgcaaagctattaatcatgtagaaaaagatgctgcaagaattgacatcgaatcctgcctcataagaaggttttattttcttctgaatatattaatcttctttttcccaatctatttcatccaaattttgaaaagcatccgccaggattaatatagattggccttttttgaatgatgaattagtggttatgtatctgtaaccacaaagataaaataggaaatgtagtgttatattgcaatgtgaaataaattaaggataaaattccatactcaggctgttcttcagaatgaaaagaagtgaaatttgagagtttagccttcttgatattatggcagcagactttctaaagttatgatctttagatcttcctgacatttgtttgcatatctgcattgattgaaatagatctgtagatatgtatttaaaaatatgacagttttatacaaatattcattcaaaatgagaatatgtgaagatatacatttccacttaagtgatttgctttaaagagaaacagtaactattacaagccatattattttggcagctgttttgacctgattattaggaaaatgatccttgaactatgtgaatttctgaaattgtgagtctttgaagtacataggtatggttgtaaaaccctatagtttcacactttttctttttctttctttttttttttttttttgagttagagccttgctgtgtcacccaggctggagtgcagtggcgtgatgtctgctcactgcaacctccacctcccacgttcaagcgattctcctgcctcagcctcccgagtaggtgggattacaggctcacacctccatgcccagctaatttttatatttttggtagagacagggtttcaccatgttggtcaggctggtctcgaaactcctgacctcgtgatgtgtccacctcggcctcccaaagtgctgggattacaggcgtgagccaccacgtccggcccacacattcttaaaggtataaaatggtgcttggatagagttgggagataacagacgggaggaggaggagagtaaacccagccaatgactggcagctgaaccttgcttatgtaccttagccatagcaagtctctccatttttgcctcattatattttaaaactttcttaggccatcttcatgaagtttgatctgtcagtaacattatttgatcctcatgtattgaacaactaactgggctgcttaggaacttaaatcataaaaaattacagtcccactttctttatatgtcaaagtagatcagcaggtataatgtaggttgtgagcctacataacagttttatgtatgtgtttgggtggaatatggagatttattgattttcaaaggaatatatgccctttcacattttaataaatttctaaacattaaaaccaatttttaaaaaacccaaagcactatatattcattgctgtttttaagtcagaaaatagaaacaagaaaatgattttaaagcactcaaaattccatgttcctcaagattagtgtcattaccttggtagaattttttccgaatccttttttattaaataaatgagaagtaaagtaagtattaacctcattcatgtacctctatttgagaacttaaatagtattaacctattaatgtacccctgagaagttctgtatttattttggggaggtgtatgttgcacaaattgtttatggaaggtctcttttgaaattgcctatggggcaagtctctcaggcaatttttgtaaacattcttcttcttcatttttttaaatcaatatacctttcttctgattttaaaagcaatggttaccttacacataaagacagacatacagaaaataataaaaatctgtatcgataggaagacgttttctaagagataatattatgcaggatttatcatattttctcatgtactctacgaggcatatcttgcttttgacacaagaaacagttgcctgtgtgtgattcactggccttaactctgatttatttatcaactttcaaaaattaaaatccatgctattttttttttttttgcaaagaattctaaaatattttgcatagtgtatatagtaagaaagattgattcccagggtgactgctttcaagcaatgttaatttgatttgttaattatccacacaggtgtgtttatttaggctctttccttcatggtgacattaaaaatgtgaatttatataaattttgtaagattatgaaaatcagatctatgtaaaaatcatgtctactgcataattcatagcagtgctggtattcaggaaggaaaatgtggcaattcagtttaaggagagtaacatctgcttctctgaaccatttttaccaggttgaataagcgaatgttactgtataacactgtaaaatagattgaaaccaccatgtgcggagtggctcctgttccttccccatctctgtgtaaaattagatagaggctgaacactacccttcaaagtccttgcagctccatcctattgctttgccccccttctcactgtccacacttttctctttcattgtgaccatttttggtagggagtttaaaaccttaaatgtgagtgcttcccccaggatttctttgcagccctctcatcttctcaggatgccgtctcctggatggcctcattgcccctcacttttgaactgtctgaacatcatgcactcccaagggttctgtcatctcgtcttatctgcaggacctctgtcttcttgtatgctgaagaggttctgaaattcaccggcatctggaggccaacatgtctacagccgaccttatcttttcccctaaagttgttccttctgcgttgctctgtgcgggtcaatggcaccactttctacccatccaggttaccctgaactgttccttcttcctcattcctcactaccagtcccctaacttgttctgttggtctcctcttaaatgtttctaaaatttctccctcaccttaattcaaactttaatcctttcttgcttacagtagcctccttttggccttcaggttctctggtcttgtcttccatacctctttttagagaaacttttttctaagacacacattggatttctctcctgcttaattcttcagtgcctttctcttgttgtcagaataatatggaatatcctcagtctggaacacgtggcctttgtatccaggtccctgcctgtgttgcaaccccacctcttattaccaccctccaccacattcccagtgttttggcattttattcgttggctaaggttgccataacaaataccacagaaaagatggcttaaacaaacagaaatgtatttctttcatggttctggaggctagagctgcaagacaatgtcagcaggtttggtttgtcctgagtcttctctctctggctggcacatggctgctttctcacagcacccacaagtgagtggtctttcctctgttcatccccgatgccttttcctatgtccaaatttcctcttcttataaggacaccagtcgtattggatgagggcctaaagacatcattttagcttaatcgtctctttaaagatcttatctccaaatatagttatgttctgaggtatacagagcgaggatttcaatacaggaatttgagggccaaggggcatgatgttgagcacctaggagtcacactgaattctgtgtagttgcttgaccatggtttgcctctagttttgtaaatgcttcctctctccagactttcttctccaggctaaatcttatatgttctttaaggctcaattcaaatgggaagctttcccaacatccatagcctgtttgcctcctcttgtttcctctgttgaactccacacttgcaccatcatggcactcccctgtatcaaaattgtaactgtttacttctcctccccgtgccccaaacataccctcacacaggatactaagctcttggctcccgaaagtcccacttaacagcgtctgtggcttcacagttaaagcatttgaaggatggctagatcttcattttgtgaggagtgcacatgacaactgctgatttaagataatagacttactggtggtggctgtcaattcttgacattccttggcttacagctgcatccctccagtctctgactctgccatccttggcattcttctctcataaggacatcagtcatattggattaggtcccgccctaatgacttcatcttaagttgattctacctgcaaagaccctatttctaaacaggggacattcacaggtaccaggggttaggacttgaacatagttggggtggtggagggaaatataatttagatcataacaggcagttgtgtgttttaaatgaattatcaactaacatgaatgattatgtagataattctacaaggatgaggcatgtagccaaggctttatacccgaggtaggaggtctaacgcagttactgtcaaacagttttgcttggggccctctaattctgtacctcagtcacaacagctgatgccatcatatcatctactgtttaactgtgtttacagtataaactggaaagttggctggaccttggtatctacatatgtaaaatatgggtgttggggaaaatattagttttctgtcaacttttaaaactgtttcattgaggtttacatgtggaaaaggggaaaaactatgtagatgatgtttaattaggaatgtatctcatgtcatttttctgaaaactgaaatgagtagttatacatttctgctcaagttatttggctatattttcttaattatgtcagaaaatacatagtgctttttcagtatagtttccttaggcaaacaagaaaaaacgcaagttgaagtttaccttgcaccattctatagtggtaagtaaacagtgatcttgcagcttgtgtccattgttaaagtgggaatggggcaggcaaacaccttttaaaatccatatttgattggctttctcttttaaaagaagacatacatcccattttatcttcagaagtttagacttgcgttcttccaaattaaattccaagtgtgaaacttgtactagtttgctttatgtcagctaaactaattgacaagttgataatggattatatgtcttctgtatctacaggccagtattaaagattatctttaattgaaaaatctacagtatcactattttatgtaacttctcacagatatgtactatttgtcataaaacaagatttctaggtgctagatctaaaagaacccaaaaggctttggataagagattccttcttccaaaaaaacttggagatccctgttcatagtctcaaagctattaaaatgtcagcatacatgctgatatttacttgtgagagagggctcagtgaactttgattcgcgttagtagctagagataaaccaagtataatgattatttgtatttatttttagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattaggtaagtctatttatttcaccgcttattgtcaaccagtaaacataaatctaatattacaacgaaagctctcttctctgaactatcaaagcaggcagttggttagtttttaaaaaatcagtaaatcagggaagcataaagagacatgcacaaatttcaataaataaaaagcaactttacatttattcaactgttatgtagacccaaggcattttctttggttatgcgtgtctacattggctttctaatttattgttgtgcataaactacagataatgtctacaacttccattttggatttttaaaaatggatcaagatcttaaatcttttagtggagccatctgaatagtaaagtgttagatttttatccttccatcttagtttcctctcactcataattactgtaacatgttttgttcagtaatttgcttttattaggcctttacagagcattcaacttcccttgggaacaattttacatagcaactggtataaacaggtttaggaacctgcaaacgcattcttggtaggcattgtgacactcagtggttagaagaagcatgcaggggtgcccactagacatgggtgttctagaggcataactgactgttttacagaggtaatggagagcattggacaatcaaggaagtcagttaaggaggttttagagcaattattgttgttgatgatttatcaatcagaccttctcagttttctagattacagctctgttgggaatgctgtgtttgttatcaatttgtatttggcattggcattgtgtaccatacttattaggtgtatgtgaaaaacaacaaaataagttgatgaaataatgtattttctttacagattgcatccaagacttatcagtctttatggaggaagcatggaagaaatgattccaaagtaacatgtaattgtttctaaaagaaatgtacaaactagaattttaatataaagaaatgtggccatgctttaaacctgtggtccccaccctttttgggaccagtttcatggaagacaatttttccgtggatgggggaatggtttcaggatgaactgttccacctcagatcatcaggcattagattctcttgaggaacatggcactctagatccctcacataccagttcaccatatggttcgcacttctatgagaatctaatgctgctgctgatctgacagggggaggaactcagtaatgctccattgctctaacctcctgctgtgtggccaaacggatatcctaatagaaattgatgttactaacaattagcctctagggctttaaaagtcaagatgaaatatcaattcaaattctgtttttagatatcaattcaaattcttttttttacaatgtgtttattggacacacaaaaaaactttgcaaccatcataatacatcaatatttaacctagataattctgaaataatttggattctttcatttttcaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttcttaaagtggtagggttttaaaattcatgatacaagtaacaaagtaagttgataacaaatactattttgaactgggcaaaatctagcccaatatgtaattgtgttccccttgtatctgagaggcctgtgttggacaaccatagtactctgctttcactgtgctcagataacctgaaatatatagttgtttctgagtagttctgagtaggaaagaaccaaatgtaaatttccttagagaccatcctggagaagacagttctaaatcggggcttgatttttcatctatgatcctagatgttctcctgaaagaatgactagcctttttataacgatacaaagttttttaaaaatacataaatgtcataaagtttattcctgtgtatacacactctgggttcaggaggttttgtgcttacatttcactactcaaatgccttcgcaaatctcagaacattcctcaccatcactgcaggcctgtgaacagataactttcatcaattaggatggctggctagtggcagggacttcatataaagaaatctttcccagaattgtttttccacattgccttctaatttgatcactccctataacagatgttcaaaattcggccacagctctcttatgaaggcagagtcagataaaatgatattctgcaattatctagatcataagcataaaataaatattacaaaaatgattgtatttaaagaaattttttaaaatccagaaagtcatttaaaatagaacctcatatagtatgaacaaactataaaaatattttacatttca

(The sequence listing continues in the following parts.)

What is claimed is:

1. A method of administering a compound to a human individual, the method comprising:

determining, or having determined, from a biological specimen obtained from the individual, the individual's genotype at the single nucleotide polymorphism (SNP) locus rs993648;

in the case that the individual's genotype at the rs993648 locus is AG and not associated with an increased risk of QT prolongation, administering to the individual a first quantity of iloperidone, an iloperidone metabolite, or a pharmaceutically-acceptable salt thereof; and in the case that the individual's genotype at the rs993648 locus is non-AG and associated with an increased risk of QT prolongation, administering to the individual a second quantity of iloperidone, an iloperidone metabolite, or a pharmaceutically-acceptable salt thereof that is less than the first quantity that would be administered to an individual having an AG genotype at the rs993648 locus.

2. The method of claim 1, further comprising:

determining the individual's CYP2D6 genotype.

3. A method of administering a compound capable of prolonging a QT interval to a human individual suffering from long QT syndrome (LQTS), the method comprising:

determining the individual's genotype at the single nucleotide polymorphism (SNP) locus rs993648; and administering to the individual a quantity of iloperidone, an iloperidone metabolite, or a pharmaceutically-acceptable salt thereof based on the individual's genotype at the rs993648 locus, wherein an individual determined to have an AG genotype at the rs993648 locus is administered 24 mg/day of iloperidone, an iloperidone metabolite, or a pharmaceutically-acceptable salt thereof and an individual determined to have a non-AG genotype at the rs993648 locus is administered less than 24 mg/day of iloperidone, an iloperidone metabolite, or a pharmaceutically-acceptable salt thereof.

4. The method of claim 3, further comprising:
determining the individual's CYP2D6 genotype.

5. The method of claim 1, wherein the first quantity is 24 mg/day.

6. The method of claim 1, wherein the individual is suffering from long QT syndrome (LQTS).

* * * * *